United States Patent
Olek et al.

(10) Patent No.: US 8,298,762 B2
(45) Date of Patent: Oct. 30, 2012

(54) SPECIFIC DNAS FOR EPIGENETIC CHARACTERISATION OF CELLS AND TISSUES

(75) Inventors: Sven Olek, Berlin (DE); Ivana Türbachova, Berlin (DE); Paul Gardina, San Francisco, CA (US)

(73) Assignee: Epiontis GmbH, Berlin (DE)

( * ) Notice: Subject to any disclaimer, the term of this patent is extended or adjusted under 35 U.S.C. 154(b) by 749 days.

(21) Appl. No.: 11/908,392

(22) PCT Filed: Mar. 13, 2006

(86) PCT No.: PCT/EP2006/002299
§ 371 (c)(1),
(2), (4) Date: Jul. 31, 2009

(87) PCT Pub. No.: WO2006/094836
PCT Pub. Date: Sep. 14, 2006

(65) Prior Publication Data
US 2009/0305234 A1    Dec. 10, 2009

(30) Foreign Application Priority Data

Mar. 11, 2005  (EP) .................................. 05005370
Jun. 6, 2005   (EP) .................................. 05012132

(51) Int. Cl.
*C12Q 1/68* (2006.01)
(52) U.S. Cl. ....................................................... 435/6.1
(58) Field of Classification Search .................. None
See application file for complete search history.

(56) References Cited

FOREIGN PATENT DOCUMENTS

| WO | WO 01/75177 A | 10/2001 |
| WO | WO 02/00928 A | 1/2002 |
| WO | WO 03/064700 A | 8/2003 |

OTHER PUBLICATIONS

Aguiar, Dean J. et al., "Gene expression in bone marrow derived mesenchymal stem cells during cartilage differentiation," *Blood*, Nov. 16, 2000, vol. 96, No. 11 Part 2, p. 113b, Abstract #4172.
Goessler, U.R. et al., "[A comparison of the gene expression patterns of human chondrocytes and chondrogen differentiated mesenchymal stem cells for tissue engineering,]" *HNO*, Apr. 2006, vol. 54, No. 4, pp. 258-266.
Imamura, T. et al., "CpG Island of Rat Sphingosine Kinase-1 Gene: Tissue-Dependent DNA Methylation Status and Multiple Alternative First Exons," *Genomics*, Academic Press, San Diego, US, Aug. 2001, vol. 76, No. 1-3, pp. 117-125.
Kawaguchi, J. et al., "The transition of cadherin expression in osteoblast differentiation from mesenchymal cells: consistent expression of cadherin-11 in osteoblast lineage," *Journal of Bone and Mineral Research: The Official Journal of the American Society for Bone and Mineral Research*, Feb. 2001, vol. 16, No. 2, pp. 260-269.
Ohgane, Jun et al., "Analysis of tissue-specific DNA methylation during development," *Methods in Molecular Biology*, Clifton, NJ, 2005, vol. 289, pp. 371-382 [Online].
Takatsu, Masaki et al., "Age-dependent alterations in mRNA level and promoter methylation of collagen alpha1(I) gene in human periodontal ligament," *Mechanisms of Ageing and Development*, Oct. 1, 1999, vol. 110, No. 1-2, pp. 37-48.
Tholpady, S. S. et al., "Mesenchymal stem cells from rat visceral fat exhibit multipotential differentiation in vitro," *Anatomical Record*, May 2003, vol. 272A, No. 1, pp. 398-402.

*Primary Examiner* — James Martinell
(74) *Attorney, Agent, or Firm* — Saliwanchik, Lloyd & Eisenschenk

(57) ABSTRACT

The present invention provides methods, nucleic acids and molecular markers for the characterization of cells, tissues and heterogeneous mixtures of cells. Specifically, it describes particular genes and genomic regions in which DNA methylation patterns are a consistent and characteristic property of different cell types, states and stages of differentiation. The invention is useful in determining the identity, composition, quality and potency of cells and cell populations. Furthermore, the invention will be useful in monitoring the differentiation of cells.

22 Claims, 2 Drawing Sheets

SPECIFIC DNAS FOR EPIGENETIC CHARACTERISATION OF CELLS AND TISSUES

FIELD OF INVENTION

The present invention provides methods, nucleic acids and molecular markers for the characterization of cells, tissues and heterogeneous mixtures of cells. Specifically, it describes particular genes and genomic regions in which DNA methylation patterns are a consistent and characteristic property of different cell types, states and stages of differentiation. The invention is useful in determining the identity, composition, quality and potency of cells and cell populations. Furthermore, the invention will be useful in monitoring the differentiation of cells. In addition, this invention allows to define discriminatory methylation profiles that are descriptive of particular cell types. Once these are known, the ratios of various cell types in a heterogeneous mixture can be determined. Due to the unpredictability of in-vitro handled cells, such a complexly informative system would be ideal as analytical tool for the determination of the quality of cell products, supplementing to, or even replacing, currently available molecular methods. Therefore, DNA methylation can provide a valuable alternative to the established analytical tools for characterising engineered cells Regenerative Medicine and Cell Identification In novel medical approaches related to "regenerative medicine" (including the sub-disciplines "tissue engineering" and "cell therapy") biological substitutes, such as cells and growth factors, are used to heal or replace damaged and diseased tissues and cells. In some cases, cells may be extensively manipulated in the laboratory and possibly changed from one cell type into another.

As one example, chondrocytes may be isolated from damaged knee cartilage, multiplied in the laboratory and re-implanted surgically to heal the injury. In other cases, such as Autologous Stem Cell Transplants (ASCT), it may be sufficient to purify or enrich a particular type of precursor cell (usually stem cells) that can develop into a target tissue naturally when re-infused into the body. ASCT, which is a widely employed treatment for blood diseases, utilises purified stem cells to rebuild the immune system after chemotherapy. More ambitious tissue engineering projects include attempts to produce pancreatic beta cells (to treat diabetes) or dopaminergic neurones (for Parkinson's and other neural diseases) from their respective precursor cells. Presently, however, extensively manipulated cells are produced mainly for metabolically inactive tissues, such as cartilage and skin.

A fundamental deficiency of regenerative medicine (and cell biology in general) is the lack of adequate methods to accurately identify and characterise living cells. Cells are complex, intrinsically variable entities whose internal workings are largely invisible to researchers. Furthermore, the engineering of cells remains at a rudimentary stage because the rules governing the conversion from one type of cell into a different type ("differentiation") are largely unknown. These difficulties are exacerbated by the long developmental times involved—usually on the order of weeks or months—and the fact that in vitro cultures are generally mixed populations of cells in various stages of differentiation or even different cell types.

Analytical shortcomings have strong adverse effects on three basic areas:

(1) Identity/purity is a confirmation that the product precisely matches its labelling and contains no extraneous material. However, because cells are complex entities that display inherent biological variation, precise definitions of cell identity (and therefore purity) with traditional technologies are dubious. Such problems are magnified by the fact that minute cellular impurities (e.g., cancerous cells) could pose immense hazards.

(2) The potency of a product is its functional ability to achieve some desired medical outcome. The intrinsic complexity and variation of cells also interferes with the ability to predict the therapeutic efficacy of product cells. Subtle, but critical, differences between any two particular batches of cells will probably not be detectable with current methods.

(3) Process optimisation requires the ability to monitor changes in cell status during in vitro manipulations to determine whether the process is proceeding in the expected direction, to analyse growth/differentiation/inhibition factors, and to optimise the process for maximum yield.

PRIOR ART

The conventional mechanisms to classify/identify cells involve extensive usage of heterogeneous biochemical and molecular procedures. These approaches, which are the current state of the art, are described below:

1. Morphology (histology): a microscopic examination of cell shape and features. This may be useful in cases in which cells display a distinctive shape (long axons in neurones) or an easily recognisable feature (a lipid vesicle stained for fats), but most cells are difficult to distinguish based on appearance alone. Histology requires a highly trained adept and is impossible to apply in high throughput.

2. Protein-based analysis (biochemical/immunological): detection of specific proteins that may be indicative of a particular cell type. The proteins are recognised by their cognate antibody either on the cell surface (immunohistology) or from disintegrated cells (immunoblotting/ELISA) (Molecular Biology Protocols (1997) ed. M. B. Frank, Oklahoma City, USA; Current Protocols in Molecular Biology (2001) ed. F. M. Ausubel et al., John Wiley & Sons, NY, USA, 2001). These assays are generally sensitive, fast and simple, and offer the possibility of cell sorting with fluorescently or magnetically tagged antibodies. However, they provide little informational complexity since each antibody recognises only one particular protein. This is a major disadvantage since a single protein marker is rarely a guarantee of a particular cell type. Larger scale protein detection methods (proteomics) suffer from insufficient sensitivity and a lack of capability for automation.

3. RNA-based analysis: detection of mRNA, which reflects gene expression, is performed in individual analyses or in array systems (Spellman et al., Mol Biol Cell 9:3273-97, 1998; DeRisi et al., Science 278:680-686, 1997; Burton et al., Gene 293:21-31 2002). This widely used technology can produce a great deal of information about the current state of the cell since the overall pattern of gene expression is revealed. Aside from its technologically difficult set-up, the decisive drawback of this system is the instability of RNA. Every experiment with RNA must take into account the degradation of RNA that may occur during sample collection, storage and the experimental procedure. This is particularly problematic when working with archived samples (e.g., preserved biopsies) or with limiting amounts of cellular material. A further, biologically inherent problem is that mRNA fluctuates in response to temporary changes environmental conditions. Together, these factors mean that meaningful expression changes are blurred by random degradation and transient background noise. Robustness, reproducibility and interpretation are therefore a grave issues for all RNA-based technologies. Both biological and stochastic variability must be countered by intense bioinformatic analysis. In general, RNA-based arrays are a useful discovery tool, but not yet widely applicable as a clinical or large scale assay method (Miller et al., Cancer Cell 2:353-61, 2002; Nadon and Shoemaker, Trends Genet 18:265-71, 2002; Murphy D, Adv Physiol Educ, 26:256-70, 2002).

DNA Methylation

Even though almost all cells in an individual contain the exact same complement of DNA code, higher organisms must impose and maintain different patterns of gene expression in the various tissue types. Most gene regulation is transitory, depending on the current state of the cell and changes in external stimuli. Persistent regulation, on the other hand, is a primary role of epigenetics—heritable regulatory patterns that do not alter the basic genetic coding of the DNA. DNA methylation is the archetypical form of epigenetic regulation; it serves as the stable memory for cells and performs a crucial role in maintaining the long term identity of various cell types.

The primary target of methylation is the two nucleotide sequence Cytosine-Guanine (a 'CpG site'); within this context cytosine (C) can undergo a simple chemical modification to become 5-methyl-cytosine. In the human genome, the CG sequence is much rarer than expected except in certain relatively dense clusters called 'CpG islands'. CpG islands are frequently associated with gene promoters, and it has been estimated that over half of human genes have CpG islands (Antequera and Bird, Proc Natl Acad Sci USA. 90:11995-9, 1993).

Aberrant methylation of DNA frequently accompanies the transformation from healthy to cancerous cells. Among the observed effects are genome-wide hypomethylation, increased methylation of tumour suppressor genes and hypomethylation of many oncogenes (reviewed by Jones and Laird, Nature Genetics 21:163-167, 1999; Esteller, Oncogene 21:5427-5440, 2002; Laird, Nature Reviews/Cancer 3:253-266, 2003). Methylation profiles have been recognised to be tumour specific (i.e., changes in the methylation pattern of particular genes or even individual CpGs are diagnostic of particular tumour types) and there is now an extensive collection of diagnostic markers for bladder, breast, colon, oesophagus, stomach, liver, lung, and prostate cancers (summarised by Laird, Nature Reviews/Cancer 3:253-266, 2003).

Epigenetic control by methylation is essential for early development including embryogenesis, X-chromosome inactivation and imprinting (monoallelic silencing) of either the paternal or maternal allele (Erlich, J Cellular Chem 88:899-910, 2003). There is also a class of genes that is active in the germline, but is silenced by methylation in somatic cells (Bird, Genes and Dev 16:6-21, 2002; Li, Nature Reviews/Genetics 3:662-673, 2002).

Tissue-specific methylation also serves in regulating adult cell types/stages, and there are examples in which a causal relationship between methylation and gene expression has been established. The following is a partial list of genes for which methylation changes are strongly implicated in controlling gene expression in tissue-specific manner: Lactate dehydrogenase C (testes); Oxytocin receptor (blood & liver); Tyrosine aminotransferase (liver); GFAP (astrocytes); and Leukosialin (leukocytes). In other cases, methylation may be a byproduct of some other primary regulation, or it is required to lock the gene in the 'off' state (Erlich, J Cellular Chem 88:899-910, 2003). However, for a statistical correlation between methylation patterns and cell types, the recognition of a causal relationship is not required.

A previously published example for such a cell type and cell status specific modification of certain gene regions is found during the lineage commitment of T-cells to helper T-cells (Th1 or Th2). Naïve (unstimulated) CD4+ T-cells become activated upon encountering an antigen and can be committed to alternative cell fates through further stimulation by interleukins. The two types of helper T-cells show reciprocal patterns of gene expression; Th1 produces Interferon-gamma (IFN-g) and silences IL-4, while Th2 produces IL-4 and silences INF-g (Ansel et al., Nature Immunol 4:616-623, 2003). For both alternative cell fates, the expression of these genes is inversely correlated with methylation of proximal CpG sites. In Th2 and naïve T-cells the IFN-g promoter is methylated, but not in Th1 cells where IFN-g is expressed (Attwood et al., CMLS 59:241-257, 2002). Conversely, the entire transcribed region of IL-4 becomes demethylated under Th2-inducing conditions, which strongly correlates with efficient transcription of IL-4. In Th1 cells, this extensive demethylation does not occur, rather particular untranscribed regions gradually become heavily methylated and IL-4 is not expressed (Lee et al., Immunity 16:649-660, 2002). Furthermore, Bruniquel and Schwartz (Nat Immunol. 4:235-40, 2003) have demonstrated that in naïve T-cells, the IL-2 promoter is heavily methylated and inactive, but after activation of the naïve T-cell, the IL-2 gene undergoes rapid and specific demethylation at 6 consecutive CpGs. This alteration in methylation patterns occurs concomitantly with cell differentiation and increased production of the IL-2 product.

Previous suggestions to use genomic methylation patterns as discriminatory tools in cell typing (Ataru, et al., EP 1 213 360, JP 2002-171973) rely mainly on what are in fact "discovery" methods. These are broad screening techniques for uncovering localised differences in the methylation patterns between two or more pure samples of cells. However, further steps are required to determine which exact DNA regions are affected by differential methylation. An effective analytical tool must be guided by specific markers—known targets whose methylation status is an absolute indicator of the cell type. Such large scale discovery methods are not useful as an assay method since:

1. they are not useful in quantitating the proportions of mixed cell populations;
2. they are not capable of detecting minute impurities (e.g., cancerous cells);
3. they are not applicable as a routine testing mechanism or as a large scale, high throughput assay technology; and
4. usable markers must be identified and validated on multiple samples to establish a true statistical significance.

It is therefore an object of the present invention, to provide a method of expression analysis and, in particular, expression analysis based on DNA methylation analysis as a superior tool that can supplement or replace conventional methodologies as an indicator of cell type and status.

This object of the present invention, in one aspect thereof, is solved by a method for determining the presence of a cell in a biological sample, comprising the step of determining the expression level of at least one of the genes selected from the group of COL3A1, CAV1, PRELP, SPP1, CHAD, ANXA6, KRTHB6, BGN, LTA, FGFR1, HIF1A, GDF5, PTHR1, BMP4, GLI3, COL2A1, IGF2, LPIN1, TDGF1, KRT8, CD4, CNTN1, COL6A3, FMOD, PKNOX2, C15orf27, ROPN1L, and ACVRL1, whereby an expression profile is generated that is specific for the cellular characteristics of a selected cell.

Thus, in one aspect thereof, the present invention refers to specific genes whose expression was surprisingly found to be indicative for certain cell types and statuses. In one aspect of the present invention, these genes can therefore be used to characterise cell types and statuses in biological samples that contain a mixture of, for example, cells of unknown type and/or status.

Preferred is a method according to the present invention, wherein the expression level of at least two of said genes is determined. Preferred is further a method according to the present invention, wherein the expression level of all of said genes is determined. The genes that form the basis of the present invention are preferably to be used to form a "gene panel", i.e. a collection comprising the particular genetic sequences of the present invention and/or their respective informative expression and/or methylation sites. The formation of gene panels allows for a quick and specific analysis which is indicative for particular cell types and statuses. The gene panel(s) as described and employed in this invention can be used with surprisingly high efficiency for the determination of the presence of a cell in a biological sample. In addition, the use of multiple CpG sites from a diverse array of genes allows for a high degree of sensitivity and specificity in comparison to single gene diagnostic and detection tools.

In another aspect thereof, the method according to the present invention further comprises a specific selection of the genes to be determined based on the quality of the expression analysis for said selected cell. This is, while the broad panel with 25 genes can be employed for distinguishing a wide range of cell types with highest accuracy, it is possible to using only a fraction of the panel for the identification and quantification of a smaller group of cell types. In cases where it is known that not all cell types may be present or relevant for the analysis, a selected panel consisting of less markers than all 25 may be used. For example, in a case where a differentiation experiment is performed with mesenchymal stem cells that produces only a subset of cell types within the mesengenic differentiation pathway (e.g., adipocytes, chondrocytes, fibroblasts and osteoblasts), there is demand only for the analysis of 5 cell types and their differential methylation patterns. For this analysis, one may therefore only include markers for mesenchymal stem cells, adipocytes, chondrocytes, fibroblasts and osteoblasts, while one may not be looking for markers for keratinocytes or melanocytes. In this case, a mini-marker panel may be generated for this purpose, with less than the full set of 25 markers to achieve both identification and quantification of the investigated population. In the most extreme case, such minipanel may—in dependence on the addressed question—consist of no more than one marker. This minimal scenario is feasible in two situations. On one hand such situation could occur when only two cell types are possibly present in a heterogeneous cell population. In this case, a single marker gene that has a consistent and distinctive methylation pattern between the two cell types is capable of distinguishing and quantifying them. Alternatively, such minimal panel is applicable in a more heterogeneous mixture (i.e. more than two cell types are possibly present), when the single investigated marker is known to be exclusively methylated (or unmethylated) in one particular cell type, while it is in the opposite state in all other cells. In this latter case and when the addressed question only refers to the quantification and analysis of the presence of this particular one cell type, a single marker from the large panel is eligible.

It is also an alternative embodiment of the invention to base the determination of the presence of a cell type in a biological sample on a combination of different markers as described above. To increase the likelihood of a correct determination, it is preferred that the expression of several selected additional genes is investigated. It is preferred that in such a "mini panel" comprising one or more genes, additional genes are used up to a number of 25. The preferred number of genes to be added to such a mini panel, would be one or more out of the group as described above. Especially preferred would be a combined analysis of up to 8 of the 25 genes as described, in order to distinguish between cell types and statuses with a sufficient high level of quality of said analysis. Other preferred combination would comprise the expression analysis of 4, 5, 6 and 7 genes. Wherever in the following the invention is described specifically for a particular cell type that is detected, it is meant to also include a combination of one gene of the above panel with one or more of the named genes.

While all of the present markers carry useful information in various contexts, there are several preferred combinations with variable utility. For example, COL6A3, FMOD, COL3A1, GDF5, and HIF1A typically show large blocks of consecutive CpGs which are either strongly methylated or strongly unmethylated in many cell types. Because of their 'all-or-none' character, these markers are likely to be very consistent and easy to interpret for many cell types. Thus, especially preferred would be a combined analysis of these 5 markers—or if an equivalent accuracy is achieved, possibly a subset of these markers consisting of 4, 3 or even 2 markers. Markers/CpGs that are consistently, e.g., 30% methylated in one cell type and 70% methylated in another cell type are also very useful. In some cases, the discriminatory methylation may be restricted to one or a few CpGs within the gene, but individual CpGs can be reliably assayed, as with single base extension (see below).

Certain markers demonstrated methylation patterns affecting regions of specific genes that were particularly distinctive in some cell types relative to the other cell types tested. For example, regions of CHAD, COL2A1, CAV1, ACVRL1 and ANXA6 are most heavily methylated in melanocytes, while PTHR1, KRT9 and FGFR1 are most heavily methylated in keratinocytes. Genes FMOD, FGFR1, HIF1A and CNTN1 are least methylated in chondrocytes, COL3A1 is least methylated in adipocytes, KRT8 and CAV1 are least methylated in keratinocytes, KRT9 the least in melanocytes, and CD4 the least in Mesenchymal Stem Cells (MSCs). Keratinocytes and melanocytes are methylated in PTHR1 and COL6A3, while all the other cell types were not. Gene SPP1 is distinctive for osteoblasts among the differentiated cell types tested. Heavy methylation in GDF5 separates keratinocytes and melanocytes from all other cell types except osteoblasts (which is weakly methylated). CAV1 appears most useful in separating melanocytes from keratinocytes, while BGN appears most useful in separating melanocytes from fibroblasts, and FGFR1 for separating chondrocytes from keratinocytes. Thus, other preferred combinations would comprise the expression analysis of 2, 3, 4, 5 or 6 genes. The genes FMOD, FGFR1, HIF1A, KRT8, PKNOX2, ROPN1L, and C15orf27 can be used in order to distinguish between chondrocytes and synovial fibroblasts/fibroblasts.

Also, some CpGs in particular genes (FGFR1, HIF1A, BGN, CHAD, GLI3 and CD4) appear to be sensitive to changes in growth conditions (e.g., prolonged growth as a monolayer), while some (CHAD, ANXA6, BGN, HIF1A and PRELP) are sensitive to induction with growth factors.

Preferred is a method according to the present invention, wherein determining the expression level comprises determining the mRNA and/or protein expression and/or analysis of the methylation status and/or analysis of other epigenetic markers.

Said expression level analysis of the genes may be enabled by means of mRNA expression analysis or protein expression analysis or by analysis of its genetic modifications leading to an altered expression. However, in the most preferred embodiment of the invention, the expression analysis is enabled by means of analysis of the methylation status of CpG sites within the genes (e.g. in introns and/or exons), and/or their promoter or regulatory elements, and/or contiguous regions.

To detect the levels of mRNA encoding the genes in a detection system, a sample is obtained from a patient. Said obtaining of a sample is not meant to be retrieving of a sample, as in performing a biopsy, but rather directed to the availability of an isolated biological material representing a specific tissue, relevant for the intended use. The sample can be—amongst other as described herein below—primary cell cultures, cell lines, differentiated cells, a surgically removed tissue sample, a biopsy sample as taken by a surgeon and provided to the analyst or a sample of blood, plasma, serum or the like. The sample may be treated to extract the nucleic acids contained therein. The resulting nucleic acid from the sample is subjected to gel electrophoresis or other separation techniques. Detection involves contacting the nucleic acids and in particular the mRNA of the sample with a DNA sequence serving as a probe to form hybrid duplexes. The stringency of hybridisation is determined by a number of factors during hybridisation and during the washing procedure, including temperature, ionic strength, length of time and concentration of formamide. Detection of the resulting duplex is usually accomplished by the use of labelled probes. Alternatively, the probe may be unlabeled, but may be detectable by specific binding with a ligand which is labelled, either directly or indirectly. Suitable labels and methods for labelling probes and ligands are known in the art, and include, for example, radioactive labels which may be incorporated by known methods (e.g., nick translation or kinasing), biotin, fluorescent groups, chemiluminescent groups (e.g., dioxetanes, particularly triggered dioxetanes), enzymes, antibodies, and the like.

In order to increase the sensitivity of the detection in a sample of mRNA encoding the genes, the technique of reverse transcription/polymerisation chain reaction can be used to amplify cDNA transcribed from mRNA encoding the genes. The method of reverse transcription/PCR is well known in the art. The reverse transcription/PCR method can be performed as follows. Total cellular RNA is isolated by, for example, the standard guanidium isothiocyanate method and the total RNA is reverse transcribed. The reverse transcription method involves synthesis of DNA on a template of RNA using a reverse transcriptase enzyme and a 3' end primer. Typically, the primer contains an oligo(dT) sequence. The cDNA thus produced is then amplified using the PCR method and gene specific primers. (Belyavsky et al, Nucl Acid Res 17:2919-2932, 1989; Krug and Berger, Methods in Enzymology, Academic Press, N.Y., Vol. 152, pp. 316-325, 1987 which are incorporated by reference in their entireties).

The present invention may also be described in certain embodiments as a kit for use in determining the presence of a cell in a biological sample through testing of a biological sample. A representative kit may comprise one or more nucleic acid segments as described above that selectively hybridise to the mRNA of at least one of the above genes and a container for each of the one or more nucleic acid segments. In certain embodiments the nucleic acid segments may be combined in a single tube. In further embodiments, the nucleic acid segments may also include a pair of primers for amplifying the target mRNA. Such kits may also include any buffers, solutions, solvents, enzymes, nucleotides, or other components for hybridisation, amplification or detection reactions. Preferred kit components include reagents for reverse transcription-PCR, in situ hybridisation, Northern analysis and/or restriction polymorphism analysis (RPA).

The present invention further provides for methods to detect the presence of the polypeptide of the genes as above, e.g., in a sample obtained from a subject. Any method known in the art for detecting proteins can be used. Such methods include, but are not limited to immunodiffusion, immunoelectrophoresis, immunochemical methods, binder-ligand assays, immunohistochemical techniques, agglutination and complement assays. (for example see Basic and Clinical Immunology, Sites and Terr, eds., Appleton & Lange, Norwalk, Conn. pp 217-262, 1991 which is incorporated herein by reference). Preferred are binder-ligand immunoassay methods including reacting antibodies with an epitope or epitopes of the genes and competitively displacing a labelled protein or derivative thereof.

Certain embodiments of the present invention comprise the use of antibodies specific to the polypeptide encoded by the genes as above. In certain embodiments production of monoclonal or polyclonal antibodies can be induced by the use of the polypeptide(s) of the gene as antigen(s). Such antibodies may in turn be used to detect expressed proteins as markers for detecting the presence of the polypeptide of the genes as above. The levels of such proteins present in the peripheral blood of a patient may be quantified by conventional methods. Antibody-protein binding may be detected and quantified by a variety of means known in the art, such as labelling with fluorescent or radioactive ligands. The invention further comprises kits for performing the above-mentioned procedures, wherein such kits contain antibodies specific for the polypeptides of the genes as above.

Numerous competitive and non-competitive protein binding immunoassays are well known in the art. Antibodies employed in such assays may be unlabeled, for example as used in agglutination tests, or labelled for use a wide variety of assay methods. Labels that can be used include radionuclides, enzymes, fluorescers, chemiluminescers, enzyme substrates or co-factors, enzyme inhibitors, particles, dyes and the like for use in radioimmunoassay (RIA), enzyme immunoassays, e.g., enzyme-linked immunosorbent assay (ELISA), fluorescent immunoassays and the like. Polyclonal or monoclonal antibodies to the genes as above or an epitope thereof can be made for use in immunoassays by any of a number of methods known in the art. One approach for preparing antibodies to a protein is the selection and preparation of an amino acid sequence of all or part of the protein, chemically synthesising the sequence and injecting it into an appropriate animal, usually a rabbit or a mouse (Milstein and Kohler Nature 256:495-497, 1975; Gulfre and Milstein, Methods in Enzymology: Immunochemical Techniques 73:1-46, Langone and Banatis eds., Academic Press, 1981 which are incorporated by reference). Methods for preparation of the polypeptides of the genes as above or an epitope thereof include, but are not limited to chemical synthesis, recombinant DNA techniques or isolation from biological samples.

In the context of the present invention, it could be shown that promoters, promoter-proximal regions or coding sequences of particular genes show cell type- or state-specific chemical modifications. The inventors revealed genes and gene regions that behave principally similar to the example stated above for T cell differentiation. In particular, a number of genes/gene regions have been discovered that are sensitive indicators of cell type/status depending on their degree of methylation. The methylation phenotype of these regions are found to be variable between cell types, but maintain a consistent methylation phenotype within cell types. They have been validated on multiple samples of each cell type and will serve as markers that can be specifically targeted in assays to determine cell identity, purity and potency. Furthermore, they are indicators of essential changes in cellular character and thus are useful in tissue engineering and for monitoring compounds that effect such changes.

Thus, in one particular aspect thereof, the invention takes advantage of the observation that certain epigenetic properties of a cell's DNA correlate with the cell type and differentiation status. Particularly, the methylation patterns associated with the described genes is indicative of its identity and status. The consistency, stability and uniformity of this approach make it a useful complement to or replacement for the conventional techniques for assessing cells, which suffer from a range of disadvantages.

The inventors describe a series of genes and genetic regions whose epigenetic (e.g. methylation) patterns are statistically correlated to the type of cell. As such, these regions represent particularly sensitive and useful markers for distinguishing cell type.

More preferred is a method according to the present invention, wherein said cell is present in said biological sample in a cell population, cellular batch, a heterogeneous population of cells, a subpopulation of cells, a tissue, an organ and/or a non-human organism.

In another aspect thereof, the method according to the present invention, further comprises determining the identity, purity, cell type, cellular status, composition, relative proportion, absolute amount and/or potency of said cell based on said presence in said biological sample. The present invention thus provides methods and nucleic acids for the determination of purity, identity and potency of cells by epigenetic analysis of specific genes or genomic regions. Examples are as follows:

Identity/purity—Using the methods and nucleic acids claimed herein, it will be possible to determine the components and proportions of cell populations (i.e., cell types, cell stages, etc.) within a batch. It will also, for example, be possible to identify contaminants in the batch.

Potency—Using the methods and nucleic acids described herein, cell batches and their origins and/or growth treatment in culture can be statistically correlated to the success of the treatment. As such, the described nucleic acids and methods are to be used to assess the suitability of tissue engineering procedures and provide a way to predict the validity of cell batches. The derived knowledge should be utilised to assist patients and clinicians in determining improved treatment and tissue culturing options.

In yet another aspect of the method according to the present invention, the determining comprises calculation by an algorithm based on linear algebra. Further details regarding this are outlined below (see "Data analysis").

Preferred is a method according to the present invention, wherein one or any combination of the following cell types are analysed: keratinocytes, chondrocytes, osteoblasts, melanocytes, fibroblasts, adipocytes, or mesenchymal stem cells. The methylation profile may be, for example, employed to determine or confirm the identity of a relatively homogeneous cell sample. For example, the patterns generated by MS-SNuPE in FIG. 2 are consistent with that of essentially pure adipocytes or keratinocytes.

More preferred is a method according to the present invention, wherein said analysis of the methylation status comprises a chemical or enzymatic conversion of the DNA. Usually, chemical conversion is performed with bisulfite treatment as described herein, and enzymatic conversion is performed using methylation-sensitive restriction enzymes. In a most preferred embodiment of the method according to the present invention, the converted DNA is subsequently amplified. Such amplification preferably involves an enzymatic amplification using a polymerase enzyme, preferably a heat stable polymerase enzyme, such as a Taq polymerase. Respective methods are further described below.

In yet another aspect of the method according to the present invention, said analysis of the methylation status comprises an analysis selected from promoter methylation, CpG island methylation, and/or analysis of at least one CpG in any of the chemically converted chromosomal DNAs as shown in SEQ ID NOs 1 to 160, preferably as shown in SEQ ID NOs 76 to 160, and sequences complementary thereto.

There are a number of well-established techniques for determining the methylation status of samples that range from those for determining the overall methylation level of the genome to those that quantitatively detect the methylation level at single or closely linked CpGs. General techniques for analysis of DNA methylation are reviewed by Dahl and Guldberg, Biogerontology 4:233-50 2003. Furthermore, statistical approaches to describe, discriminate, and classify methylation patterns have been validated for various uses (reviewed by Siegmund and Laird, Methods 27:170-8, 2002).

Preferred is a method according to the present invention, wherein said analysis of the methylation status comprises at least one of the following methods: MSP, HeavyMethyl, MethyLight, Ms-SNuPE or other methods relying on a detection of amplified DNA. These methods are used in order to analyse particular regions which, in some instances, are combined in order to give information about the genome.

Most of the methods for detecting methylation differences in DNA samples rely on either of two approaches: chemical conversion or digestion with methylation-sensitive restriction enzymes. These methods are preferred, because standard molecular techniques that rely on specific base pairing (PCR, sequencing, etc.) will not specifically detect methylated cytosine nucleotides since they have the same base-pairing characteristics as unmethylated cytosines.

A first approach currently relies on a chemical called bisulfite (disulfite, hydrogen sulfite, bisulphite) that, combined with alkaline hydrolysis, converts unmethylated cytosine (C) to uracil (U), while leaving methylated C unchanged. During, for example, PCR amplification, the U's will be replaced by thymines (T's) (Frommer et al., Proc Natl Acad Sci USA 89:1827-1831, 1992). After chemical conversion, each unmethylated CpG site therefore contains an altered nucleotide sequence that can then be detected by conventional techniques, such as sequencing, single base primer extension, microarray chips, or various PCR techniques. (Note that all genomic C's that are not within a CpG motif are assumed to be converted to U's since CpG's are the overwhelming targets of methylation in vertebrates.) The main drawback of this technique is that conversion by bisulfite is not always 100% efficient, but various modifications are available to improve the efficiency (Olek et al., Nucleic Acids Res. 24:5064-6, 1996; Rein et al., Mol Cell Biol. 17:416-26, 1997; Paulin et al., Nucleic Acids Res. 26:5009-10, 1998; Warnecke et al., Methods 27:101-7, 2002).

A second approach employs restriction enzymes that cut DNA differentially depending on the methylation state of the CpG target site. Since the potential cutting targets may occur at thousands of places within the DNA, this approach is generally suited to large-scale, unbiased analysis of the entire genome. Furthermore, this method is amiable to discriminating broad changes in methylation, e.g., large segments of CpG islands that are either completely methylated or unmethylated, rather than individual CpGs. Therefore, methods relying on methylation-sensitive restriction enzymes are more useful in marker discovery—the initial determination of which regions are differentially methylated with respect to particular cell types or states—rather than as an assay method per se. Examples of such methods are RLGS (Costello et al., Nat Genet. 24:132-8, 2000), MCA (Toyota et al., Cancer Res. 59:2307-12, 1999), MS-AP-PCR (Gonzalgo et al., Cancer Res. 57:594-9, 1997) and DMH (Huang et al., Hum Mol Genet. 8:459-70, 1999).

Standard techniques to analyse DNA methylation are furthermore:

a) Bisulfite sequencing: Direct sequencing of DNA will not distinguish methylated cytosine nucleotides since they have the same base pairing characteristics as non-methylated cytosines. In bisulfite sequencing, the genomic DNA is first treated with bisulfite and then (typically) specific regions are amplified with PCR. The proportion of methylated cytosines within any particular CpG site can then be estimated by the ratio of C/T signals found at that site (Frommer et al., Proc Natl Acad Sci USA 89:1827-1831, 1992). Bisulfite sequencing is targeted to very specific segments of DNA (e.g., a particular gene) and is thus more suited for detailed analysis of particularly interesting regions since it gives information about the methylation status of every CpG in the sequenced region.

b) MSP: This method takes advantage of discriminatory priming of a PCR reaction due to the differences in the target DNA after bisulfite treatment. Briefly, two alternate primers are designed, one that anneals preferentially to the methylated version of the target CpG (which still contains a C at the target site after bisulfite treatment) and one that anneals preferentially to the unmethylated version (which contains an U at the target site after bisulfite treatment). A ratio of the originally methylated/unmethylated target sites is derived from the relative portion of amplification products (e.g., by ethidium bromide staining of an agarose gel) generated from each primer set. MSP requires only small amounts of target DNA and can detect a 0.1% methylation level (Herman et al., Proc Natl Acad Sci USA 93:9821-9826, 1996; U.S. Pat. No. 5,786, 146). However, MSP should still be considered as only semi-quantitative and most suitable for initial screening (Dahl and Guldberg, Biogerontology 4:233-50).

c) MethyLight: This technique also relies on PCR amplification of bisulfite-treated DNA with the primary improvement being the inclusion of a fluorescent hybridisation probe ("TaqMan") for detection. The probe contains both a fluorescent dye and a quencher moiety so that the fluorescence is suppressed when the probe is intact. During PCR amplification the hybridised probe is hydrolysed by the polymerase, thus releasing the fluorine. The increased fluorescence can then be detected in a real-time fluorescent detection system. Quantitation is typically achieved by determining the cycle number at which the fluorescence crosses some predetermined threshold. Specificity to methylated or unmethylated target DNA is contained in the design of the flanking primers or in the hybridisation probe itself (Eads et al., Cancer Res 59:2302-2306, 1999). MethyLight is very sensitive and capable of high throughput, but generates a low resolution (Dahl and Guldberg, Biogerontology 4:233-50).

d) HeavyMethyl: This is a variation of the MethyLight technique with a further refinement of adding methyl-specific blocking probes that interfere with hybridisation of the PCR amplification primers or the detection probe (Cottrell et al., Nucleic Acids Res 32:e10, 2004).

e) Ms-SNuPE: Ms-SNuPE is a variation of the single nucleotide primer extension method for detecting SNPs (Kuppuswamy et al., Proc Natl Acad Sci USA. 88:1143-7, 1991). The region of interest is amplified by PCR from bisulfite-treated genomic DNA such that there is no bias towards amplification of either methylated or unmethylated target DNA. A detection primer is designed to hybridise immediately adjacent to the target CpG in the resulting PCR amplicons. Reaction conditions are such that the primer can only be extended by a single nucleotide (e.g., a G or an A as complementary bases to C or T, respectively). The relative incorporation of radio- or dye-labelled nucleotides gives the ratio of methylated (G incorporated) or unmethylated (A incorporated) at that site in the original DNA. The method is both quantitative and sensitive (Gonzalgo and Jones, Nucleic Acids Res 25:2529-2531, 1997).

e) COBRA: This method makes use of specific restriction enzymes after bisulfite conversion of genomic DNA and an unbiased amplification by PCR. Since bisulfite conversion potentially destroys the native restriction sites or creates new ones, restriction enzymes can be chosen to target CpG sites that were either originally methylated or originally unmethylated, depending on the experimental design. The proportion of methylated or unmethylated nucleotides at that site can then be estimated by comparing the amount of cleaved products to the total amount of PCR product (Xiong and Laird, Nucleic Acids Res. 25:2532-2534, 1997). COBRA is a sensitive technique, but is limited to analysing CpGs that may be targeted by particular restriction enzymes (Dahl and Guldberg, Biogerontology 4:233-50).

f) MSRE-PCR: One method that does not require pretreatment of the DNA with bisulfite reagents is the analytical use of methylation-sensitive restriction enzymes targeting CpGs whose flanking DNA is then specifically amplified by PCR. Discrimination of the methylation status is generated by using isoschizomer enzymes in parallel in which one enzyme if methylation sensitive and the other is not (e.g., HpaII/MspI which both target CCGG; the site cannot be cleaved by HpaII if the internal CpG is methylated). The uncut DNA can undergo specific PCR amplification (using primers that target each side of the restriction site), while the cut DNA will not. Therefore, the relative proportion of methylation at that site can be estimated by the accumulation of PCR products from the methylation-sensitive digestion versus that from the total (i.e., undigested DNA; the methylation insensitive enzyme serves as a negative control) (Singer-Sam et al., Mol Cell Biol 10:4987-9, 1990).

g) Methylation-specific chips (DNA (micro)arrays, gene chips, genome chips): This is a means of detecting methylation differences in a large number of CpG sites (possibly associated with many different genes) simultaneously. In one method, the bisulfite or chemically converted DNA from a sample is amplified by PCR, then labelled with a fluorescent dye, such as Cy5. The methylation level originally present at each CpG site in the genomic DNA is determined by specific hybridisation to probes bound to a solid media phase (the "chip").

The bound probes can be oligonucleotides or PNA-oligomers at least 9 bp in length that are identical to or complementary to the methylation markers of interest. Probes can be designed in tandem such that one preferentially recognises an originally methylated C (amplified as an unmodified C) and the other preferentially recognises an originally unmethylated C (chemically converted and amplified as a T). That is, near the middle of the probe, one version of the pair may contain a CG and the other a TG (or a CG and CA, depending on the sense of the strand). The probes should also overlap C's at non-CpG sites in order to minimise the effects of incomplete bisulfite conversion of the sample DNA. Probes representing several hundred CpG sites may be bound to individual positions ("spots") on the solid media by a 6C-amino modification at their 5' ends.

The labelled amplicons from the sample are then hybridised to the probes under conditions that distinguish the base-pair mismatches. The unbound labelled DNA is removed and the relative fluorescent intensity is determined for each pair of spots that recognise either the originally methylated CpG or the originally unmethylated CpG for each marker site. (Golub et al., Science 286:531-557, 1999; Chen et al., Nucleic Acids Res 27:389-395, 1999).

In yet another aspect of the method according to the present invention, said method further comprises a prediction of the quality and/or suitability of said cells as therapeutics based on the analysis of the methylation status and/or epigenetic markers of said cells. In this aspect, the markers according to the present invention are used in order to monitor the suitability of the cells to be employed in a therapeutic approach (which in itself constitutes another preferred embodiment of the present invention). A factor that reflects the quality and/or suitability of said cells which can be measured by using the present markers (genes) is the viability (e.g. proliferation or general protein turnover) of the cells. Cells that appear to lack viability or show expression of markers related to transformation and/or apoptosis will usually not be used for a treatment. Markers can also be employed in accordance with statistical correlation with successful medical outcomes. In yet another similar aspect of the method according to the present invention, said method further comprises an estimation or prediction of the potency of said cells in their use as a therapeutic for an individual or between different individuals (which in itself constitutes another preferred embodiment of the present invention). Here, differences between nominally identical types of cells between individuals to be treated are examined based on the present markers. In yet another similar aspect of the method according to the present invention, said method further comprises a quality control during the development, manufacturing and approval of engineered tissues (which in itself constitutes another preferred embodiment of the present invention). In addition to characterization of identity and purity, a factor that reflects the quality of said cells which can be measured by using the present markers (genes) is the viability (e.g. proliferation or general protein turnover) of the cells. Cells that appear to lack viability or show expression of markers related to malignant transformation and/or apoptosis will usually not be used for a generation of tissues. Markers can also be employed in accordance with statistical correlation with successful medical outcomes. In yet another aspect of the method according to the present invention, said method further comprises detecting and monitoring the response to chemical and/or biological substances interacting with the cells' growth or differentiation program(s) (which in itself constitutes another preferred embodiment of the present invention). Here, a follow-up of the methylation pattern of certain cells based on the markers herein will point to changes in the cells as a response to chemical and/or biological substances, in some cases even before a phenotypic change can be observed. Cells that appear to show expression of markers related to transformation and/or apoptosis will usually not be used further or the treatment will be ceased and/or a different treatment will be initiated.

Another preferred aspect of the present invention is directed to a nucleic acid molecule, comprising a sequence at least 18 bases in length of a segment of the chemically pretreated genomic DNA derived from the genes COL3A1, CAV1, PRELP, SPP1, CHAD, ANXA6, KRTHB6, BGN, LTA, FGFR1, HIF1A, GDF5, PTHR1, BMP4, GLI3, COL2A1, IGF2, LPIN1, TDGF1, KRT8, CD4, CNTN1, COL6A3, FMOD, PKNOX2, C15orf27, ROPN1L, and ACVRL1 or according to any one of the sequences taken from the group consisting of SEQ. ID NO. 1 to 160, preferably SEQ. ID NO 76 to 160, and sequences complementary thereto.

In one preferred embodiment of the nucleic acid molecule according to the present invention, the sequence of said molecule is different from the unmodified chromosomal sequence. This embodiment reflects the fact that—although chemically treated—each unmethylated CpG site contains an altered nucleotide sequence that can then be detected by conventional techniques, such as sequencing, single base primer extension, microarray chips, or various PCR techniques, whilst all methylated C's remain unchanged (i.e. identical to the genomic sequence).

Thus, the invention provides the chemically modified genomic DNA, as well as oligonucleotides and/or PNA-oligomers for detecting cytosine methylations, as well as a method which is particularly suitable for the classification of cells by type or status. The present invention is based on the discovery of particular variations in the cytosine methylation patterns of genomic DNA that are particularly suitable for distinguishing various cell types in the mesenchymal lineage.

As mentioned above, this objective is achieved, according to the present invention, by detection of epigenetic and, in particular, methylation differences within genomic sequences according to one of SEQ ID NOs. 1 to 25, and sequences complementary thereto.

This objective is further achieved, according to the present invention, by providing a nucleic acid containing a sequence of at least 18 bases in length of the chemically pretreated genomic DNA according to one of SEQ ID NOs. 1 to 160, preferably SEQ ID NOs 76 to 160, and sequences complementary thereto. The chemically modified nucleic acids could not previously be connected with the discrimination of cell type or status.

IGF2 has been described as partaking in the phenomenon of imprinting in early development.

Preferred is an oligomer, in particular an oligonucleotide or peptide nucleic acid (PNA)-oligomer, said oligomer comprising in each case at least one base sequence having a length of at least 9 nucleotides which is complementary to, or hybridises under moderately stringent or stringent conditions to a pretreated genomic DNA as described above, and sequences complementary thereto. More preferred is an oligomer according to the present invention, wherein the nucleotide sequence of said oligomer comprises at least one CpG, TpG or CpA dinucleotide. More preferred is an oligomer according to the present invention, wherein the CpG, TpG or CpA dinucleotide is located in the middle third of the oligomer. More preferred is oligomer according to the present invention, wherein the nucleotide sequence of said oligomer terminates one base before a target CpG of either of the strands of the genomic, unconverted DNA sequence.

Another preferred aspect of the present invention is directed to a set of oligomers, comprising at least two oligomers according to the present invention and as described above.

As stated, the object of the present invention is further achieved by oligonucleotides for detecting the cytosine methylation state in chemically pretreated DNA, containing at least one base sequence having a length of at least 9 to 13 nucleotides which hybridises to a chemically pretreated genomic DNA according to SEQ ID NOs. 1 to 25, and in particular to SEQ ID NOs 76 to 160. The base sequence of the oligomers preferably contains at least one CpG, TpG or CpA dinucleotide. Particularly preferred are oligonucleotides according to the present invention in which the targeted cytosine of the CpG occurs in the middle third of the oligomer. The oligonucleotides may also exist in the form of a PNA (peptide nucleic acid) which has particularly preferred pairing properties or as dye-conjugated or other covalently modified nucleic acids.

Another preferred aspect of the present invention relates to a diagnostic kit for detecting the presence of certain cell types and statuses based on DNA methylation, comprising: a) a bisulfite reagent; and b) a nucleic acid molecule as above or an oligomer or set of oligomers according to the present invention. Thus, one preferred embodiment of the invention is the production of kits for the uses described above. The kits may contain: 1. Chemicals (bisulfite, etc.) for processing the cell samples; 2. Procedure protocols; 3. Oligonucleotide probes, blockers or extension primers according to the present invention that will detect markers relevant to a particular cell type. The oligonucleotides would be constructed to generate a signal on a commonly available detection platform, such as Real Time-PCR (RT-PCR) or Single Base Extension (SBE). Each signal indicates the level of methylation at a particular target site in the sample. As an alternative, probes according to the described nucleic acids could be produced for usage on a chip; 4. A bioinformatic tool to process the results. This, e.g., software might normalise the signals from the raw data, contain a result matrix for interpretation of the read-out, or implement various algorithms that calculate, for example, cell type proportions, or potency predictions.

Yet another preferred aspect of the present invention relates to the use of a nucleic acid molecule according to the present invention or an oligomer or set of oligomers according to the present invention or a kit according to the present invention for determining the presence of a particular cell type in a biological sample. Yet another preferred aspect of the present invention relates to the use according to the present invention, wherein said cell is present in said biological sample in a cell population, cellular batch, a heterogeneous population of cells, a subpopulation of cells, a tissue, an organ and/or a non-human organism. Yet another preferred aspect of the present invention relates to the use according to the present invention for determining the identity, cell type, cellular status, composition, relative proportion, absolute amount and/or potency of said cell based on said presence in said biological sample. Yet another preferred aspect of the present invention relates to the use according to the present invention for a quality control during the development, manufacturing and approval of engineered tissues. Yet another preferred aspect of the present invention relates to the use according to the present invention for monitoring the response to chemical and/or biological substances interacting with the cells' growth or differentiation behaviour. The genes (markers) that form the panel according to the present invention have not been used for such methods as described above, and are surprisingly well suited for precise and quick analyses.

As will be understood from reading the above, the precise analysis of cell types that is possible with the inventive markers can be applied to diagnostic and/or analytical purposes for tissues and cells in vivo.

DEFINITIONS

Gene names are according to HUGO (The Human Genome Organisation; www.gene.ucl.ac.uk/hugo). Genomic sequences and mapping are according to ENSEMBL (www.ensembl.org) release Version 35 of the human genome.

In the context of the present invention, the terms "gene(s)" and "marker(s)" are used interchangeably and relate to the nucleic acids that form the basis of the listing of genes as given in Table 1. It should be understood that the present invention is not limited to the nucleic acid sequence as depicted in the accompanying sequence listing, but also encompasses sequences of the genes as indicated that have been corrected due to sequencing errors and/or errors in mapping the genes on the chromosome.

In the context of the present invention, "expression level" or "expression analysis" comprises determination of the mRNA and/or protein expression and/or analysis of the methylation status and/or analysis of other epigenetic markers. Preferred are the analyses of methylation status and/or analysis of other epigenetic markers.

In the context of the present invention, "genetic parameters" are mutations and polymorphisms of genomic DNA and sequences further required for their regulation. To be designated as mutations are, in particular, insertions, deletions, point mutations, inversions and polymorphisms and, particularly preferred, SNPs (single nucleotide polymorphisms).

In the context of the present invention, "epigenetic parameters" are, in particular, cytosine methylations and further modifications of DNA bases of genomic DNA and sequences further required for their regulation. Further epigenetic parameters include, for example, the acetylation of histones, which cannot be directly analysed using the described method but which, in turn, correlates with the DNA methylation.

In the context of the present invention, the term "regulatory region" of a gene is taken to mean nucleotide sequences which affect the expression of a gene. Said regulatory regions may be located within, proximal or distal to said gene. Said regulatory regions include but are not limited to constitutive promoters, tissue-specific promoters, developmental-specific promoters, inducible promoters and the like. Regulatory elements may also include certain enhancer or silencer sequence elements that control transcriptional or translational efficiency of the gene.

The term "biological material" relates to any material that is derived from a source, in particular an animal and/or human source, that contains or is suspected to contain genomic DNA and/or the protein(s) of interest. One preferred example of a biological material according to the present invention is designated herein as "biological sample" or "biological specimen".

In the context of the present invention, the terms "identity", "purity" and "potency" are as employed by regulatory agencies, i.e. meaning (1) the correct labelling of a substance, (2) the kind and amount of impurities, and (3) the therapeutic or functional effectiveness of the substance, respectively.

In the context of the present invention, the term "bisulfite" (disulfite, hydrogen sulfite, bisulphite) shall mean the chemical entity that converts unmethylated cytosine (C) to uracil (U), while leaving methylated C unchanged (see, for example, Frommer et al., Proc Natl Acad Sci USA 89:1827-1831, 1992).

In the context of the present invention, the term "bisulfite sequencing" shall mean a method wherein genomic DNA is treated with bisulfite, amplified with PCR and sequenced with molecular biological techniques that account for the resulting low complexity sequence (see, for example, Frommer et al., Proc Natl Acad Sci USA 89:1827-1831, 1992).

In the context of the present invention, the term "MSP" shall mean methyl-Specific PCR, in which amplification of DNA is dependent on methylation-specific primers after bisulfite treatment (Herman et al. Proc. Natl. Acad. Sci. USA 93:9821-9826, 1996; U.S. Pat. No. 5,786,146).

In the context of the present invention, the term "MethyLight" shall mean the technique in which PCR amplification of bisulfite-treated DNA is detected by fluorescent hybridisation probe during Real-Time PCR (Eads et al., Cancer Res. 59:2302-2306, 1999).

In the context of the present invention, the term "HeavyMethyl"—shall mean the variation of the MethyLight technique also employing adding methyl-specific blocking probes (Cottrell et al., Nucleic Acids Res 32:e10, 2004).

In the context of the present invention, the term "MS-SnuPE" shall mean Methylation-Sensitive Single Nucleotide Primer Extension follows PCR amplification of bisulfite-treated genomic DNA and detects the ratio of methylated to unmethylated C's by differential incorporation of a nucleotide on a primer that hybridises immediately adjacent to the target CpG (Gonzalgo and Jones, Nucleic Acids Res. 25:2529-2531, 1997).

In the context of the present invention, the term "COBRA" shall mean Combined Bisulfite Restriction Analysis which employs restriction enzymes targeting potential methylation sites that might be created or destroyed by bisulfite conversion of DNA. Uncleaved template is quantitated by subsequent local amplification of the flanking sequences (Xiong and Laird, Nucleic Acids Res. 25:2532-2534, 1997).

In the context of the present invention, the term "MSRE-PCR" shall mean Methylation-sensitive Restriction Endonuclease which uses methylation-sensitive restriction enzymes targeting CpGs on unconverted genomic DNA. Uncleaved template is quantitated by subsequent local amplification of the flanking sequences (Singer-Sam et al., Mol Cell Biol. 10:4987-9, 1990).

In the context of the present invention, the terms "Chips", "DNA microarrays", "gene chips", "genome chips" shall mean a device that helps to detect the methylation status of, for example, bisulfite-converted and PCR amplified DNA fragments by differential hybridisation to probes bound to a solid media phase. Paired probes contain alternative nucleotides that are complementary to CpG sites depending on whether they were converted or not (i.e., unmethylated or methylated) by chemical treatment. The hybridised DNA fragments are typically detected via a fluorescent dye covalently attached to the fragment (Golub et al., Science 286:531-557, 1999; Chen et al., Nucleic Acids Res 27:389-395, 1999; an overview of chip manufacture is given in Nature Genetics Supplement, Volume 21, January 1999).

In the context of the present invention, the term "cell type" shall mean the commonly accepted label for a cell according to its lineage and differentiation status, generally according to common phenotyping methods (histology, etc.). However, it shall be understood that the precision of DNA methylation analysis may lead to new subtypes or a re-characterization of accepted cell type labels which, in turn, will lead to new cell types.

In the context of the present invention, the term "cell status/stage" shall mean potentially variable characteristics of a cell including general health, differentiation state, cell age, alterations during generations or passages, competence for propagation, differentiation, apoptosis, therapeutic potency, etc.

"Stringent hybridisation conditions", as defined herein, involve hybridising at 68° C. in 5×SSC/5×Denhardt's solution/1.0% SDS, and washing in 0.2×SSC/0.1% SDS at room temperature, or involve the art-recognised equivalent thereof (e.g., conditions in which a hybridisation is carried out at 60° C. in 2.5×SSC buffer, followed by several washing steps at 37° C. in a low buffer concentration, and remains stable).

Moderately stringent conditions, as defined herein, involve including washing in 3×SSC at 42° C., or the art-recognised equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

In the context of the present invention, the term "genomic DNA" shall mean native DNA before any chemical treatment.

In the context of the present invention, the term "CpG" shall indicate the typical target sequence for methylation in vertebrate genomes, with the cytosine undergoing methylation (or not).

In the context of the present invention, the term "converted" or "chemically (pre)treated DNA" shall mean DNA subjected to a chemical treatment (e.g., bisulfite) that alters the base-pairing characteristics depending on methylation status of the nucleotides.

In the context of the present invention, the terms "oligos", "oligonucleotides", "oligomers" are used interchangeably and indicate oligonucleotides with or without modification by dyes, minor groove binders (Zeschnigk et al., Nucleic Acids Res 32:e125, 2004) or other moieties, or as a peptide nucleic acid (PNA; reviewed by Pellestor and Paulasova, Eur J Hum Genet 12:694-700, 2004).

In the context of the present invention, the term "methylation level" shall mean the quantitative level of methylation at a single CpG across every DNA molecule in the sample (terminology from Siegmund and Laird, Methods 27:170-8, 2002).

In the context of the present invention, the term "methylation profile" shall mean the methylation levels at multiple sites (terminology from Siegmund and Laird, Methods 27:170-8, 2002). Similarly, a "methylation pattern" shall mean the general pattern of methylation of a sample or a subset that is characteristic for a particular cell type or status.

In the context of the present invention, the term "amplicon" shall mean the DNA fragment resulting after PCR amplification, also known as an "amplificate".

In the context of the present invention, the term "probes or blockers" shall mean oligonucleotides that specifically hybridise to DNA as a method of detection, or to interfere with the hybridisation of other oligonucleotides (Yu et al., BioTechniques 23:714-720, 1997), respectively.

As described, the present invention in general relates to the identification and characterisation of cell samples based on the analysis of methylation patterns within the genomic regions described herein. It has surprisingly been determined that these methylation patterns have a distinctiveness and consistency that gives them a utility as novel discriminatory markers for research and therapeutic purposes.

One preferred embodiment is the methylation analysis of any of the genes of contained within the listing of genes as given in Table 1, and/or particular regions thereof with or without chemical modification of the DNA using, for example, methylation-sensitive restriction enzymes, bisulfite or chemical pretreatment, PCR amplification primers, specific hybridisation probes, mass spectrometry, etc.

Another preferred embodiment provides the use of oligonucleotides or modified oligonucleotides according to the present invention that can be used for the detection of the methylation state within the region of SEQ ID NOs 1 to NO 153 or in the listing of genes as given in Table 1, for example, by way of using the oligonucleotides or modified oligonucleotides as amplification primers, extension primers, detection probes, hybridisation blockers, for hybridisation on a solid media (e.g., as in DNA chips), etc.

In particular, these primers would overlap, or be adjacent to a CpG, TpG, CpA that corresponds to a CpG site in the original genomic DNA as described in SEQ ID NOs 1 to 25.

The preferred method to distinguish methylation status of the DNAs as described in SEQ ID NOs 1 to 25 generally follows these steps:

a) Biological samples are obtained from cell cultures, biopsies, etc., using standard techniques known to the art.

b) DNA is extracted from the samples using, e.g., methods standard to the art.

[At this point, it is possible to utilise methods that do not require bisulfite or chemical pretreatment, such as MSRE-PCR, as described above.]

c) The DNA is chemically or biologically converted such that there is an altered pairing behaviour of methylated nucleotides versus methylated nucleotides, as, for example, with bisulfite treatment to convert unmethylated cytosines to uracil.

d) Specific DNA regions as described in SEQ ID NOs 76 to 160 or belonging to the genes as described above are amplified by PCR. In one preferred embodiment, the PCR amplification may be biased by methylation-specific primers, i.e., primers that hybridise to potentially methylated sites that may or may not have been altered during the chemical pretreatment (i.e., they overlap a CpG site, as described for MSP, above). Afterwards, the resulting fragments are subject to detection or quantitation methods such as gel electrophoresis analysis, hybridisation analysis, incorporation of detectable tags within the PCR products, fluorescent dye/quencher probes, etc.

In other methods, the DNA regions are amplified in an unbiased manner with regard to whether the DNA was originally methylated or unmethylated. Generally, these primers overlap some non-CpG cytosines coded in the genomic sequence to favour template DNA that was completely converted by the bisulfite reaction; i.e., the primer is designed to hybridise to T's that were C's in the native genomic DNA.

For methods in which the chemically-treated DNA was amplified in an unbiased manner, there are an number of preferred methods for detecting the original methylation state of the genomic DNA.

One preferred detection method is direct (bisulfite) sequencing. This generally requires a further sequencing reaction such as cycle sequencing and analysis on an instrument for determining the nucleotide sequence of the DNA fragment (e.g., an ABI 3100 machine). The methylation level at any particular CpG site is obtained from the intensity of the C and/or T signals (for the sense strand, however these methods could also target G to A changes depending on the strand tested). Normalization of the signals and accounting for incomplete conversion of the bisulfite reaction may require elaborate software. This method gives the methylation status of multiple CpGs within the amplified sequence and has a resolution of at least 20% (Lewin et al., Bioinformatics 20:3005-12, 2004).

Another preferred embodiment is a single nucleotide primer extension reaction (a version of MS-SNuPE as described above) which detects the ratio of methylated to unmethylated cytosines at a single CpG site within the original DNA sample pool. In this case, a primer is designed to hybridise immediately adjacent to the CpG of interest such that an extension of the primer in the 5' to 3' direction incorporates the complement of the C position as the next nucleotide. The reaction conditions are such that only that nucleotide is incorporated (e.g., by using dideoxy-nucleotides or using separate reactions containing only 1 nucleotide). Thus, the ratio of methylation at that CpG position is given by the relative incorporation of C/T for the sense strand and G/A for the anti-sense strand. The relative ratios can be detected within the extended-primer products, for example, by radiometric assays of radio-labelled nucleotides, fluorescent detection of conjugated dyes, or High Performance Liquid Chromatography (HPLC) (El-Maarri, Methods Mol Biol. 287:195-205, 2004; El-Maarri et al., Nucleic Acids Res. 30(6):e25, 2002).

Detection can also be accomplished by a number of PCR methods, including Real-Time PCR (Heid et al., Genome Res. 6:986-994, 1996) in which the accumulation of a particular target product is measured by a fluorescence detection mechanism, such as in the MethyLight and HeavyMethyl methods described above. In some instances, the target sequence for primers, hybridisation probes or blocking probes may overlap several nearby CpG sites, thereby generating specificity for multiple methylated or unmethylated sites.

Many of these methods allow for multiplexing—the ability to simultaneously detect multiple probes targeting several different CpG sites. For single nucleotide primer extension, this requires that the primers have distinctive masses (different lengths or attached chemical moieties) and RT-PCR requires probes with dye moieties that have different spectral characteristics.

Other potential detection methods that have been employed for discriminating the methylation-specific fragments include mass spectrometry (Karas and Hillenkamp, Anal Chem 60:299-301, 1988; Schatz et al., Nucleic Acids Res 32:e167, 2004; Tost J et al., Nucleic Acids Res 31:e50, 2003), HPLC (El-Maarri, Methods Mol Biol 287:195-205, 2004; Baumer, Methods 27:139-43, 2002), hybridisation/melting temperature analysis (Worm et al., Clinical Chemistry 47:1183-1189, 2001; Olek et al., WO 99/28498), gel electrophoresis analysis, and DNA microarray analysis.

Once the methylation profile at one or more marker sites is determined for a sample, a number of data analysis methods are available, depending on the purpose of the assay. Examples for such a data analysis are as follows:

1. The methylation profile may be employed to determine or confirm the identity of a relatively homogeneous cell sample. For example, the patterns generated by MS-SNuPE in FIG. 2 are consistent with that of essentially pure adipocytes or keratinocytes. Methylation profiles that deviate from that predicted by the combination of markers in our marker set are unlikely to be homogeneous samples of the expected cell type. This type of analysis would be useful in, for example, quality control of in vitro manipulated cell samples that might be employed in surgical re-implantation of chondrocytes, or batches of cells used for drug screens.

2. The relative proportion of cell types in a sample can be estimated by comparing the methylation profile of the entire sample to that expected for each of the relevant cell types. In a preferred example, the calculation requires solving multiple simultaneous equations with linear algebra in the form:

$$M_1 = ax_{1a} + bx_{1b} + \ldots nx_1n$$

$$M_2 = ax_{2a} + bx_{2b} + \ldots nx_2n$$

$$\ldots$$

$$M_i = ax_{ia} + bx_{ib} + \ldots nx_{in}$$

where $M_I$ is the observed methylation level at marker I for the sample (up to i markers), $x_{IN}$ is the expected methylation level at marker I in cell type N, and a, b, . . . n are the calculated (unknown) fractions of n cell types within the sample. The calculation requires n−1 distinctive markers (assuming each marker acts at only one branch of distinction) to solve the system of equations that also includes the formula:

$a+b+\ldots n=1$ (i.e., the total of each of the cell types constitute 100% of the sample)

For example, three cell types, A, B and C, have the methylation phenotypes of (0%, 0%), (0%, 100%) and (100%, 100%) for Markers 1 and 2, respectively. For an unknown mixture containing A, B and C, the measured methylation levels for Marker 1 is 0.5 and for Marker 2 is 0.75. Therefore, the equations to be solved are:

$0.5 = a(0) + b(0) + c(1.0)$ $0.75 = a(0) + b(1.0) + c(1.0)$ $a + b + c = 1$

Solving these equations shows that the proportion of cell type A (represented by "a") is therefore 25% of the mixture, B is 25% and C is 50%.

In cases where insufficient markers or unknown/uncharacterised cell types are involved, the methylation profile sets boundary conditions, e.g., the maximum fraction of cell type A is determined by the observed methylation level and the expected methylation level for the limiting marker(s) in cell type A.

3. Detection of contaminating cell types is generally determined by a sensitive PCR detection technique (such as MethyLight or HeavyMethyl) by targeting a particular CpG or closely linked CpGs with a distinctive methylation pattern. The fraction of the original DNA molecules in the sample (i.e., representing a particular cell type) is calculated from the cycle number at which the PCR signal surpasses a predetermined threshold. These techniques approach a sensitivity in the range of 1 in 10,000 (Cottrell et al., Nucleic Acids Res 32:e10, 2004; Eads et al., Cancer Res. 59:2302-2306, 1999). This application may be useful in detecting either desirable (e.g., rare stem cells) or undesirable (e.g., cancerous or wrongly differentiated) cell types.

4. The potency of a batch of cells can be judged by statistically correlating methylation patterns with, for example, particular therapeutic outcomes. Methods to produce models for class prediction (also called supervised learning) have been previously applied to both gene expression and to methylation analysis (Adorjan P et al., Nucleic Acids Res 2002 30:e21, 2002; Golub et al., Science 286:531-557, 1999; reviewed by Siegmund and Laird, Methods 27:170-8, 2002). A prime advantage of this approach is that it relies on statistical analysis, but is not dependent on a priori knowledge of biochemical pathways, therapeutic mechanisms, etc.

The goal of this approach is to build a statistical model that targets methylation profiles that are predictive of a particular class, then to assign unknown samples into one of the classes based solely on its methylation pattern. As an example using the case of chondrocyte therapy, the methylation patterns from batches that were used in chondrocyte transplantation would be segregated into those that resulted in a positive medical outcome and those which did not. A predictive algorithm (a "classifier") is produced that essentially encapsulates a model of "good" versus "bad" chondrocyte batches. Subsequent batches of chondrocytes can be classified with this predictive model in order to filter out those batches which are not likely to be successful.

5. The analysis of methylation profiles may also be useful for tracking differentiation during in vitro manipulations of cells. For example, a researcher may desire to maintain a particular cell type during growth and expansion of a cell culture. The current usage of chondrocytes illustrates such a case: biopsy material is taken from damaged cartilage, the chondrocytes are released from the extracellular matrix by enzymatic digestion, and grown as a 3-D pellet culture to produce more cells for surgical re-implantation (Brittberg et al., J Bone Joint Surg Am 85-A Suppl 3:109-15, 2003; Brittberg et al., N Engl J Med 331:889-95, 1994). Since native chondrocytes do not normally multiply, this procedure entails some cellular alterations. Testing the methylation patterns of in vitro grown chondrocytes is one mechanism to ensure that the endpoint cells retain their original chondrocyte-like character. This is particularly useful because conventional markers (e.g., Col2A1 antibodies) used to judge the quality of chondrocytes are of dubious merit (Kolettas et al., J Cell Sci 108:1991-9, 1995; Dell'Accio et al., Arthritis Rheum 44:1608-19, 2001).

Conversely, a researcher may wish to convert one cell type (e.g., a precursor cell) to another cell type by in vitro manipulation (e.g., by using growth or differentiation factors). Such a process can be quality controlled or optimised using methylation markers to assay or track the changes. For example, mesenchymal stem cells (MSCs) may act as a precursor which can be differentiated to chondrocyte cells under the proper growth conditions (Mackay et al., Tissue Eng 4:415-28, 1998). Methylation markers that distinguish MSCs from chondrocytes are useful to monitor the progress of the conversion, ensure proper differentiation, and improve the growth/differentiation process. Thus, this invention provides novel epigenetic markers and oligonucleotides, as well as methods for testing the identity and quality of cell samples, and to optimise laboratory procedures for engineering or manipulating cells and tissues. The markers and methods have advantages over conventional molecular and morphological techniques in that they provide stable, consistent, sensitive, quantifiable and potentially universal mechanisms for discriminating a wide range of cell types.

The inventors have identified specific genomic regions which had covalent modifications specifically depending on the type or state of the cells. The invention therefore provides a set of molecular markers whose expression, and, in particular, methylation pattern is sensitive to cell type and/or status. The invention also discloses a method to identify cell and to calculate the proportion of cell types in a heterogeneous mixture.

The described invention provides a method and nucleic acids for the discrimination of cell types and statuses based on epigenetic differences. The invention discloses a means of: quantitating the portions of various cell types in a mixture; detecting minute impurities of one or more cell types within a batch; estimating the potency of a batch of cells by a statistical correlation between epigenetic markers and therapeutic outcomes or known biological parameters; and monitoring changes in cell type/status during various protocols.

The invention represents an advancement over state of the art methods (histological, immunological or mRNA detection) in that it is uniform, consistent, robust, sensitive, potentially universal and capable of producing complex information to any arbitrarily high level of resolution.

The inadequacy of current cell identification techniques means that it is difficult both to efficiently engineer the cells and, ultimately, to guarantee that engineered cells are in concordance to their original, healthy counterparts. Particularly for cells used as therapeutics, it is mandatory that their identity, purity and potency be determined prior to re-introduction into the body. Furthermore, successful cell engineering requires the ability assess growth and differentiation inducing/inhibiting factors by their effect on cell differentiation.

Methylation analysis has qualities that potentially make it superior to other methodologies for tissue recognition. Biochemical and immunological methods require long developmental times and are relevant only for particular subsets of tissues, whereas methylation testing is uniform (only the marker set varies) and universal (applicable to all tissue types). Only RNA-based arrays have strengths similar to methylation analysis in genome-wide detection of altered properties. However, RNA-based methods are problematic for a number of reasons: RNA is unstable, making it inconsistent and difficult to work with; RNA expression fluctuates in response to short-term environmental stimuli; and RNA expression analysis relies entirely on quantitative differences, therefore requiring elaborate statistical tools to assign significance to changes in mRNA expression (Miller et al., Cancer Cell 2:353-61, 2002; Nadon and Shoemaker, Trends Genet 18:265-71, 2002; Murphy D, Adv Physiol Educ, 26:256-70, 2002). Finally, although RNA arrays are powerful discovery tools, they are cumbersome for large scale clinical assays, requiring extensive panels of expression markers for class prediction (van de Vijver M J et al., N Engl J Med 347:1999-2009, 2002). Although mRNA- and methylation-based class prediction can perform comparably in cancer diagnosis, assays based on methylation are likely to be more reproducible in large scale analyses (Adorjan P et al., Nucleic Acids Res 2002 30:e21, 2002; Golub et al., Science 286:531-557, 1999).

In addition to uniformity and universality, methylation analysis is: robust, since it is based on DNA rather than RNA; sensitive, since DNA can be amplified, and informationally complex since there are millions of potential methylation sites in the human genome that can be assayed. Furthermore, since methylation levels are not an open ended signal (as in protein or mRNA expression), but rather vary from 0 to 1.0, the relative proportion of the overall signal contributed by different cell types can be calculated. Finally, the most significant advantage of methylation assays is a purely biological one. Protein- and RNA-based methodologies may reflect only the immediate, short term state of the cell; these signals are unstable and highly variable depending on the current conditions. Methylation appears to act in some cases as a long term cellular landmark, generating a stable signal that parallels the commitment to an particular cell type.

BRIEF DESCRIPTION OF THE DRAWINGS

The invention will now be further described based on the following examples and with reference to the accompanying figures and the sequence protocol.

Figure 1:
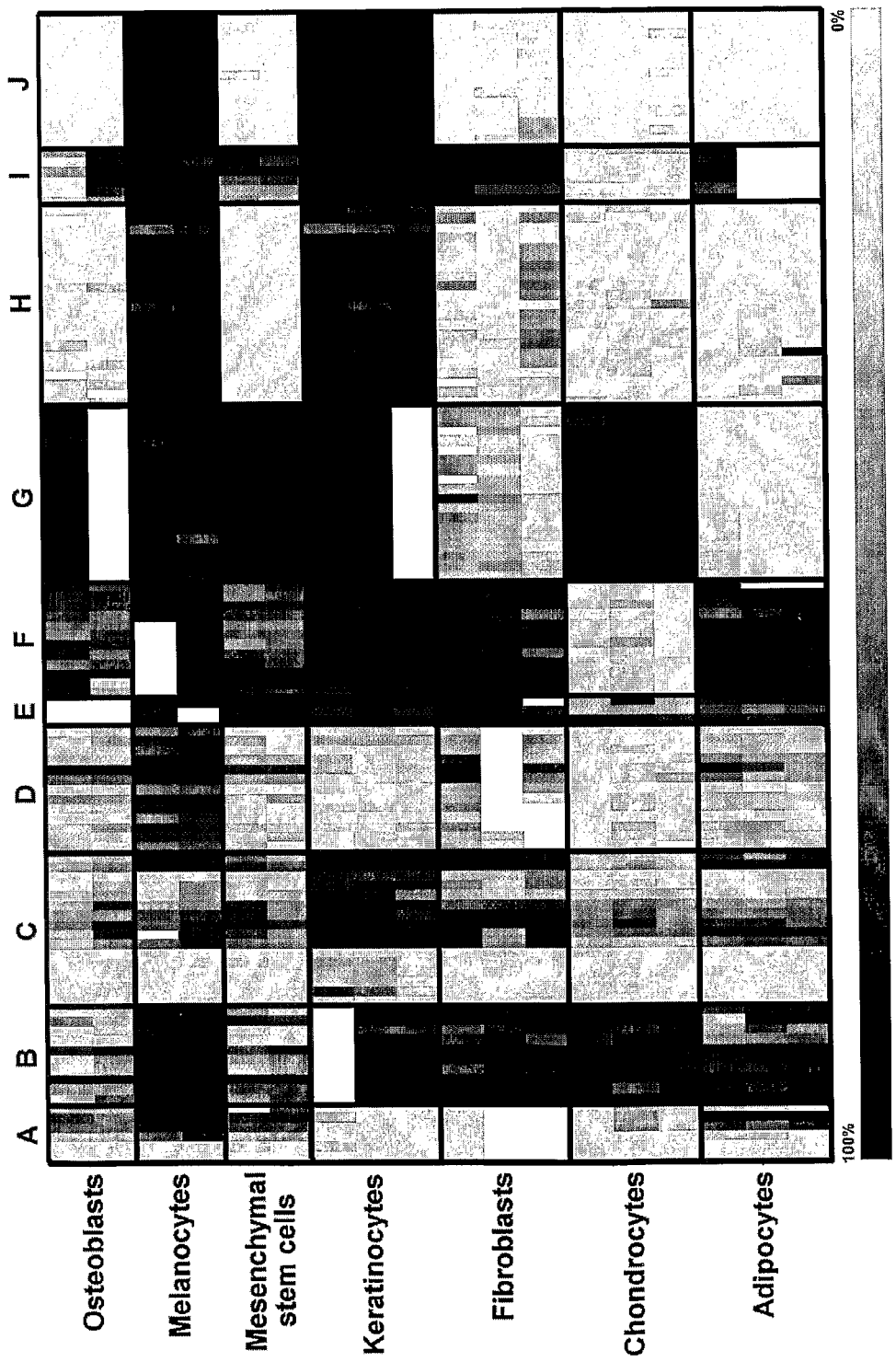
FIG. 1. Shows methylation patterns from 10 genes (A to J) in seven different cell types. Gene A=CAV1; Gene B=SPP1; Gene C=FGFR1; Gene D=ANX6; Gene E=GLI 3; Gene F=FMOD; Gene G Col3A1; Gene H=GDF5; Gene I=HIF 1A, and Gene J=

SEQ ID NO 1 to 25 depict genomic (unconverted) DNA sequences (entire genes+promoter) corresponding to the list of genes as mentioned in Table 1, below.

SEQ ID NO 26 to 75 depict bisulfite converted (chemically pretreated) DNA sequences corresponding to either fully methylated or fully unmethylated genomic DNA in the regions of variable methylation, and also sequences complementary thereto.

SEQ ID NO 76 to 101 depict the genomic (unconverted) sequences of 26 specific regions that were tested.

SEQ ID NO 102 to 153 depict the bisulfite converted (chemically pretreated) DNA sequences of 26 specific regions that were tested.

SEQ ID NO 154 to 160 depict the genomic (unconverted) sequences of additional 7 specific regions that were tested

TABLE 1

Gene (marker) list according to the present invention

| Gene name | SEQ ID NO | Accession number (GenBank) | notes: e.g., methylation patterns particular to certain subsets of cells relative to the other cell types |
|---|---|---|---|
| COL3A1 | 1, 26, 27, 76, 102, 103 | X15332 | e.g. unmethylated in adipocytes |
| CAV1 | 2, 28, 29, 77, 104, 105 | NM_001753 | e.g. heavily methylated in melanocytes; e.g. unmethylated in keratinocytes |
| PRELP | 3, 30, 31, 78, 106, 107 | BC032498 | e.g. sensitive to growth/differentiation factors; e.g. least methylated in chondrocytes and MSCs |
| SPP1 | 4, 32, 33, 79, 108, 109 | NM_000582 | e.g. distinctive for osteoblasts and MSCs |
| CHAD | 5, 34, 35, 80, 110, 111 | U96767 | e.g. heavily methylated in melanocytes; e.g. sensitive to growth conditions and growth/differentiation factors |
| ANXA6 | 6, 36, 37, 81, 112, 113 | J03578 | e.g. heavily methylated in melanocytes; e.g. sensitive to growth/differentiation factors |
| KRTHB6 | 7, 38, 39, 82, 114, 115 | X99142 | e.g. heavily methylated in keratinocytes; least methylated in melanocytes |
| BGN | 8, 40, 41, 83, 116, 117 | AK092954 | e.g. heavily methylated in fibroblasts, distinctive versus melanocytes; e.g. sensitive to growth conditions and growth/differentiation factors |

TABLE 1-continued

Gene (marker) list according to the present invention

| Gene name | SEQ ID NO | Accession number (GenBank) | notes: e.g., methylation patterns particular to certain subsets of cells relative to the other cell types |
|---|---|---|---|
| LTA | 9, 42, 43, 84, 118, 119 | X01393 | e.g. heavily methylated in chondrocytes |
| FGFR1 | 10, 44, 45, 85, 120, 121, 155 | M34185 | e.g. heavily methylated in ceratinocytes; e.g. unmethylated in chondrocytes; e.g. sensitive to growth conditions; distinguishes between chondrocytes and synovial fibroblasts |
| HIF1A | 11, 46, 47, 86, 122, 123, 156 | U22431 | e.g. unmethylated in chondrocytes; e.g. sensitive to growth conditions and growth/differentiation factors; distinguishes between chondrocytes and synovial fibroblasts |
| GDF5 | 12, 48, 49, 87, 124, 125 | X80915 | e.g. methylated in keratinocytes and melanocytes; low methylation in all others |
| PTHR1 | 13, 50, 51, 88, 126, 127 | NM_000316 | e.g. heavily methylated in keratinocytes; unmethylated in all others except melanocytes |
| BMP4 | 14, 52, 53, 89, 128, 129 | AF035427 | e.g. least methylated in chondrocytes and MSCs |
| GLI3 | 15, 54, 55, 90, 130, 131 | NM_000168 | e.g. least methylated in chondrocytes and adipocytes; e.g. sensitive to growth conditions |
| COL2A1 | 16, 56, 57, 91, 132, 133 | X16468 | e.g. heavily methylated in melanocytes |
| IGF2 | 17, 58, 59, 92, 134, 135 | NM_000612 | e.g. least methylated in keratinocytes |
| LPIN1 | 18, 60, 61, 93, 136, 137 | D80010 | e.g. most methylated in keratinocytes and fibroblasts |
| TDGF1 | 19, 62, 63, 94, 138, 139 | M96955 | e.g. heavily methylated in keratinocytes and melanocytes |
| KRT8 | 20, 64, 65, 95, 140, 141 | BC000654 | e.g. unmethylated in keratinocytes |
| CD4 | 21, 66, 67, 96, 142, 143 | M35160 | e.g. unmethylated in MSCs, distinguishing versus osteoblasts; e.g. sensitive to growth conditions |
| CNTN1 | 22, 68, 69, 97, 144, 145 | Z21488 | e.g. unmethylated in chondrocytes |
| COL6A3 | 23, 70, 71, 98, 146, 147 | X52022 | e.g. methylated in keratinocytes and melanocytes; unmethylated in all others |
| FMOD | 24, 72, 73, 99, 148, 149, 154 | U05291 | e.g. unmethylated in chondrocytes; distinguishes between chondrocytes and synovial fibroblasts |
| ACVRL1* | 25, 74, 75, 100, 101, 150, 151, 152, 153 | L17075 | e.g. heavily methylated in melanocytes |
| KRT 8 | 157 | NT_029419 | distinguishes between chondrocytes and synovial fibroblasts |
| PKNOX2 | 158 | NT_033899 | distinguishes between chondrocytes and synovial fibroblasts |
| C15orf27 | 159 | NT_010194 | distinguishes between chondrocytes and synovial fibroblasts |
| ROPN1L | 160 | NT_006576 | distinguishes between chondrocytes and synovial fibroblasts |

*Note that two widely separated areas of variable methylation were identified for this gene.

Table 3 Methylation levels and variability of selected CpGs. The average % methylation and standard deviation for three samples within each cell type (except MSCs) is shown for selected CpGs. CpGs shown in bold are considered as primary discriminators between at least two cell types and those shown in red were further characterized with MS-SNuPE. Cell type abbreviations: Keratinocytes (K), Melanocytes (M), Adipocytes (A), Chondrocytes (C), Fibroblasts (F) and mesenchymal mtem cells (MSCs)

TABLE 3

Methylation levels and variability of selected CpGs.

| | A | F | K | M | C | MSC | Distinguishes: |
|---|---|---|---|---|---|---|---|
| COL6A3: 272 | 0 (0) | 18 (20) | 95 (1) | 96 (4)* | 4 (4) | 0 | A, C, (F) from K, M |
| CAV1: 218 | 96 (8) | 21 (20) | 9 (15) | 100 (0) | 67 (41) | 79 | K from M |
| COL3A1: 328 | 0 (0) | 25 (35) | 100 (0) | 100 (0) | 100 (0) | 100 | A, (F) from K, M, C |
| BGN: 225 | 0 (0) | 100 (0) | 97 (5) | 0 (0) | 0 (0) | NA | A, M, C from F, K |
| HIF1A: 319 | 100 (0) | 100 (0) | 100 (0) | 100 (0) | 12 (19) | 71 | A, F, K, M from C |
| GDF5: 285 | 0 (0) | 14 (18) | 98 (0) | 100 (0) | 0 (0) | 0 | A, C, (F) from K, M |
| ANXA6: 264 | 46 (1) | 42 (40) | 7 (8) | 100 (0) | 0 (0) | 42 | M from C |
| SPP1: 157 | 91 (2) | 100 (0) | 100 (0) | 99 (1) | 97 (4) | 67 | (A, F, K, M, C from MSC) |

The average % methylation and standard deviation for three samples within each cell type (except MSCs) is shown for selected CpGs.
CpGs shown in bold are considered as primary discriminators between at least two cell types and those shown in red were further characterized with MSSNuPE.
Cell type abbreviations:
Keratinocytes (K),
Melanocytes (M),
Adipocytes (A),
Chondrocytes (C),
Fibroblasts (F) and
mesenchymal mtem cells (MSCs)

EXAMPLES

Example 1

According to the present invention, the methylation status of particular regions of certain genes (as disclosed in SEQ ID NO. 1 to 25 and in Table 1) were found to have differential expression levels and methylation patterns that were consistent within each cell type.

The analysis procedure was as follows. Approximately 150 genes were chosen for analysis based on suspected relevance to particular cell types or cell states according to scientific literature. In general, the candidates were selected from conventional markers for specific cell types, those showing strong or consistently differential expression patterns, or genes associated with diseases in particular tissues (Winter et al., Arthritis Rheum 48:418-29, 2003; Dell'Accio et al., Arthritis Rheum 44:1608-19, 2001; Benz et al., Biochem Biophys Res Commun 293:284-92, 2002; Tremain et al., Stem Cells 19:408-18, 2001; Wieczorek et al., Cell Tissue Res 311:227-37, 2003; Imabayashi et al., Exp Cell Res 288: 35-50, 2003; Peng et al., J Cell Biochem 90:1149-65, 2003; MacDougald and Lane, Annu Rev Biochem 64:345-73, 1995; Shum and Nuckolls, Arthritis Res 4:94-106, 2002; R&D and Chemicon online catalogues), or from keywords in the Gene Ontology or SwissProt databases. Alternatively, candidate genes can be identified by discovery methods, such as MCA.

The candidates targeted predominantly chondrocytes with only a few (<10) specific to adipocytes, osteoblasts or mesenchymal stem cells. In only very few cases has the expression pattern or relevance of the gene in other cell types been previously demonstrated. Furthermore, there was little reason to suspect that differential methylation patterns would be found between cell types for which the candidates were not targeted, like keratinocytes or melanocytes.

Generally, two PCR amplicons (200-500 base pairs long) were designed for each gene, but mainly due to the low complexity of bisulfite-treated DNA and the requirement to avoid CpG sites within the primer (which may or may not be methylated), primers for only approximately 250 amplicons were designed and created.

In most cases, DNA from at least three independent samples (representing standard examples of the cell types as might be obtained routinely by purchase, biopsy, etc.) for each known cell type were isolated using the Qiagen DNeasy Tissue Kit (catalog number 69504), according to the protocol "Purification of total DNA from cultivated animal cells". This DNA was treated with bisulfite and amplified using primers as designed above.

The amplicons from each gene from each cell type were bisulfite sequenced (Frommer et al., Proc Natl Acad Sci USA 89:1827-1831, 1992). The raw sequencing data was analysed with a program that normalises sequencing traces to account for the abnormal lack of C signal (due to bisulfite conversion of all unmethylated C's) and for the efficiency of the bisulfite treatment (Lewin et al., Bioinformatics 20:3005-12, 2004).

For each of the described gene regions, at least 1 CpG site showed significant distinctions between some pair of cell types (examples are shown in FIG. 1). FIG. 1 thus summarises the methylation data for 10 exemplary genomic regions (each associated with a different gene) in a comparison between 7 cell types. Each vertical block (labelled A-J) is a particular genomic region, with each individual column representing a single CpG site. Each horizontal block (e.g., "osteoblasts") represents a particular cell type, with each individual row representing an independent sample of that cell type. Each cell of the matrix therefore represents the average methylation level of that sample at one particular CpG site, according to the colour bar at the bottom (yellow (light grey)=low methylation; blue (dark grey)=heavy methylation; variable green (intermediate shadings of grey)=intermediate levels of methylation). Note that, for the present purposes, a single distinctive CpG within each gene is sufficient to serve as a marker. The statistical significance was generally determined by the Fisher criteria, which compares the variation between classes (i.e., different cell types) versus the variation within a class (i.e., one cell type).

While all of these markers carry useful information in various contexts, there are several subclasses with potentially variable utility. For example, COL6A3, FMOD, COL3A1, GDF5, and HIF1A typically show large blocks of consecutive CpGs which are either strongly methylated or strongly unmethylated in many cell types. Because of their 'all-or-none' character, these markers are likely to be very consistent and easy to interpret for many cell types. In other cases, the discriminatory methylation may be restricted to one or a few CpGs within the gene, but these individual CpGs can still be reliably assayed, as with single base extension. In addition to markers that show absolute patterns (i.e., nearly 0% or 100% methylation), markers/CpGs that are consistently, e.g., 30% methylated in one cell type and 70% methylated in another cell type are also very useful.

Some marker regions may be most applicable to or most distinctive for specific subsets of cell types. For example, CHAD, COL2A1, CAV1, ACVRL1 and ANXA6 are most heavily methylated in melanocytes, while PTHR1, KRT9 and FGFR1 are most heavily methylated in keratinocytes (among the cell types tested here). Conversely, genes FMOD, FGFR1, HIF1A and CNTN1 are least methylated in chondrocytes, COL3A1 is least methylated in adipocytes, KRT8 and CAV1 are least methylated in keratinocytes, KRT9 the least in melanocytes, and CD4 the least in Mesenchymal Stem Cells (MSCs). Keratinocytes and melanocytes are methylated in PTHR1 and COL6A3, while all the other cell types were not. Gene SPP1 is distinctive for osteoblasts among the differentiated cell types tested. Heavy methylation in GDF5 separates keratinocytes and melanocytes from all other cell types except osteoblasts (which is weakly methylated). CAV1 appears most useful in separating melanocytes from keratinocytes, while BGN appears most useful in separating melanocytes from fibroblasts, and FGFR1 for separating chondrocytes from keratinocytes.

One possible use of the markers would be to distinguish one particular cell type from another in a mixture, for example as the result of a growth or differentiation process. Table 2 shows examples of markers that would be most discriminatory between any specific pair of cell types, and which marker(s) may be most distinctive for one cell type versus all or most of the others. In some cases, 2 or 3 markers might be sufficient to identify and quantitate the cell types.

TABLE 2

Most distinctive markers for any pair of cell types and the most distinctive individual marker(s) for any cell type versus all or most of the other cell types.

|  | osteoblasts | MSCs | chondrocytes | adipocytes | fibroblasts | keratinocytes | melanocytes | Most distinctive individual marker(s) |
|---|---|---|---|---|---|---|---|---|
| osteoblasts | — | ANXA6 | SPP1, HIF1A, FMOD, ANXA6, KRT8 | SPP1, COL3A1 | SPP1, BGN, CHAD | COL6A3, PTHR1, GDF5 | CHAD, COL6A3, GDF5, COL2A1 | SPP1 |
| MSCs |  | — | SPP1, FMOD, HIF1A, KRT8 | COL3A1, CNTN1, SPP1 | HIF1A, SPP1, FMOD, CHAD, COL3A1 | PTHR1, COL6A3, GDF5, FGFR1 | CHAD, COL6A3, GDF5 | SPP1 |
| chondrocytes |  |  | — | FMOD, CNTN1, HIF1A, COL3A1 | BGN, FMOD, CNTN1, HIF1A | PTHR1, COL6A3, GDF5, FGFR1, FMOD, CNTN1, HIF1A | CHAD, COL6A3, GDF5, ANXA6, FMOD, CNTN1, HIF1A | FMOD, HIF1A |
| adipocytes |  |  |  | — | BGN, CAV1 | PTHR1, COL6A3, GDF5, COL3A1, FGFR1 | COL6A3, GDF5, COL3A1 | COL3A1 |
| fibroblasts |  |  |  |  | — | PTHR1, COL6A3, GDF5 | COL2A1, COL6A3, GDF5, BGN | BGN |
| keratinocytes |  |  |  |  |  | — | CAV1, ANXA6, KRT8, COL2A1 | CAV1, KRT8 |
| melanocytes |  |  |  |  |  |  | — | COL2A1 |

Additionally, some CpGs in particular genes (FGFR1, HIF1A, BGN, CHAD, GLI3 and CD4) appear to be sensitive to changes in growth conditions (e.g., prolonged growth as a monolayer), while some (CHAD, ANXA6, BGN, HIF1A and PRELP) are sensitive to induction with growth factors.

Figure 2:
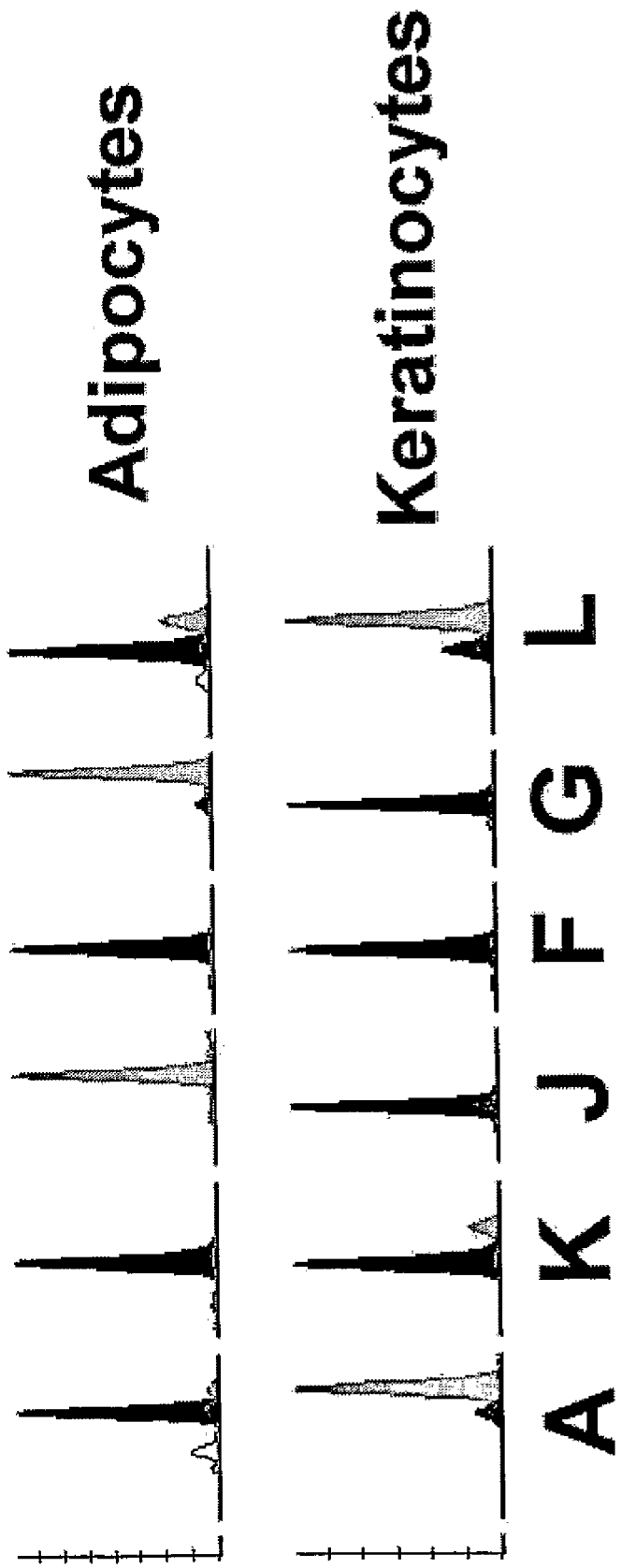
FIG. 2. Shows methylation profiles of six genes (A to F) from two cell types as generated by an MS-SNuPE method. Letters are as in FIG. 1.

The above regions therefore represent epigenetically sensitive markers that are then capable of distinguishing at least one cell type from any other cell types which display consistent methylation patterns within that region. In some cases, the methylation phenotypes were confirmed with a single base extension method (FIG. 2, see below). The finding of these methylation markers is a substantial advancement relative to the previous methods to characterise these cell types, as epitomised by the uncertain value of traditionally prototypical expression markers for chondrogenesis and osteogenesis (Kolettas et al., J Cell Sci 108:1991-9, 1995; Winter et al., Arthritis Rheum 48:418-29, 2003; Dell'Accio et al., Arthritis Rheum 44:1608-19, 2001; Benz et al., Biochem Biophys Res Commun 293:284-92, 2002).

FIG. 2 shows the distinctive methylation profiles of adipocytes and keratinocytes within six different genes (labelled as A, K, J, F, G and L). The profiles were generated using the MS-SNuPE method. The peak areas reflect the relative incorporation of C's (blue peaks) or T's (green peaks) onto an extension primer targeting a single CpG site in each gene. The ratio of the pairs of peaks (blue or green) at each site therefore corresponds to the relative methylation rate (methylated or unmethylated, respectively) of the targeted C in the genomic DNA of that sample. These ratios are characteristic and reproducible for many independent samples of these cell types. On a purely qualitative level, four of the markers (A, J, G and L) clearly distinguish adipocytes from keratinocytes, and in some cases the differential methylation between the two cell types reaches nearly 100%. The known ratio of these markers also allows one to calculate the quantity of each cell type within a heterogeneous mixture.

Completely resolving multiple unknown cell types within a batch will require between $N-1$ and $\log_2 N$ perfectly discriminative markers (where N is the number of cell types in the batch)—the number depends on how much the information carried in the markers overlaps with that of the other markers. In some cases, the markers are, in fact, useful to discriminate multiple subgroupings of cell types (as illustrated below); this tends to reduce the required number of markers needed. On the other hand, more markers may be required to compensate for those markers showing some biological variation.

As an example, the inventors can construct a dichotomous key, which incrementally splits the possible cell types according to a series of logical division points. For example, a possible first step would be to (logically) separate keratinocytes and melanocytes from osteoblasts, MSCs, fibroblasts, adipocytes and chondrocytes based on the methylation differences in COL6A3 and GDF5. Fibroblasts and adipocytes can be split from the latter grouping by differences in COL3A1. Fibroblasts are distinguished from adipocytes by differences in BGN and CAV1. Osteoblasts and MSCs can be separated from chondrocytes by differences in FMOD, KRT8 and SPP1. Osteoblasts are distinguished from MSCs by ANXA6. Finally, keratinocytes and melanocytes can be separated by methylation differences in CAV1 and ANXA6. In this case, a panel of eight markers resolves all the cell types; some of the markers operate at multiple division points (e.g., CAV1 and ANXA6), but some marker multiplicity is included to compensate for groupings that might be difficult to separate. Regardless of the logical structure of the key, this panel of markers would probably be tested simultaneously, allowing the calculation of the relative proportions of mixed cell types within a batch. It may be possible to use only a subset of markers (e.g., COL6A3, ANXA6, COL3A1, CAV1 and SPP1) to distinguish all the cell types, albeit with a lesser degree of confidence. Using a larger collection of markers not only reduces the uncertainty (due to measurement error and biological variation) but also makes the dichotomous key more likely to extend to other cell types.

Typically a combination of markers would generally be necessary to calculate mixtures of cells (as described above employing a system of multiple equations) and to resolve whether marker measurements were due to cells with intermediate methylation levels or due to mixtures of cell types with absolute methylation levels (i.e., 0% or 100%). Such an approach would employ marker profiles describing the methylation level at particular CpGs of each marker for a particular cell type. For example, the approximate methylation profile for melanocytes would be CHAD, COL6A3, GDF5, CAV1, ANXA6, ACVRL1, PRELP, FMOD, CNTN1, HIF1A, SPP1, COL3A1, GLI3, KRT8=1.0; COL2A1=0.9; PTHR1=0.5; FGFR1=0.3 and BGN=0.

These markers are also likely to be useful in determining the potency of individual batches of cells to effect a particular medical outcome, such as a successful Autologous Chondrocyte Transplantation. Class prediction methods employing learning algorithms (such as a Support Vector Machine) are particularly useful in cases where the exact the physiological or biochemical relationship to medical outcome are not known. However, it is difficult to predict a priori how many markers would be the optimal number for any specific usage; this number arises from the outcome of complex statistical algorithms and subsequent feature selection to distinguish, e.g., "therapeutic" from "non-therapeutic" batches of cells for that specific application. In one example of using methylation markers to distinguish between various types of tumours, 2 CpGs gave an 85% accuracy in class prediction, but 60 CpGs increased the accuracy to 94%. In another case, the optimal number was 5 CpGs, giving an accuracy of 94% (Adorjan P et al., Nucleic Acids Res 2002 30:e21, 2002). Given the uncertainty of predicting beforehand exactly what characteristics are most indicative of a "therapeutically successful" batch of cells and which genes/CpGs will prove most discriminatory, a good estimate would be between 5 and 25 markers as class predictors for any particular application.

Although the candidate genes in the inventors initial screening were generally selected based on literature, there is, as yet, no method to predict a priori how, when or where methylation changes will occur; finding them is overwhelmingly an empirical exercise, requiring intensive and laborious research. The connection between protein or gene expression and methylation patterns is, at best, asymmetric; increased methylation often correlates with decreased expression, but the reverse (i.e., changes in gene expression mean changes in methylation) is not necessarily, or even generally, true. The biological rules that dictate the interplay between methylation and gene expression are not known in spite of various approaches to deduce them (Jones, Trends Genet 15:34-7, 1999; Feltus et al., Proc Natl Acad Sci USA 100:12253-8, 2003; Millar et al., J Biol Chem 275:24893-9, 2000). The interactions between methylation and gene regulation may prove to be as complex as that already known for the transcriptional apparatus since factors such as CpG islands, enhancers, silencers, various non-coding RNAs and repetitive or parasitic insertion elements have been implicated (Bestor and Tycko, Nat Genet 12:363-7, 1996; Hejnar et al., Proc Natl Acad Sci USA 98:565-9, 2001; Mutskov et al., Genes Dev 16:1540-54, 2002; Wolffe and Matzke, Science 286:481-

6, 1999; Antequera, Cell Mol Life Sci 60:1647-58, 2000motiftr03; Gidekel and Bergman, J Biol Chem 277:34521-30, 2002; Grewal and Moazed, Science 301:798-802, 2003; Bird, Genes and Dev 16:6-21, 2002).

Conversely, changes in methylation are strongly correlated with altered gene expression. There are a number of examples wherein methylation changes either cause decreased gene expression themselves or else they 'lock in' regulatory patterns that are caused by other factors (Erlich, J Cellular Chem 88:899-910, 2003). In the inventive research, altered methylation patterns were found in cell types for which no parallel gene expression data is known. Furthermore, in many cases, methylation analysis may be a superior discovery method compared to either RNA or protein expression analysis for reasons cited above (e.g., sensitivity, robustness, both quantitative and qualitative changes, etc.). Subtle changes in gene expression may be lost or overlooked in large scale expression analysis, but become apparent by a more focussed approach once altered methylation patterns have been detected. In various instances, the behaviour of the corresponding mRNAs and proteins may correlate with or be primed by epigenetic modifications in such way that they are or are not expressed in concurrence with the methylation state. In these instances the protein synthesis and RNA expression patterns are claimed in their ability to provide an indication of the cell type and status.

The initial identification of variably methylated sites is not trivial. At this point, possibly a few hundred tissue- or stage-specific methylation states are known (out of approximately 30,000 human genes), and most are connected to early development, rather than to adult tissue. The inventors encompassed approximately 150 genes and extensive methylation analysis by bisulfite sequencing yielded only 25 genes in which variable methylation concurred with different cell types. Similar results were obtained from a herculean effort by the Human Epigenome Project (Rakyan et al., PLoS Biol 2:e405, 2004), covering 90 genes in the MHC region, in which only about 10% of the amplicons showed variable methylation between different tissues (approximately the same rate as in our study). This is not unexpected since each amplicon may cover only 200-500 bases of a potential regulatory several Kb.

On the other hand, once variable methylation is uncovered for a human gene in one tissue, it is likely to be a useful marker for other tissues, as demonstrated by the patterns shown in FIG. 1. Many of the markers are also stage specific since they distinguish mesenchymal stem cells from their descendants comprising various cell types. Some of the CpGs in these regions are also sensitive to changes in the cell state, such as multiple passages in monolayer culture or maturation from pre-adipocytes to adipocytes.

Furthermore, neighbouring regions to those defined by SEQ ID NOs 76 to 153 are also likely to show differential methylation, since, in some cases, the variably methylated region extends to the end, and possibly beyond, the amplicons comprising the named sequences. Due to the phenomena of co-methylation and "spreading", discriminatory CpGs are likely to be found in regions adjacent to those the inventors have revealed here. For this reason, the present invention also encompasses all or contiguous differentially methylated regions associated with the gene(s) as part of the invention.

Example 2

The inventors showed that six different cell types can be unambiguously classified based on their individual methylation patterns. Furthermore, the methylation levels at four discriminatory cytosines are sufficient to identify all six cell types, providing a specific cell-type "barcode".

The inventors included adult fibroblasts (stroma), adipocytes (fat), chondrocytes (cartilage) and mesenchymal stem cells (MSCs), all derived from the mesoderm, as well as the ectoderm-derived skin cell types keratinocytes and melanocytes. With exception to MSCs, where only one donor was used, three independent samples of each cell type were tested. For detection of methylation differences in these cell types, approximately 150 genes were selected. While a few genes were picked due to specific expression in adipocytes or MSCs, most genes were chosen according to their reported impact on chondrocyte maturation. For each candidate gene, two electronic PCR products were designed to target CpG islands in the proximity of the transcriptional start site. Due to low complexity of bisulphite-converted DNA and the requirement to avoid CpG dinucleotides overlapping the primer binding site, primer pairs were successfully generated for only 250 amplicons.

Human primary cells were purchased from Cascade Biologics (Mansfield, United Kingdom), Cell Applications Inc. (San Diego, Calif., United States), Cambrex Bio Science (Verviers, Belgium) or were a gift from TransTissue GmbH (Berlin, Germany). Samples from three donors were used for each cell type, with the exception of mesenchymal stem cells (MSCs), where only one sample was used. Primary cells were cultured according to the supplier's recommendations. Maturation of adipocytes was achieved by following the supplier's protocol.

DNA was prepared using the DNeasy tissue kit (Qiagen, Hilden, Germany). RNA was isolated using Trizol (Invitrogen Inc., Carlsbad, Calif., United States) following the supplier's recommendations. For RNA isolation from cartilage tissue, 10 mg were homogenised and incubated with 133 µl Brom-Chlor-Propan (Sigma-Aldrich, Seelze, Germany). Subsequently, a DNeasy minikit (Qiagen) was used according to manufacturer's recommendations. Potential DNA contaminations were eliminated by treating 1 µg of total RNA with 1 U DNase I (Invitrogen Inc., Carlsbad, Calif., United States) according to manufacturers recommendation. The reaction was terminated by adding 1 µl of a 25 mM EDTA solution and incubation at 65° C. for 10 min.

Sodium bisulphite treatment of genomic DNA was performed according to Olek A. et al., 1996, with minor modifications. Since methylated cytosines have the same base-pairing characteristics as unmethylated cytosines, the DNA is first chemically modified to distinguish between the two species. Purified genomic DNA was treated with sodium bisulfite, resulting in the conversion of unmethylated cytosine to uracil. In a subsequent PCR uracil is, in turn, replicated as thymine. However, methylated cytosines are protected from conversion and remain as cytosines throughout amplification. Thus, detection of a C in sequencing reaction or MS-SNuPE analysis reflects methylation at that site whereas detection of a T reflects no methylation. PCRs were performed on MJ Research thermocyclers (Waltham, Mass., United States) in a final volume of 25 µl containing 1×PCR Buffer, 1 U Taq DNA polymerase (Qiagen, Hilden, Germany), 200 µM dNTPs, 12.5 pmol each of forward and reverse primers, and 7 ng of bisulphite-treated genomic DNA. The amplification conditions were 95° C. for 15 min followed by 40 cycles of 95° C. for 1 min., 55° C. for 45 sec and 72° C. for 1 min. and a final extension step of 10 min. at 72° C. PCR products were purified using ExoSAP-IT (USB Corp., Cleveland, Ohio, United States) and sequenced applying the PCR primers and the ABI Big Dye Terminator v1.1 cycle sequencing chemistry (Applied Biosystems, Foster City, Calif., United States) followed by capillary electrophoresis on an ABI 3100 genetic analyser. Trace files were interpreted using ESME software, which performs quality control, normalizes sequence traces, corrects for incomplete bisulphite conversion and allows for quantification of methylation signals (Song et al., Proc Natl Acad Sci USA 102: 3336-3341, 2005).

To assess the methylation rate of individual CpGs, the inventors performed MS-SNuPE using the ABI Prism Snapshot multiplex kit (Applied Biosystems, Foster City, Calif., United States). The substrates were PCR products as produced from bisulphite converted genomic DNA. The assay utilizes internal primer(s) annealing immediately 3' of the nucleotide to be assayed. In the reaction, in the presence of labelled dideoxy NTP's, the primer is extended by exactly one nucleotide. Analysis of the elongated primer was performed by capillary electrophoresis using the ABI 3100 "Genetic Analyser" and "GeneMapper" software (v3.5). Extension Primer Sequences:

```
COL6A3: AACTCAAAAAACATCTCCCAAC;

COL3A1: AAAAACTAAAACAAAAAATAAC;

CAV1: AAATTAAAAATCTTCATTTCTTATTTC;

FMOD: TAATTATTCTAAAAATACACATACTTCATAC.
```

For first strand cDNA synthesis, the inventors used 200 ng DNase I treated RNA following the RevertAid reverse transcriptase kit protocol (Fermentas, St. Leon-Rot, Germany). First strand cDNA was directly used for PCR amplification. To assess expression levels of selected genes (semi-) quantitatively, we performed RT-PCR analysis according to Marone et al. 2001. Primers had a melting temperature of approx. 60° C. and were positioned to span two conserved exons at the 5' end of the transcripts. Amplification of GDF5, FMOD and COL3A1 was performed in a total volume of 20 µl containing 1 µl cDNA, 1× reaction buffer, 0.5 units HotStarTaq DNA polymerase (Qiagen, Hilden, Germany), 3 µM $MgCl_2$, 0.4 µM dNTP's, 0.5 µM of the specific primer pair, 0.125 µM aldolase (housekeeping control) specific primers. Amplification of COL6A3 contained 0.0625 µM aldolase specific primers and was otherwise identical. Amplification was performed at 95° C. for 15 min, followed by 32 amplification cycles for genes GDF5, FMOD and COL3A1 and 30 cycles for COL6A3 at 95° C. for 1 min, 55° C. for 45 sec and at 72° C. for 1 min. Amplificates were separated gelelectrophoretically in the presence of ethidium bromide and quantified with the "Gene Tools" program on a Syngene Bio Imaging System (Cambridge, United Kingdom). Target gene specific signals were normalized against the aldolase transcript.

In an initial screen, PCR products were sequenced for one sample per cell type in order to identify potentially differentially methylated gene regions. Due to the difficulties to design specific and reliable PCR primers for bisulphited DNA, approximately 100 electronic PCR products of the initial 250 were removed from the screen, either because they failed to produce a specific fragment in more than two of the six cell types or they did not produce a reliable sequence trace. For the remaining 150 amplicons, three types of methylation results were observed: (i) 90 amplicons did not demonstrate cell type-specific differential methylation, i.e., all tested samples showed the same methylation status. Of these, 72 sequenced gene regions showed no or very low methylation, while 18 sequences showed high methylation rates equally in all cell types. (ii) 35 amplicons showed intermediate levels of methylation in all cell types. Accordingly, observed differences were only moderate or detectable only at individual CpGs. (iii) 25 amplicons were selected as potential cell type-specific, large scale differentially methylated regions (CDMs). Bisulphite sequencing was performed for these amplicons on all available samples. In this analysis another four amplicons failed to show robust PCR products or sequencing results.

For the remaining 21 gene regions the inventors calculated the pairwise Euclidean distances between all cell samples applying the methylation information for sequenced CpGs. Since the number of comparable CpG measurements differed from pair to pair, they normalised these distances to the number of available CpGs. Thus, intervals in the tree directly translate into Euclidean distance per CpG. As shown in FIG. 2, the samples cluster into the five adult cell types, indicating that the average distance between the same cell type obtained from different donors is less than the distance between different cell types. For the adult cells, the farthest distance is observed between the ectodermally-derived cell types (keratinocytes and melanocytes), and the mesoderm-derived cell types. Note therefore, that the observed Eucledian distances of the differentially methylated regions reflect the developmental intervals of different cell types. Also, distances appear to be large enough for unambiguous differentiation between melanocytes and keratinocytes. Within the mesoderm-derived cell types, chondrocytes are easily segregated from fibroblasts and adipocytes, with large Euclidean distances between the branch points. The single MSC sample straddles the chondrocyte cluster and the branch leading to adipocytes and fibroblasts. According to this analysis, it is most difficult to distinguish fibroblast from adipocyte samples, which lie on the same main branch in the phylogenic tree. Fibroblasts B and C, and adipocytes A, B and C clearly fall into different categories, but the position of fibroblast sample A is somewhat ambiguous. The observed difficulty to differentiate these to cell types may be due to the original selection of candidate regions, which specifically targeted chondrocyte markers. According to this cluster analysis, 15 of the 16 samples can be correctly assigned to a cell type. Together, it appears that the measured methylation profiles are principally capable of distinguishing all analysed cell types.

Faced with the limitation of only three available samples per cell type, an exhaustive validation of the statistical significance of the discriminating regions was not possible. However, potent discriminators were selected to serve as tool for "cell typing" based on the following phenomenological and biological criteria: (i) Since it has been reported that differentially methylated genes were mostly found to be in a bimodal state, i.e. either strongly methylated or unmethylated (Lorincz et al. Mol. Cell Biol 22: 7572; 2002) the difference of the methylation rate between any two cell types as averaged throughout all CpG's of the analysed region were set to exceed 60%. (ii) Genes were regarded as potent discriminators, when a low variation among all tested donors of a particular cell type was demonstrated. (iii) Gene regions were primarily selected, when methylation occurred not only at individual CpGs, but appeared to span a wide-range of CpG methylation throughout the analysed region, a phenomenon named co-methylation. While each CpG in such cluster is not a statistically independent variable, the repetitive occurrence of various uniformly methylated CpGs within a short stretch of DNA in the CDMs suggests a biological significance, minimizing the chance of this observation to be a stochastic event. In FIG. 2, out of 21 cell type specifically methylated regions, 9 selected separators are shown. Some of the displayed gene regions were found as large blocks of consecutive CpGs, which are either highly methylated (95-100%) or effectively unmethylated (0-15%) in a given cell type. Additionally, there are gene regions, which are clearly distinctive between different groups, while not displaying strictly bimodal methylation patterns.

As was expected from the phylogenic tree, the clearest distinction was achieved between the two ectoderm-derived cell types versus all the cell types originating from the mesoderm. The amplicons derived from the gene regions associated with COL6A3 and GDF-5 unambiguously segregate them from the mesoderm-derived tissues, being methylated in both keratinocytes and melanocytes, while they appear unmethylated in fibroblasts, chondrocytes and adipocytes. All kerantinocyte and melanocyte samples consistently showed 100% methylation while adipocytes and chondrocytes unmethylated. Fibroblasts showed less consistent data, i.e., CpGs were intermediately methylated or were rather variable in this cell type among donors. Four CpGs in Caveolin-1 (CAV-1) are distinctively methylated between melanocytes and keratinocytes, with nearly 100% methylation in melanocytes but are primarily unmethylated in keratinocytes. Together, CAV-1 and either COL6A3 or GDF-5 are sufficient to separate melanocytes and keratinocytes, segregating them from each other and from all other tested cell types. Both FMOD and HIF1A are unmethylated in chondrocytes, while methylated in all other cell types. FMOD in particular exhibits discriminatory CpGs, with 0% methylation in all chondrocyte samples and 100% methylation in melanocytes, keratinocytes, adipocytes and fibroblasts. HIF1A was similarly distinctive for all cell types except adipocytes, where some ambiguity was introduced by low quality of the respective sequence trace. However, both genes individually allow for a clear discrimination of chondrocytes versus all other tested cell types. In adipocytes and fibroblasts, Collagen 3A1 is unmethylated, while methylated in keratinocytes, melanocytes, chondrocytes and MSCs, distinguishing these groups from each other. Methylation rates in all samples, with the exception of fibroblasts, were bimodal and showed low donor variability. To further distinguish adipocytes from fibroblasts, BGN can be analysed. The analysed gene region is highly methylated in fibroblasts (ca. 80%) but remains unmethylated in adipocytes. For positive identification of mesenchymal stem cells, SPP1 can be used. Although this gene does not display the bimodal methylation pattern, it appears that differentiated cells are 100% methylated, while the analysed MSC sample is only 50-60% methylated at particular CpGs. The ANXA-6 gene shows significant methylation differences between keratinocytes, fibroblasts and chondrocytes, which are rather unmethylated compared to adipocytes and melanocytes. As such, it could be used as confirmation of the CAV-1 gene to verify the distinction of the ectoderm-derived from each other.

Methylation states of selected individual CpGs in nine highly discriminatory gene regions (FIG. 5) are summarized in Table 3, which shows the average methylation rate and standard deviation within each cell type. Surprising signal stability is observed in particular for highly methylated regions, such as for FMOD in adipocytes, fibroblasts and keratinocytes. The sequencing data show no trace of unmethylated cytosine at these CpGs. Regions that are predominantly unmethylated show somewhat higher variability, such as within COL6A3 in chondrocytes or ANXA6 in keratinocytes. The least stable are those regions that appear to be in an intermediate state of methylation, such as ANXA6 in fibroblasts and CAV-1 in chondrocytes.

In order to adapt the observed markers to a platform suitable as a convenient cell-typing assay (and as a technical verification of the sequencing data), the inventors applied MS-SNuPE (Bird et al., Genes Dev 16: 6-21, 2002). Conventional SNuPE has previously been used for the precise detection of single nucleotide polymorphisms (SNPs) (Gonzalgo and Jones, NAR 25(12): 2529, 1997; Szabo and Mann, Genes Dev 9: 3097, 1996). Here, SNPs generated by bisulphite treatment distinguish between methylated cytosine (remaining as cytosine) and unmethylated cytosine (converted to thymine).

The sequencing results suggested that a methylation marker panel consisting of CpGs associated with genes CAV1, COL3A1, COL6A3 and FMOD can provide unique fingerprints for all analysed cell types. For each of these gene regions, individual CpGs (as shown in Table 3) were selected for MS-SNuPE based on the ability to design MS-SNuPE primers at these positions, their discriminatory power and the signal stability among samples of the same cell type.

The results from the MS-SNuPE assays closely paralleled that of the bisulfite sequencing. In most cases the signal generated at the respective CpGs showed either 0% or 100% methylation for the cell sample with no detectable peak for the alternative extension product.

From this data, the inventors can construct binary barcodes—with methylated CpG coding as 1 and unmethylated CpG coding as 0—for CpGs in the gene regions of COL6A3/COL3A1/CAV1/FMOD, respectively. As shown in the upper panel of FIG. 6, MS-SNuPE analysis of melanocytes revealed that the targeted CpG for all four genes were invariably methylated, with no detectable peaks representing unmethylated CpG at the analysed positions. This result translates into a melanocyte-specific barcode of "1111". Analysis of keratinocytes shows that three out of the four analysed CpGs are fully methylated, while the targeted CpG in CAV-1 was found to be unmethylated. Therefore, the keratinocyte-specific barcode for the measured CpGs is "1101". Thus, the selected CpG in the CAV-1 gene provides for the distinction of keratinocytes from melanocytes. Note that, while no signal for the unmethylated CpG is detected in either FMOD or COL3A1, a minor peak representing 2-3% of the total signal intensity for the COL6A3 gene appears to be unmethylated. In adipocytes, the analysis shows that the CpGs derived from CAV-1 and FMOD are entirely methylated, while COL6A3 and COL3A1 are unmethylated, translating in the barcode "0011". For COL3A1, a peak representing ca. 1-2% of the total signal intensity indicates a minor portion of methylated signal to be present. Analysis of chondrocytes reveals unmethylated CpGs for FMOD and COL6A3, and a fully methylated CpG in COL3A1. The CAV-1 gene shows strong signals for methylated as well as unmethylated CpG; this CpG is heterogeneously methylated at this position and can not cannot be used as an absolute indicator for this cell type. A chondrocyte-specific binary barcode would therefore be undetermined at this position and translates into "01X0". However, the CpG measured for FMOD is uniquely unmethylated in chondrocytes and methylated in all other cell types, allowing positive identification within the barcode. MSCs also produce a unique pattern with the analysed CpG from COL6A being unmethylated while all other CpGs are methylated, thus translating into the barcode "0111". Finally, fibroblasts display the specific barcode of "0001".

For a representative analysis of the gene expression in the differentially methylated genes, we chose regions with consistent and prominent methylation differences throughout long stretches of dense CpG regions. Collagen 6A3, GDF-5, Collagen 3A1 and FMOD fulfil these criteria and also appear to be powerful discriminators between different types of cells (FMOD) or different lineages (COL6A3, GDF-5). The bisulphite sequenced gene regions for GDF-5 and FMOD both map to the second exon of their respective genes, while the analysed region for COL6A3 aligns to its first intron adjacent to the 5' untranslated region. The amplicon for Collagen 3A1 maps to the promoter region, app. 1.8 kb upstream of the transcriptional start site of the gene and was included in this analysis due to its high methylation in keratinocytes and chondrocytes, and its low methylation in fibroblasts. For analysis we selected chondrocytes, fibroblasts and keratinocytes, representing both ectoderm- and mesoderm-derived cell types. For both FMOD and COL6A3, low methylation corresponds to expression and heavy methylation corresponds to little or no expression in all three cell types. For GDF5, heavy methylation again corresponds to no expression of the gene (in keratinocytes), while one of the two cell types with low methylation (chondrocytes) shows no expression. Finally, in COL3A1, methylation and expression are reciprocally related in fibroblasts and keratinocytes, but high expression accompanies heavy methylation in chondrocytes.

Example 3

The inventors furthermore showed that seven markers can be used to unambiguously classify chondrocytes from synovial fibroblasts. The following amplicons displayed a significant differential methylation pattern that allows for the discrimination between chondrocytes and synoviocytes FMOD (Fibromodulin)/AMP43 (SEQ ID No: 154)

Fibromodulin is a member of a family of small interstitial proteoglycans, containing a central region composed of leucine-rich repeats with 4 keratan sulfate chains flanked by disulfide-bonded terminal domains. It may participate in the assembly of the extracellular matrix as it interacts with type I and type II collagen fibrils and inhibits fibrillogenesis in vitro. It may also regulate TGF-beta activities by sequestering TGF-beta into the extracellular matrix.

AMP43 maps to the 2nd exon of the FMOD gene. The genomic sequence of AMP43 is shown in SEQ ID No: 154.

FGFR1 (Basic Fibroblast Growth Factor Receptor1)/AMP164 (SEQ ID No: 155)

The vertebrate fibroblast growth factor receptor family is highly conserved between members and throughout evolution. The FGFR1 gene is alternatively spliced generating multiple splice variants that are differentially expressed during embryo development and in the adult body.

The restricted expression patterns of FGFR1 isoforms, together with differential expression and binding of specific ligands, leads to activation of common FGFR1 signal transduction pathways, but may result in distinctively different biological responses as a result of differences in cellular context. FGFR1 isoforms are also present in the nucleus in complex with various fibroblast growth factors where they function to regulate transcription of target genes. Fibroblast growth factors are also important regulators of chondrocyte proliferation and differentiation.

AMP164 maps upstream of the 5'-UTR of the FGFR1 gene. The genomic sequence of AMP164 is shown in SEQ ID No: 155.

HIF1A (Hypoxia-Inducible Factor 1 Alpha)/AMP179 (SEQ ID No: 156)

HIF1A functions as a master transcriptional regulator of the adaptive response to hypoxia. Under hypoxic conditions it activates the transcription of over 40 genes, including erythropoietin, glucose transporters, glycolytic enzymes, vascular endothelial growth factors and other genes whose protein products increase oxygen delivery or facilitate metabolic adaptation to hypoxia. HIF1A plays an essential role in embryonic vascularization, tumor angiogenesis and pathophysiology of ischemic disease. Binds to core DNA sequence 5'-[AG] CGTG-3' within the hypoxia response element (HRE) of target gene promoters. Activation requires recruitment of transcriptional coactivators such as CREBPB and EP300. Activity is enhanced by interaction with both, NCOA1 or NCOA2. Interaction with redox regulatory protein APEX seems to activate CTAD and potentiates activation by NCOA1 and CREBBP.

HIF1A is a putative molecular component (oxygen sensor) which regulates oxygen homeostasis and stress responsive genes in articular chondrocytes.

AMP179 maps to the 1st exon of the HIF1A gene. The genomic sequence of AMP179 is shown in SEQ ID No: 156.

KRT8 (Keratin 8, Type II Cytoskeletal)/AMP308 (SEQ ID No: 157)

KRT8, a structural protein, is involved in the organization/biogenesis of the cytoskeleton. It heterotetramerizes with KRT18 (two type I and two type II keratins).

AMP308 maps near the transcriptional start site, targeting a region spanning 1st exon, 5'-UTR and promotor of the KRT8 gene. The genomic sequence of AMP308 is shown in SEQ ID No: 157

PKNOX2 (PBX/Knotted 1 Homeobox 2)/AMP522 (SEQ ID No: 158)

PKNOX2 is a member of the three-amino-acid loop extension (TALE) homeodomain proteins which are highly conserved transcription modulators. Cooperative function among PKNOX-related proteins seem to be critical for regulating transcription, and thus for cellular proliferation and differentiation.

PKNOX2 is a novel TALE-homeodomain protein and may interact with PBX proteins and plays a role in tissue-specific regulation of transcription. Unlike transcription factor PKNOX1, which is broadly expressed in many tissues, PKNOX2 shows a more restricted mRNA expression pattern.

AMP522 maps to the 1st intron (near the transcriptional start site) of the PKNOX2 gene. The genomic sequence of AMP522 is shown in SEQ ID No: 158.

C15orf27/AMP537 (SEQ ID No: 156)

Predicted protein; (Ota T. et al. (2004) Complete sequencing and characterization of 21, 243 full-length human cDNAs. Nat Genet. 36(1):40-45)

AMP537 maps to the 3rd intron of the C15orf27 gene. The genomic sequence of AMP537 is shown in SEQ ID No: 159.

ROPN1L (Ropporin 1-Like Protein/AKAP-Associated Sperm Protein)/AMP549 (SEQ ID No: 160)

The protein encoded by this gene is a sperm protein, which interacts with A-kinase anchoring protein, AKAP3, through the amphipathic helix region of AKAP3. Type II regulatory subunit of cAMP-dependent protein kinase (PKARII) also binds to this helix domain of AKAP3, which allows PKARII to be targeted to specific subcellular compartments. It is suggested that sperm contains several proteins that bind to AKAPs in a manner similar to PKARII, and this encoded protein may be one of them.

AMP549 maps to the 3rd intron of the ROPN1L gene. The genomic sequence of AMP549 is shown in SEQ ID No: 160.

SEQUENCE LISTING (160 sequences)

SEQ ID NO: 1 - DNA, 41974 bp, Homo sapiens
cataaagccgcacaacaaaggggaggggagaggaaagagagaaacattgaaacatttctgttccatgtgttttccatggtggagataattgattttcttagtgctgttgtagaaagcgctgctggcattcactggcctactgagttcatcacagctgtgcttgtgcatctctctcaagctccactttccactgaattggaaaagatttgaatttttggttgataatctgccacacccttgctttgcctcatctttccaggcactctctttgttaaaggagatccagattaatcagtgctttagttggtgcaggtatttagatttgtgttaaagctccaaatgcaatccaaaaagcaaaatgacatgtttatgtgtcctggttaacatcagtgaagtcagggaagtatgggaagaaatgtgtggctagataacaatgaggacagcagttcctggatggcataataggattcagaagtgtatgcatttcacctagttcagaccctgtattaagaaatgctttgaccccgtattaggaaatgctttgacaggaggtagaaaaataggatctgggacacagaatgcaaaggatcctagtgcaaaacctccatattcgaggtagtgaagaatcgtaaatcagaatatctggagaatgaattctctaggtctctcctgaagaccttaaaatacaacaatccttccatatgcaaaacatcagctaatgtttcttaagtgagtgcatcaatcatgaatttttctcatgagtataaggcttttatttgaatagctaagcaaattaagaattttagaacaatagtaattttatttataatgcctaaaataaagcataacaagcattattttaaaaataacatttctaatttttcacagtggaaaataaatctaatgaagaaattcaataaatttcagcttttatagaccacctaaaacaatgagagaaatctaatatagatatatgaattctacgtagatacaaagacatcatgagaaaaactatgtttctgaattggtttgaacacaggaaatattttttgtgtacaggacaaagatgtctgaaagacagaaagatgcatataacagcctttccccagcatctctactgtgatccagtagaaaagcttatattcatgaccattctcaacagttacttttctcccacgcccccaagcagtgactctccaatctaaaataaagatacacaagaggttggtctcgttctagttttcctttcctgtcatcaaatgatgtcatctacattgagatgtcttggtttgtgtccttgtgactgaagatataagaaagcttgggaggccgaggcgggcggatcacgaggtcaggacatcaagaccatcctgactaacacggtgaaaccccgtctctactaaaaatacaaaaaattaaccaggcgtagtggcgggcgcctgtagtcccagctactcgggaggctgaggcaggagaatggcgtgaacccgggaggcggagcttgccgtgagccgagattgcgccactgcagtctagcctgggcgagagagggcgaccccgtcgcaaaaaaaaaaaaaaaaaagatgcaagaaacaagaaagcaagtttgccactgtccatgcttacaggattcatgtacacctgggaatatacatatgacatgagttgagtgaaaatttagtaacacaaattagaagaaagagaaagatgaaaattagtttaaaggaggtaatttacttaaggaggaaagttttgcattgaggcataaggaagtgacttccattaattggtgtgaaatggggagaattttatgtgcacaggcatagagacggacatgtttaggtgaaggtgaagaaaattagttcaagtgaccttgattagaattgaaatgtccaccgtagattatagagatagatgaactaactatgaactgatgattagggtgtaaagagatatctccattgccagatatagccttatactgtggacaagcatatttttcctgcagagatttatcaaagacctataaatggtatttgcccctctttcaaatatgacacaaaaattactgcttagatagatccagaaatacattggaaagttttgtggatgaggatctggaaagtatacacataaaagtctaaattagaaatatttatactaatctttagagtaatgcagaaaaaatgaccactttctctggtactcttttgctattctatgtgataaactctttctcttccagtttcctaaaaagttatgtcatgaaaaggctgaatttttctctagaaaaatctgctctgtctttcccaggcagcataaaaattggaaatctcacaagaaagcactctggcttgctaaagaaatttgtgagaaatggaaacagctatagataagtatctaacttttaggaagccattcaaacattgctgaaatactttgtcttttgatatttgcctgaaacttaacttctaggacccagggtgggtggatgagtcgaaggggcatacggtggcatttctttccgtgagtctcttacagtctcctatttaaattgagttaggattacttctggcaaaatcccaacataaaaatcttctaggaagatcagttctgtaaattagacatactagataaatgggcatcaagcagtttttcaaaattatgcagttgttaacttcataaggggaaataaaaatgtatgcatttacattgtatgtattaaaacaaggcagagcatttctatacgttcctaagttatacaaacatatatgtaagagtgaaatatgtaaaaaaacttttacataagcagatgcatacaaactccagatgtgctctttttcttactgtgggttgtgtcttctataagggaaaaagaaatatttatcatttcttttactgctgaggggatgggtgcggctctcatatttcagaaaggggctggaaagtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaaggtgagtaggtactgatttcaagaaactttatgggatttttgtctttcttctcctcacaaagaggggtgtaaaggggaaaatcagttgcctgattcaagataatttcctctataagctccagattgtgaaacgttgaactgaccatggctgtgctttttacattacttgaaaaataatcgcgttatgtgtgtttttaagagttctgtggttaagataagatgttcttgtactaacttgttttcatgttaaaggcactggaaacttttaaaaatggctttaaaatttttccctcctggattgttaacatcttggaatacttccccaggcagtctggaagttattggtctcttgcaataattttatgttcctctttgtctgctggattctttgtaaggttagaatattgagcattgttttctgaataagaatgcctttcaaatatcatggattaagaacagtctaaaggaagattctacgcattatcagaatcattgaatatatttctgtaaaatggctacaagatacctataaacattcttcaaagggatcaaactgctaaaatattttattattcctgtttttattttgtttcaagaatgattgattaattcatcttttctagtagcttgatattaagggactaatattttccacatattctacgttttaaccacattcgcattaatgaagaaaatattttttaaaatgtttcaacaggaggtttgactttgctgcaaacaaggtaaagatactagtactgtttgacttcagaaagctgttttgctatattttctaataattgcatgtaatgtttttcatattctaatttcccctaaaaacacatttgtctcattatttatgtgaaaatattcttttatttaccatagtcatgaaaatgctgaacaaattggaatacaaacttccatagaaataaatatttaagtgctaaatgtaaagatagctaggagaaattattagacaatttttattgcacataactaaacatggttacatttaaacatatagattttgcaaaggacactgcatgaaaatttggtttttgtttgtaatatcaaatgtatttgttgtcctcatagctaatacatgtaaatgtgtgtatgaggggaggggtagatatacaatgaaatgtcttcagttatattcagcccatggacacaaaagaaaagaaacacccattttccttgttcccttaatttcctctcctccttacccctcctctccttcgctttgccctcctccttatctctctccaccccttttggctcctttagacttctcttcactcatcaccccaccccttcctaggcaagcccatatctactcctctctcctcctctgtcttccctgcctgttactccctccctactccccatgtggcctccttatgcctccatttcttttttttagttctctctctccttgcctcctcaccctttctttcccctgaactctcaatccttcttcctttctcattcctctccccttttcctccctatcctgctcttcccaggagatgctacaactcacagtccttttttaggataccaaatgactactatcccccaccaaccatttattgaaaagactacaaacttaggggttttagctcaaaaaattgcaacatatttgtagttgcctcgtggttgcaagctttttataagcactgtggctatttttcttcccaatccaactttagtgggggggtgtttgccacttacagtaccttgacatcacattaagttctgtttatttccctctttctctttagatgcaaaaaataatcaataagtataaaattttgctgatatgtgtttgtgtgttcttaagctcaaaaagagttgaaagagaactgttcagcctattttttttgtcatgagtaaaagtaaagttgaagtgacttaagacagtacatcttatgttccctgtgggttttacaaggaaattctgctattagataagctttggaaaagttacaggaggtatctgaatatacagcacactgagagctgtcataaagttctggggtggggtttcttatatatgccctcataacttcagagacggcacagctctaatgaacactcacttctagttcactcacaggcattttctggatacaaacaagtcctcaaaaagaattttggtcgtcttacaaatttgtgaacattgtatttaattcatgtgttttaatccaccaatggagaaacatagtctgttttatatttcctgtagattataaacatgccaagttttaagtacaaagatgcgtcacctagtggctgacaagccaggttaccatttacataacgaatgccaatattaatgttatgtagctggctttggtagtttataatgagctttaaaaaattcatatgcgtgaattttaaatgttaacactgctctcctaaggaaattagtatgttacggataaatattgcaaacacatatactgacacgaaaacacaatggtaacaatattcagagtctttttggaaattagcttaaatgttacggccacttaaaaattctacatatgactattgtttaaatacatttttcatgtctctgatgtagtccttatttgacataagtattttattcactgcttaattgttagatagattatagacagctgttactaagtaatactgctccattagggcagaaacagaaactttattttaattaaatgtgtactaatgtttgagtttctatattttgctacagtgataattccagtaaaataaactgtaggcctctagttgttttagaattttaaaactgtaaatggactcagagaatcagtttcttattagacgtcatgagagtatatttttttcattatgctttaagagggaatttgtaacttgctcaggtaacattcaagttttctggtttgtgtttgtccctacaattaaacacactgaactaacaggaaaaggttacatacatttaggaacaattgcacttttaaagggagagaatgcatagttgctcacatatctcagtgtcagtcacctaacatggatcagtgctttatttgagattacaaaactagaaaatgacggagtcaaggctaggaccaatattctgttcagtcttagataattatagaatacacattaaaatcagatatttgaattttcttaattttgtaactatttgtcattgaaaggagatactaaaaaaattatatatcgtcctagaaagtacatgaactaataatgcatttctaaaggtgaaaaaagaataggtatttttctgtttaatattcaattttatagagagtagtacgttaatttttttaaaccccagaagctcaggatcttatcattttaaaagaaattatcaccagttctgtgtgagtaaataaagtattataacactttgtgtttttcatccatgataccttgtatttacttacctgagctttttttctagggaaagaaaaatgctcaggtaataacagagccttgaaaaatttggattttcaaaactacctatttatgtataggcctttagatcatctgatgttgaatactctttaagtgatctaaaggcctacatataaaaaggtatttttattaaattctggaattaaacatttcagcattacaagaaaagaaagcaaatccactggaacaattctgggaaagaaggaaagactgtgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactcaaaaaaaaaaaaaaaaaaaagatcatatagtgtaaaaaaaaactctccagacttttcaaaggggaaactttgcctgtttcatgtcaagatgacaacggaaaaaatgagatagctattcttacataaatcatttgtgaactgcagttgggggagttacattaaccaccagagtttcagtctgtgtctaatgaaaacacagcagaagtggattcctttcagattaactaataaaacccttgtttttttccatgactgaggtcaagcactgctgtttaaaatgtagtcttaatgaacaaaatgaaacgttgaaagaggacgagtcaaaatgcccaaaagatgtaaacatcaaagagaaaagatccagaaattattaaaagttaaacttcccttgaattctagtattaagaaagtactgcttcagtaaaatggcatatatttttctgaaactgtttttctatagtattttgtgtggaggatgacagagactgcatttctcaagtaaattaaaatcacagaaatactctttggagttgcatagcatgttcacaacgttccagtttcattcagtgaaaacttctgatgaacttagatgtatattaacatgaatcatttagtaactatattttctgaaaaacagtgtgttaatgagacatcttaaacatatttttgcattggatgcagaagtcttttctgtctggtactattgttgttagaaccctacttttttgtatatagcaaaatgtatgcagggtttctgagtcacacatttattctgttggtggtctggatgtcatcagggtagctttagagatataacccttcttcataaggtcaagagaaaataaacaggagaatttaactccagatggcatcttcctgttttgaggccagatagaaaaatattttgcaaagaactgttgtccttcaaaatatacctatctagattcagattttaaccttgcagggataaaaaatcatatgggacagagctttggagttggcttctttaatcgtactcagttttgaaatagcagaaagaaaatagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggaggtactatagcactagttttactaacgctggcaaataaaattactctaaggaagaaattaaagtacttagtaacttagtgataaggatggtgaaatgtaaaattttatttataagactatacaatttaaagttgtttgccaaatgtaataagacaagtagaatatattctcttcaatgtttttataatttgacactaagaagattttattatatatgcaattgctggtggttagatatatgatacttaaaattttctaattatctaattatttttatttttaacaggataaaatattaatcaacttaaaggacatttctaaggagattgaattctaaaagattaatcttttagacaattctaaaagattaatcttttagacaattctaaaagattaatcttttagacaattctaaaagattaatcttttagacaattctaaaagattaattgaattctaaaagattaatcaacttaaaggacatttctaaggagattgaaaaagcatatatctataaaatatgaaacaagaaaatatctacaaatgataatttatcaactttttttcctggaggtagcaagaataaataaaatcttattttctatgcaaaacagtgcttttaaattaaaattattcacctagaatgtctacagatactttcttcagagtcctttttgttaagtaatctaacatattttaagatactctgataaatacataagcagcagaaaaaatattttattaaaatttatgttttccaaacaatatcatttaaaaggcaaaccaaacattatttcaattggaaactatatgaatgccaaatacccacatgtacaaaatattcagctttctaaagtaatgaaaataattatgataatttatatatcatatctgtgattcttagattttcagattatacaacatcttttcccagataaggatttagtaagaagagaaaaggaaaaaacattcacttttcattcaagccaaattaattaatttaattaggtgctttagggaataatattattgctccaaaaatagtattaagacaaacataacattcattttttgtccaaacaatatgatttcttcaagtcagcatgatttaacatgaagaatggaaacaaaaaaatcacaaaatagtaagctttatgcacatctaaaaatataaaattatgttatttggctttatttttctctaaaattccaaaatagaaaactaggaaagaagcagctaagagtggtttaagacatgtgttagcttcaatatgttttatattatagatcccagcaaggagatgattgagtttaatacattgcttgtgtgatcacaagtaaatttctttcagaattgtacttcgtagtaaggaacagaaacaccaaatgacatgggagatggaatttaaaattaattataaattggaacagagagatttagtttaaacaactaaaataatggaaataattggaaagtccattacttttcaatagtagaatgaaattatttgccttttatttaatatttttggaaaaaattaacttatttttttaaccgaagctactctgaatgcagatatctaagaaatgaagagaataatatgagatgacttacttctaaatcccattttctattctatttctaaatgttgcaaatggctaactagagcatttttattcctctagaaacaaaacattcttttccttgactttgccatgattttcgcacatattactaggtattaaatgaaggtccatgaaacatcaatctaagagctttaactttcagtagaatatattgctaactatattttgtcatgcatggaataataaaggaagctatacaaaactatttttttcagcaaaggtaactaaggtagaaaaacagagaaagggctaattttcagccacaagtttttacaggaactgacttctcaggagagccaaatttatttcaagtggatgtgaaataagttatggcaataaataaagttgcattaattcttattttttaaacattccaactctcttttttttacttaaaacaatatgactttctaaagtaaaacaaaacatacatgcaccatgttgactgtcatgtgcaggtgagaagagaaaaatattttaagaatatgataatttttaaaattgcactaaaataatctttatattgaggcctccgtgttttaaaaagtactataatatgtttctaataaaatttagaaacaataagctaaataacaacgttaatacttataacattgcatttgacccaattttaacaaactcatttacaattttaataagtcaatattgtgctcatttatttaataattagcagaacaaatggaaagtactgtatttctaatgatgtgaggacacccttaatgagacataaacataggaggatgaatacacaggagggaaaagtatttatgttaatttctaggcagatcaagaacatatagaagatacttaaaataggaaatgtttgagcctagctttaactattatcttcatttgtctttaatatgcctttagtattcaatggctgtttttcataatccacgtgctgtattaagtgtgaaaagatatgcctgatccagaggcaatgagctaaaagaatcatctgtacaatctaacaatgcttttgaggatggatctggagggcttaaaatacacattattaatgggaaaatcttgggctgaaactaatctgtaggaatatttcatataaagttgatttggagaaaatttttaagtggttcattttgagaaaaggaaccaatgtaattacagtgttccatgtaattttactgcacaatcttccaaacccaaattttcggaccttttctgcagactggtgaacttagtacttaaatatgaaacgccagttctgtctagagaacaaaatgagtttaatgcatagactcacctgttattactcttcacaccaatgtgtaaatgactgtttgctcttctattaaatatattttccgtaacaccattcaaataggcctacttcatttccactgagataagcattttggtattcagcttttatattcactaagaattaagaaatgctgttttaaaagcttaggaaatgtatatagaaaatatatcccatgttctcatatatgtgtttcagacataggggaggaattagaataaattttctaaataaacaaattatttgcctacttaaaattgcaattaaaaaatgaagctttccttcgttagctgtaaactacattgagaaattgtaacataaaaaagaatggatttttaaaacttcttgagtagatcaagtgtcttgtacaatatcattaaatttgtatcagaacacataaatggaaatgaggtggggaagcaattgcagtactttctagagtctaggttttgaaattctttttggtgaacatttactaaatcagctaaacatttcaactcatttaaacacaaacctaaattattattaccctagacagagagatgatatagcaacgggacctcgaaaaggtgatcttttgtggctgcatgtagtgcccagatggaaaaatcttaggaccactaaaaggcctcttgaccactaggcggcaaaaactaattttgaactacttgcctactcggtagcaggcctctttcaatagacattttaaatatcttggctttgagaaaataaaaatttcaccatctcacaaaaatataaattactgaacagtacatcatttgttgtttgcaaaaatttttgcagatgcttagaaacttattatttatttactcaattactggcaaactatcatactaattgtcaagaactaaagttgtatttaaccacaatacacagctaatgccttaagaattgagaccaggttttgttttggcaattcctaagctgattcatagttaatagctgctgaaatttcagtaccttgtatataattatgaagcaagtctaaaattttggttgaagcaattttttttaccattttaagccacaaatacagatggttatgattcatattttccctattatttttacttattccttgccaatgtttattttaaaaacatctttttcttttctttttggtgatttggaaatgtctttacatccatatgggatatacaatatattatgtcatatcatgttgagctactaatgccaaatagagctaacagtgacattcaatacacataataagttctgttaaaactttcccaggaaaatctggtagagttttatgctgccaagattagctcagttttcccctgaatttctcaactaggttgataaaatccagaaagtcttcagagttagtgacaaaatcatctctttagtttaatgctcccatctgctgttaaggcaaagaatagcaattgggtagaagagcttattttcaatgttcctttaataaataaatgtttaaatgcttgtgtgatatacattgatgttaattcttactataaatgaaattaaaatatctgctggtcttaaggaaaattgactatggtgtgccaattttatgttaacaagcagatatgatattttaattaatttcttgctacttagcaaattacatagggcaagtataattttctaatgaaaggaagaaattatttgtttcaaaccttttcaactttggctattgttaatagtcctaacagagtaacaaaaatcacctttcagcaaaacctaaggaaacttcacgtcatctaacttgtttttcagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctgtgagtttaaagataaactgtacatcttcaatattcatatttagacacatgaatagctcctatatcataggagcctaaaagggaatgaaagtcatgttcatcaaatagccatgtttgtattacgagtaaaaagtgaccgtttcaatttaaagataaggattggttagaatctgggttactaaataatatgcaaattctgtgtcttgtttaacttgtttcttttccatttattagcctactcgccctcctaatggtcaaggacctcaaggccccaagggagatccagtaagtaaacattcttcagtagaataaaattaatactaatgataattctagtaagagtttgctttttctagatttgagctttcatcatacattctcttcattaccacatatttgaataatggcaccaaacaacagactgagaatccataattgtacgtgtaaagatttcaatttcccaaacttcatattatgtcttcacccccatgatcagtttaaagaaaatgtgtaggtcaatatacaaaggaatacattatacttaaattattcacaagattttgattaaaaagtatgtgttataaagaaaatatattacttatattgtttcctaatattataaagtagagaaacaacaatctgataatgattgtgaatcaccaggatttttcactatttaatttatttttatctcttttttagggccctcctggtattcctgggagaaatggtgaccctggtattccaggacaaccagggtcccctggttctcctggcccccctggaatctgtgaatcatgccctactggtcctcaggtataacaattacggtacttaaaaaattccctcataaaactatctagttcatcttctttctttactcgatattacgtctcactattatgagttctttgtatctgttctctgattcagtgtatttaataaatccttatttagtgcttctatgtattaggcactattctaagtactttataagtattcatttttcctcataatgctaatgtcattgctactatatccttggaaaatttgctaatttctcagcagatatatagcatacacattatgtttaagaagtgaactatgaacttaacaaaaaaaattaacctaaataatttagttagtactgtatccatactttattctcctactaataccaatgtcaaagcctctaaaagtttagacaaaaagaagttgaagaactgttagtattcctattgaacaggattatttctgcctatgaaactgctcttgctaatacttcagagcacaccttgcttctcctgaagcatggcagccaaataaatctgcaggtaaaacaaccaaacaaataaatatgacaaaatttctgttgcatggaattaggtgaaacgagaaaatatattacacaaatttttgtgaggttaaaaagtgcatttcaaaaagcaattcaacaagaaccaaagtatattgtctaagttattcttattctagtaaccaaacagaacctaactctagacctggaacttagaatttaaaaaaagcttcaaagaaatctaataagcatatgagcctttctactattttttggtttattttctatggagatgtttatttttgagtgaatcttttagtcatattaaccagaatccaggggatatgaattttacttgtatcattaagtgtttgaaaaataatttgacttcatttttttgctcaaaatgagaaggtgtattatatgatctcgagactcttttggcctcaaacagcctatgatcctatgtttgtaatgatgtagctactgcttagaaataatagcttaagtaagcgcataataggaaaaattggggggaactaacattgaacacagtggaaagatttgtgcatcccacaagaaaatgcttctgtaggatatctaacgtctaaatctacagaaagacacgataaacaagataattagtgaatacataccacatcttttggcacacaaaaacctatcagtagacagtagatgttgcatgcacttctaaatgctttttaaaagaattatgaactgtctgttaaaatgatcatatctatttgtctccttgccacagaactattctccccagtatgattcatatgatgtcaagtctggagtagcagtaggaggactcgcaggctatcctggaccagctgtacgtacaaatgtttctcagcattttggagctttattatctttctggtttgtaaaatcttgaatggttgctcttctaggaattcagtatttttatggaattgtacaaaatagcttacccctactaaggttggaaaagaaaatggtagcattatcatgttctttctatcttattcatattattaaacctatttttaatcacatataaatttttactaaaaaaaaaaaccaaagtcaacacttattaacatctcagaaaagtgtttataagagaaaatggaaatatacaaactattgttttataaatttactatcagtatttagaaacagcatgttacaaaactgaagcatactgttttcagcttgctgaaggttttctagtttaatctgtatttctgaacaatgataaatcaattgtcctatgtatgatgattcttgcatgatcatataaatctctatgtcaattaactctgtgatagatatatcaacataattatgggacttttgggttgatttacattattattttagatacttgattataggatttctagtgtgccaataaatgtttttctgcactgagtttggctgccaagcgagaaattgcttcttcaccagtgcaatataaccctaacattgcagggattttcatagcattatgtactagtttttccagatttttaattcccttccttaagagttcaggacaacattttataacatttattaataatttatatagaatctgtgagaatttcattacagtaatgtttgcttgctaagatcttcattatagatctcatgaatagttatcaaaaagttatcaaaagatgagatatagttgttcatagttttaacaatgcgagtgtcattgctttgaagcatggataaagtgtattttgcattcatttattttgtttttcattcaaattcacattccagggccccccaggccctcccggtccccctggtacatctggtcatcctggttcccctgtaagtatagccattggtggtgttttcttcctcatttttagaaaaatcaaattaatatatattctgctataattcagccattccagcatgcataatcccagttaactagagaaatcataaccaagaaactgattaaggcttcaaagatggaattccatatttaattcctttccaccaacagttattagcaattgaaatcttggtaaaattaaaccacattaatttgcatgtaatatgacttttagttcaaaaccattcagttttgatggattgcaatgaatggaatgaaatacattaacttcattctgatctaaaaataatttggtctcaatatttataaactggagtaaaatttgctgattacattcacaatcctgatttcttactgtcaagatgtaaatgaattatatgaagattttgttactttaaaattatttacatattctactcactagggatctccaggataccaaggaccccctggtgaacctgggcaagctggtccttcagtaagtaacaattaaatttatatttagtaagtcgataattccatatggaacctacctttgttttctaaaacaagtataggtctttacagaatgaagattaaatttacccttaagtttgtaaataacgaatagcattttattgagtcttttggactctttcaattgttagctatcttagagacactagttaataaaggaattccctcatcattagccatcaaaatagtccacttcccagagctgataaaaattctgtatatattaaatatagatttcatttttctgtaaacactcagttcactcatatctaatctactgataaatatagttatatatttacatatgtaaatatacatatacatatatcttagacagtagaaataaacataatcttagagagtcctttagaaggatatgctctgtaaataagcaagtaaaatagtttaaatacaacatttcatgacatttagaaatacctttatatttagatatatttaatattcctaaacgtgtagaaatgcatttggatttataaatacacatacgtaatatatgatgcttttaatttttattaacagtaagttgatataatagaggtataatattaactcagtaagtatcattttcattatcagaaacattaaaagtattttctaaaaggaggttccttccaggaatacatacactgtgtaataataaattgtaacagaaaaatttacaaatctattcattttttatttccttattttcagggccctccaggacctcctggtgctataggtccatctggtcctgctggaaaagatgtaagtttttaaaacttaaataagaatacagcaaaatttaacttggtgtattctaaacagtatatgctttatgtcagaatcccagaagaaaaaaaaatgttattcaaaatattgttgtcttaacaacattttagttaatactaatttttgagtagctatacagtatttgcgtttctatatatatcatttgttgaattccaaaataaaatccttaaagtgctttttgactgcggagaagactcatccattgaatatattatttaactggaggagaaataggtgtctctgcctgcctcttttaatgatgaaattgataccactatttaatgaacttgagaagttatagataccttcaattcaatggcattccttctttccctcttaatctccaatggcaaattcttttcactggcttatgttatttcagtgattagaagcacctgcattatctctttataagcttatatcaaagtgggaaaggtcttcctcatgccttctaccaagaaagctgatctcaactatacattttgtggaaccattttaatgagtcctttgtgagaaaaatgcaaagtaaccattttgcttattggctacaatgtattttctcatacatgagcacctacgtattctttatttctctacctagggagaatcaggtagacccggacgacctggagagcgaggattgcctggacctccagtgagtcttcagcatctaataaattaattggaataatcttagcttgaaaactattatgtaattcaatggaattaaacttaaaaacagaaagtgttttactactagattgtgattctatttgaaggttcattaatattttttcattcattatttttagggtatcaaaggtccagctgggatacctggattccctggtatgaaaggacacagagtaagtagagtttctaagttgtttacaaggtattccactgggctatgtttacttgcctaaccaattttactggacaattatgtgccaaaaaatatgattctgacaattaattaatttgatatttttaagtctactaagtttgtttgttgaccaaactagtcattttttgcaaaataaaggagttgatttctagtgtataaagtactcttgaaaaatatcgttttcttactaccactatcagaaaaataaaaacattttgtgaattatgttttttattgacttaatatgatttatagattgagttgaacaactttattctatgcaaaatatttcgtacattcaaccaactgtgcctacaacctatcaactgaattataataaaatctatgaaactcatgtttgctactctatagttaaggcaactttcttatcagactaaattgcactttctagttttcatgttttcctgttgtaaaatcagtatgaaatatcttcaacccctttaaacaagttttaaattatttaagctaattttgcaagtagtgttatgaagaccaattagaaaaataccatgtaaactttatcaatcattctagattattaacagattttaataattttgctggttttatacatttcctagggcttcgatggacgaaatggagaaaagggtgaaacaggtgctcctggattaaaggtaaatcacaacaaaaatcatattttcataagtaaattcattaaatattaaagctacatataagattcatattgtgagccttaacttgttttctgaaatttacctgaattttacctattaggtgtgaataatggtaaccaattcagatattctattaacgcttccatgaaaaatgacaacttgaagagtctagattagaaatagttgagcatcttagtataacttatcaattacttcactttagtctttaagtttttaaatacagaaattgagatttctggtaaataaaatactaacagaaaattaatattgttaaaatgtatatctttttctaggctctataaacttttccataatattctgtatttaaaaatatataatattttcttcctcttttgtaaaatagtaacatattttatatgtatctagggtgaaaatggtcttccaggcgaaaatggagctcctggacccatggtaattatgtttcttatgtataattttcagttttattattaacctcattgttacctaaaactggctttgctcccaccccaactgttcttacacatgtcaagattagagtaaaaccatatttcaattttactctgtagggtccaagaggggctcctggtgagcgaggacggccaggacttcctggggctgcagtgagtatagctgctaacatcacacaattacaacccaaagtgacagatttttacagcctcagtaaagtttcaggctgtaaaaatatgttaggaaaaagaccttcctacaaaattatactcaatgatactgtgataaagttttggctatagttaaaaggaaatgaataattgttttacaattattatctctattgagaatttttgtgttaacttttcatatgtcatttgagccattatatctgcattcagtcctgaaaacacagactccaatccttctacatttgattgttgctgtatatatcagaattgtaataattgactttaaaatacataattattaagcagattttaatgtacttgaagaaaactcaactcacttgagtcagaattttggtcaaaatattactcatgaccagccattcagaattaaaaggatatttgatgtaaacttctctttttagggtgctcggggtaatgacggtgctcgaggcagtgatggtcaaccagtaagtaactttctatctcttatgtgttgtagggtaatgagaagttatggattgtggattatttaatattttatatatgtatatactcttaggtatatatatatgcatatgtatatctctaatatacacattagcatctctgttgaccatttttacaatttaaaaagtgaaaaaatattgtagccccaatacttaatattgtatatacactcctgtgattaaaactgacactgagcccataaacaaaatctaggttctgacactcattctgcttgatcaactgctaacatttgaatggtgctcccaatgttagttaatatcctatgtaagacatggcactttaaagagtcctacaaaatggataaaatagatgttacctccattttgtagactggagtacaaaagcccagggaaaagtagcctgcactaagtcacagaattcatggcaaagtagggagaaaccaagaatttctaactttagatttcactcttttcttattttaccacattgtttctctacataatatccataaaatatgaatatcatttttatctgcataaatatcttctttactttatatgtgctcacttatttactagtatgtcagctttcatttagttgaaaaagagctcttgaaattgtatttaattttttcagggccctcctggtcctcctggaactgccggattccctggatcccctggtgctaaggtaaacatgtgtttctatagaagggtataaaaatatcttggaggcaagagaaaagcattagattgcttcttgcaactgatttttttaatcagtcaaatggatagcttttatctatacatgtctttaaagccctattcttgattctaaaagaggtgttgtccctagtattcaactatcttgatatttcttctgctaccttctttttttccccagactctttctaggaaactgataatgcaatcacacacacatagttacatttttctctgcctttacgattaatgattccttgctttacctgcagtatagagtcccactactccaacttttgggagatgtgtttaaacaggactgaagggtgaagtggctaagtgagtagaagtggtaagagaaactgactacacaaggttttaccattagggtgaagttggacctgcagggtctcctggttcaaatggtgcccctggacaaagaggagaacctggacctcagggacacgctggtgctcaaggtcctcctgtaagtatcatagttgagagggagtaagcatagtttcatgcttactccatgaaagcatagtttcatgcttactccatgaaagcatgtgcttcaatatggctatcagtgaaaattactttgaaaaaattgttgcttagtgctctaaaatgatcctcctgtgacacatactgatttgattagtagtaaaaatgatagtttttgactgttgcactattccagaattcatgattttttatgtttatataaaagaatagaggatagactagttttctgatgctttcaagaatgtgccccaagctaatcaccaatcataaaaattcagagaagaaccaaattcaaaatctcttctatttatgtatcatttaataatttatacgaagtacatattatctctaatttatttagataatgatgattcttttgaccacatttcatatgttgtgttatagttggaggattcacttaatctctacaaagcataacactcatcgatacatttattttcacacaaacaacttcaaatatatacgaactatttgcattactattaatacattatctgttttttgtatacttagggccctcctgggattaatggtagtcctggtggtaaaggcgaaatggtaagctgtccccactcctcagccttatctcatccacacattactggcttcttttgcattttgcatgacaatagatttgtgatatttaagtgagatattcataaaagaacattcaagttcggctaatatagtgtctttggtttgttcttagggtcccgctggcattcctggagctcctggactgatgggagcccggggtcctccaggaccagccggtgctaatggtgctcctggactgcgaggtggtgcagtaagttgccttgttttttctctgttgactgaaaggtatagtttaattccatcaacaaaaaattaatagcaaaattttgctcctgttcagttgaatttatattgacttcactcttgtcttataacttataactgaattatgtgttactggtgatgatttgttagtcgaatcctccctgtgtttcaaccaagactttgttatactttagggtgagcctggtaagaatggtgccaaaggagagcccggaccacgtggtgaacgcgtaagttttactgcaacagatctggttatttcttgaaaaaatgcaacataattagaaagtaaacaggtaaaaactttgaactaaattcagtcataatttctttattttaccatcttttttttttttcagggtgaggctggtattccaggtgttccaggagctaaaggcgaagatggcaaggatggatcacctggagaacctggtgcaaatgggcttccaggagctgcaggagaaagggtacgttttccatggggcatctaaaagaaaagcagcatcactgtcatctaaataaaactaccttcagggtgagacagccaatttttcttaagttgagtgttcagtgaaaatattgtttaaagcattctatgacataaaaatatttgccactcaagaattatgaaaaagaattgaaatcctttggactgaaatacttgtctttcattattttcagggtgcccctgggttccgaggacctgctggaccaaatggcatcccaggagaaaaggtagataactttagtttctatgttcctaaatgctagcaccacaaatgggcagttcttgtatacaatttctcattcatgaaaacctaaatatctgaagaatatatattagagttaagaaaaattcctaatataatgcatcctctgttcaacaactttcctggctttgtaactaaagccacttacttaccctctatgagaatcctttacttatctgttaattggaaagcatttatctgagcatcgttgcaagagtacagtaaactaaaatgcctgaaaagtctttgaaaactctaaggttacatcaaatatgatttcatagcattaagatatttgattttagctgcacataattatatttttaagcacagtgaatactgttttattaagcatgtgatgttcacaaagttgctttaaaattttttcaatatggcaatccaagctaagataactgattttatgtataaatgtttcagcaacacacgaaccctttttaaaagttcaaatgacgtcctctctttgtaaccaaaatattgttgctatctaggttagtgaaggctattttaatttttttaaaatttctttcactacttagggtcctgctggagagcgtggtgctccaggccctgcagggcccagaggagctgctggagaacctggcagagatggcgtccctggaggtccaggaatgagggtacagagaaacatttgtttgaatgacactttaatttagacagaagaaaggcaagacaaatgaagacagatcaaaagcaacttaaatcaatcagattacatattttgtaaggcaccaaacaaaacaaaattcttttaagtaaacttaagccgagatagttcaaggagaagagaagatagaacacttgccttagatactttatagacaggaaaaaagatgtgcaaatctgaggcttcacatgtaagtgaaaatatcaaaatcatacaaatagtgtatgtagtaattttttattatttcattttaaatcacctaacaactgacttctttacttcagggcatgcccggaagtccaggaggaccaggaagtgatgggaaaccagggcctcccgtatgtacatttttaaaatctcattttaaaaggccagttaaaatggaatgtatatgttggcctatccttgagtgtgtgtgtgtgtgtgtgtgtatatatatatatgtatatgtatatctatatatatacacacacacacacacacacacatactatatatatagcatgctttaatcttctctttatcaaacctttattaatgtaattttttcttattagggaagtcaaggagaaagtggtcgaccaggtcctcctgggccatctggtccccgaggtcagcctggtgtcatgggcttccccggtcctaaaggaaatgatgtgagttccttcattaatttcttcaataaatatttgactggaaggcttttattttccatatggagtaaagaaatggtcaaaactcagtctcctcttcaaagcatggaggagtatatgaaaatcaaattgcatgtaggaagggagctaaatatataattggttatggttgtatgtgtgtgtatggagcaggcagataaaaaatatgaaacaggctgggtgcgctggctcacgcctgtaatcccagcactctgggaggccaaggcaggcagatcacctgaggtcaggagttctaggccagccttgccaacatggtgaaaccctgtctccactaaaaatacaaaaattagccaggcatggtggcatgtgcctgtaatcctagctacccaggaggctgaggcaagagaatcactagaacccggggggcagaggctacagtgagccaagattgcgccactgcactccagcctgggcgacagagcaagactcagtctcaaaaatatgtatgtgtgtgtgtgtatatatatatatgagacatatatatatgagacatatatatatgagacatatatatatgagacatatatatatgagacatatatatatgagacaataatatgattagttattgccctttgaggattagtaaataccgaccacttcttctttagggtgctcctggtaagaatggagaacgaggtggccctggaggacctggccctcaggtacgtagctttcctcaatttatttctagccttctaatagatgcgttcatctccaaccttctgacttctctctgtaatctgtattatttctacttccctaactgttcttgtttttagggtcctcctggaaagaatggtgaaactggacctcagggacccccagggcctactgtaagttcactcatataaaattggagatgaaaatagggtggaggtggggcaggaagaatgcttcaaaaattacataatctctgacaccatgttgttacagtttaccaaagcaatgatgaaacttgctgacctagttatctagctaaatgctagcattgagtttagagtgtacatgtgtgctttgggtccaggtcctcccttttcttcacatcactacttttataattaagcaacaggcctgttgaaatggatactgtagactaaatataaaaggatgtttacaacagagtgtatcattatacttttctaggggcctggtggtgacaaaggagacacaggaccccctggtccacaaggattacaagtaagaacttgttatttaaatgtcacggcatatctgactgtcaaatttttttgtgtccctaatagattataatttatctgaagcttaacttgtgattctgtctttcatctggaaataaaattttaggcaatgttaataggtaggcatatcttccatgtccgttccagagcacattaataagttatttaaaagaattaatgaaactcaaataattctatttggttacacttatttttattataacataaatccatatagccaagtctatcctgccatgctggtcaatacatttttacgtgtagcaattgaaagaacagagagagatgaaaatgggtttgtaaaatatgattatcacgtatgtgtcactggattttgagtggcacaacgtttctacccctacaagaccactggaacttttttttaatatcttgcagaaacatgtgtacatatgagaagcttttctataagccatgtttgaggtaattacctaatacaaatatgattctttctagggcttgcctggtacaggtggtcctccaggagaaaatggaaaacctggggaaccagtaagttacgtttcattattcaaaactcagaaacaaaaagaatacacactgtttgtttgtcaactattaacttcttaattttcttatgccatgatatttgagatttaacatttagttttgaaatattatcaaaacaaagacaaattatttaaaagataactattatatagagtttgaattttaccataaaatagagagttcatagtttcaagatttgaaaaattatacagtatgccaacatgacaaatgtgtattttgcttatatttacatatttgcttatatttacatatttgcttatatttacataaaatgcactctgatatgggcctaatcatataatgccaatctcccagggtccaaagggtgatgccggtgcacctggagctccaggaggcaaggtagtatttcaatttattctctaccttcttcagcaggttatagagcaattgattagtagtatatttttagtatatcaagccaaaatactctttctttaaaagagcatcattgcaaatgtttggtaagtacacttagagaaactcaagacactttcaatacattaaatttgctttaatctggaaggtccaattctctgacattcataatcactacagaatcaaatacgggcttaaaatttcaaacggaaaaatattgccaatatgttgattctatgtaggaaaactgttttggtaaaaagaactttaaaatgttgctcttgtgaataaaataataagtatttcaatgacagctcacacttaaccagactaagtatccaagttttattttagacactcttttaagcttctagttcccacccagctgttcaactatttttaagtatacaaatttctagattgttcacaatataataacctagtggcctgattcaaaatgatgcaagttaaggtgctttgtttttagctttgggttgtctaatatggttatttacatatttttgtcacagggtgatgctggtgcccctggtgaacgtggacctcctggattggcaggggccccaggacttagaggtggagctggtccccctggtcccgaaggaggaaaggtaactccacagcattccattcacctaggtttaaaaaatgcatttgatttccttctgatcatttattatttctcacttattttcagggtgctgctggtcctcctgggccacctggtgctgctggtactcctggtctgcaaggaatgcctggagaaagaggaggtcttggaagtcctggtccaaagggtgacaaggtgttgacttgttttctcttaattgttcaataaatcagtcattgtaggttttaaaaaaagcaacactcctggaaagtaatcgactgtattttcaaaattaatgttatcattttatagtaagtgaaatttaagatggattcctaaagcaacaatgaattagaacacccaatatatatccctacaaatcctgagagttactcctcttcttggctgattttcactgaagatactttgaatctgatgacattggcttttatttgacagggtgaaccaggcggtccaggtgctgatggtgtcccagggaaagatggcccaagggtgagtattcccagtgaggagaagcaggccttatctatatgtcatatgggacagtcctgcacttcaactttaattttttccaaaaactactcaagagaaattagatattttaccacctaaagacccgaatgacttgatttataatgaaatttgtggtctatatctatggctacttgatagatctacagtgactaaagaatgaaaaagcctcaagagtacgataaaggtcacaaactagcatttgtgagtcactaaaatctgagataatcactgaaatttaggataatcaatgctgctcattaagaaactaaaagtcatcaaaattcaatatagtaagtactcctcattaatagacttaatatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatggtgattgcacatttgagtatcttgattgaggtggtagtcaggcacatctacacatgggataaaattctatagagctacatatacacacacataaatgagtgtgtgtatcactggtgaaatctgaacatgctctatggatggtatcaatgtcaatttcctagttttgatattatattatagttgtgtaagatgttaacattaggggacgctgggagaaaagtgcacagaatttccctgtatattcctttgcagcatcctatgaatctataattcaaactaaaagtcaaaaacaaaacaaaaaacatctcctaaatatgattataattaagtcttttaataaatttatataatagttgccttaaagaaattcataaatgcttcgcttttgacagactaagtagataagccgtcattcaggtaaaaagagtgctcaatacttcagttttgtaatataagtaaaactactatttgaaaatttcaagttgaaaaatttaatatgtacaatgagactttgagaaaacatttaaattatcaagcaattgaataaagaaatgtactttaatttaaaaagacattactgtaagatcttacatgacatcctatttatcttctacaatggagataaagataaatgaatcaataaactattgctgaatcctattttctcccagagttatccccaaagaggcttgtgtttactgagctctgcagtatttacacattgagagaaaagcatagcattcaagccataaaaatttttaaaaagtatgttatctagtttattaggtatctatgtctatatactttctgtttgattaatgcaaaaaacgatatttgtatcttcaaaattaaaaaatatttttatttcctctagggtcctactggtcctattggtcctcctggcccagctggccagcctggagataaggtaacccttaatactacctggatataaaaagaaaatgtctctctcttttggatgcaagacagtgacatggcttctctttttccagggtgaaggtggtgcccccggacttccaggtatagctggacctcgtggtagccctgtaagtgttaaagacattctcaacatactttttaaccccatacagacagtagctacttatgcttccctttttggcagttttgccctcagttccctgagcctcaatttggagatattatcttcaaaaaccatataaggaaccatatagcatgcaagggaatgttaaatttcttaaatctaacattcacaggagaccattttaaatcaggatttctttcctaaataactttggaaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcttgcaaataatatcacagtaggaggcagaaggaatcaatggttctggtattttccactcctaattttattgagaagtggcaaagtcttcagaagtttattggctactctgcacatttcctgcttaaaggaaagaaaagataagatgataagatgacatttcctgcctaaaggagatgacgcacacttcactgtgactaaggaggatatttttctcttcagggtgagagaggtgaaactggccctccaggacctgctggtttccctggtgctcctgtaagtgtgaatatttatacatacatgtcccatagcccaggatctctatcttgctgaaaaattacaaaagtatagtcaagtttggtttctagtctcattttagctgctcattccctataggattattgtacccctattttgttttactttacccctattgtcgctctttgaaagatggaaataaaaacacctgtcctgcttttatgactgggtaatgaactaaagcagtatcatggatttaaaagcactctgaatttttgtaaattcttccattataagatggtactaattaaaattttctcttaaatccggtctttctcaaaaaaatttactggtgctgattttcaaatgtttaatccttagagacacttcctccctccctaatggcaaataatgcacagtttatgctttcttggtcatgttctttgatcatgaaaatattttgattggcttcattttgtcatgtcttcagaaagccttgtttttaaattttatttcaactccttccatctgaagaattctatattctgaagagaaataataataagccaattgtatcataaagagtgtcagctgagagattgctgttgttgttgcatgtagggacagaatggtgaacctggtggtaaaggagaaagaggggctccgggtgagaaaggtgaaggaggccctcctggagttgcaggaccccctggaggttctggacctgctgtaagttccttcctctttctctgtctatctatctatcatctatctatctattgattatctgtctatctctccctctctctctccctctcccccctctgtaagtcctaagtgttctaatggaaaaacatggaggtttatcagtaatttaatattttatactgagatagcatgtcatagtgtcaagaatataatctttatatgaatatagtccaagtatgaatctcagcaccagcaatctaaaagttattttaacctcttcatagagttcctggttttcaaaggcttaatgcttttcccaaattttgattttggtgctattcttacataatttccttccatttcatatagggtcctcctggtccccaaggtgtcaaaggtgaacgtggcagtcctggtggacctgtaagtattgatcctcttaactattattgaaaagcattaattgatatcaacctgtataaaagctgcatttgagacactagttccataaagagaatgtaaaaattgtaatcgctcattcatacatgagttatatgtaaattccaaggggaaacacaaaccataaatgactttcaggtacaatgcagatcatgccacacattatactttttgtttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagtaaaaaaagaaagaaaaaatgcactttttattataaatattcaaatttcaaacaattatttgtagggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccagtaagtaacttcatttttttaaattgattctactattttgatttttatcacaaatcgattagagaaaaacactgtcacataaagatgagctaagtcttcattatctgtattagggagctccaggcccacttgggattgctgggatcactggagcacggggtcttgcaggaccaccaggcatgccaggtcctaggggaagccctggccctcagggtgtcaaggtgagtatagtcattttccactacactcttccttcctttggtagccttcagagatcacttaaccatatcaaggatgaaaagtttttctgtcactggagtaaattagccaggagataatttttttttatttttagatttttaaaagcataaattttaataaatggctccagaacacaaaacagggcatatcatagacaaaccttgaatataaacacaaataaattaatatgatgaaaacaatattgccatctcaaacacctcttttaggaaacttgtgaatattcttcaatttgttgactgtcagttttgaagggggaaatagtgttagcttatagatcttggaaagtctttcattaatgctagttatccatccattcaagtcatcttgcactcctgactctctttcactagtattatattcctataacattctagtgcttagcatctaaaacattcgtttggtaaacaggataataaaattgcatttttattagggctcgtattatggcactttaagtacttctttcaacaaaatgttatgtaatattgtcataaaattaatatttcatatttaagtgtgttcaattgatatgatatttctggtaagtgtatattcttcagatagagacaaataacctaattttaaggatcaccatacacctctagtttcatgatggctcattattgtttttccctatactaatcatgtttatgtattcatctcagattacaatgtacagtattctgaattagataatcaatgtaactattcagccctttgccatccagagtcactgagcaagttagaaaatgcaagaagcttgctcccccatattttttcccatagcaggcatagttttaattttaaaattcaatgaagattaaataaaataagttttttacctgaaaataaagatatctgataacaccattttaattgatttcttaagttgaaacaaaatgtttttcattcctttgtatacagggtgaaagtgggaaaccaggagctaacggtctcagtggagaacgtggtccccctggaccccagggtcttcctggtctggctggtacagctggtgaacctggaagagatgtgagtagcagtttttattcaaccagccaggtagaatttgataatttatttcagcaaaggtgaaattgagctttaatgtctaagagtgtaaatatggccacatagcaaagttcttctatctctaataacagaaattctttcattacaatttaggatagacttaaaagctcttgttcattagtatttacccaatgaataatcatttgtggagaaaatattatctctaactaaattaggaaaaaagttagtggggagaaccacaattgacatgttttctgagtgaaaatattctacggttatctatggttagtcttttattatttttaaagaatttaaaattaatattatttataattaacaaatcataattgtatacatttataaggtacaatgtgatgttttaatatatgtatacaatgtggaatgattaaagcaaactaattaaactgtagatttccactaacagtttagatcactatttcttaaacttttatttattagaggtctgtaaagactctttttggatatcatttttctaatcacctctcctccatgaatacactaactatctgtctggacattgtgaccctttgaagggccacactgctttgtaatatctaagatttcttacccccaagaaccaattttaacccccttgagaattatattgccctgctgagaatgcatggatgaaatggcatttggaaggtttcaagaaattttatttcctttctcattttttaatcagggaaaccctggatcagatggtcttccaggccgagatggatctcctggtggcaaggtataataaacacatgtgcaattgatttgtgttatcaaaataagtgatcatcatgtttattttgtacctatgaatttgttcacagggtgatcgtggtgaaaatggctctcctggtgcccctggcgctcctggtcatccaggcccacctggtcctgtcggtccagctggaaagagtggtgacagaggagaaagtgtgagttcccaaaagcagcatctgtcttgtttgtctatttccttcaataaagacatttgtaggtagaaggtagaatgtcagatctgccaaccaaaatatccactgtcatttgttttacagttttaatgctagttgttccttagacaaatgtgtgaataagtcaataccagaagtacttggcagtagtcaataaagaattcattactgaaacccgaaatcatattaatcagaccaactatctatatgctgggtaaatgcaaggccaagttaacagggctcttgcccaacttttctgtctagatcccctgagaaagctataaacagggctttagcactttgaaggcaaaaacaatattaacttccaataattgcatgcatactataattctattataatgaaattatttacttttgaaaacgaaattgtgtcaacacataaaactagttccgtgtatgtcttctcaattgaatgttttcatcttagggccctgctggccctgctggtgctcccggtcctgctggttcccgaggtgctcctgtaagttttgtcattttttggttttattttgttttgttctttttttaactcattctacagtgtaggaaatattttattttccagcgtgttcaggaaaaaagaatgaatatatatatatatatatatatatatatatatatatatatatatttgttctatctatagatagatgatagatagatagatagatagatagatagatagatagatagatagatagaacaaatataaactttcctttaatgacaatgatatggaaagcagttcaggatctaaaagttctttggagccaaggatagaaacatcagttgttagggatccatgcaatgatcagtccaaaatgaaaacaaccacagaaacaaatctcatttcctatctgaagtgtctgttgatgggggattttttagctgatagaaagccataaaatagatttaattattataaattctattttatttttccaatatgtatgtgtgtatatgacttcaattcaaaatatgtttctaaagggtcctcaaggcccacgtggtgacaaaggtgaaacaggtgaacgtggagctgctggcatcaaaggacatcgaggattccctggtaatccaggtgccccaggttctccagtaagtgcattcattttgttggaaaatcccttcaatgtatacaaattttagagattaagagaagaaagctttccatctctaaaaatatgtactagaagagatgagaaatggatttgaaggctaatttgaaacaacaatcagcatgacacaatgggaagattaaagaaagaaaaaaaatttcatcatgatccccatgtttcttgatctgatcttgaatgtacagtttcccagtgctttttaaggccttcactcctatgtacacttcctttctttccagggccctgctggtcagcagggtgcaatcggcagtccaggacctgcaggccccagagtaagtagcacagaaagatattacaggtccacatgtttcagatgtctgcatttcagaaagatattctggcattgtgatgtcatgatactttcttagggacctgttggacccagtggacctcctggcaaagatggaaccagtggacatccaggtcccattggaccaccagggcctcgaggtaacagaggtgaaagaggatctgaggtaagacatcacttatacgtatgtgtatttaatttgctacaatcttccaattttcagaaacacagcgcattatgtttaaattgaaatagagagacgcaatgcatccactcaatttagaaactgaacaatgactttaagacattctccatcacattaaaaatgtttctaccacactataacaggagaaaaatacctttttaaaaatttgatcaggtatccatcgtatcagaataatgacatctgcccaattaaccaaataaaccctgtccacattgctatcccactagagatctcagaattacaacattcataattatctgcgtttatgtagtgcattttacttctcaaacagcttccatggttactattttgttaatgatactatcattcctaatactttctattccatgcctttgggtaaatgaaataaaaacaattatcccaacaaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctcaatgatccatgttttactcattctagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggtatgtttggtagtctttcatcttcatggcaataggattacagagaaagctgcttagattagaatgggaacgaaaaaacatctactttcaatggaaagctgaaatagtactttaagaaagttaactgaattgaaactgcttgatataaaagagtaaactttgcagatgtaaaatataacataacttcagatcatgccaaatacagaaaaatataaagacatttttgtagaagttgtagtataaattgtaagttatttgagtataaagtaacatatctttttttctcaggattaaatatacataatttgatgcagacaattataatctgattattgtaatatttacttattgcaatgaatctaattattaaaattttcaaattaaacaagtgaaaaatttcagaatactgtataaaattaaatagaatattgtaatagtttaaggttttgcatatattgggttaaatatttctgaaaagcaaaattatttcaagttttcaaatatcttgacatggaacactgcctttgctaggagtcatttctagaaattacttaaaataggagacaagcatcaatcatagggatttcagctttagaactattggaacaaatctaggttagacaaccagcttatattattaagcaagattacatataataatcatctttttttaaaggagagacttttgcaaatattatacagcaatcaaaaggtcttagcttagtgtatcatccttattagaaaccaagatgttgcattttatttcagtgctttctgtagtcatagctaactcttttacctcagcaatttcaatcaaaaagcttctctatcattctatacataaaatgcagacacattagcagtcaacattatgaatgcctttacaggtaaacaaacaaaatcactttattactggattttataaccaattcccattcttttttgtgactattcaggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattctcctgttttttgtcacttttcaaagatttaaaaaatgcacgtctacattaaggaactccagtaatcttgaaaaagtatattgaattctaactctatagattaataatgcaataatttttaagaatataaaataatataacatatattcagagtagagataatgctcaatgaggaatcctgcagatttttagatcatatttgcaggaacccctgtgggacatactggacactgagggcattctgtttgaaagggtcaatccttggaaatggtaacacagtaaatcaaggtattcccaaactgggaataataagggaggaagatgttgatagtttatcagaaagtaattgtaatacgggtctattgaaatatattaatattaagaaaaattgacaagtaccacatgatctcacttctatgtggaatctaaaagagttgaattcattgatgaagaatagaatggtggtttccaagggcagaaggtggggtggggttgggagattttagtctatggatacaaaattgcagtaagatagaagttataagctcaagagatctattgtgaaacgtggtgaccacagtcaataacaatgtattatatt

SEQ ID NO: 2 - DNA, 38092 bp, Homo sapiens
caaattttttaacttttattttaggttcaagagtacatgtgcaggtttgttaaattttgtgtcacagggattcgttgtacagattatttcatcacccagctacaaagcctactccccaatagttatttttctgctcctctccctccccgacgctccacccctcaagtgggccccagtgcctgttttttccctatttgtttccatgagttctcatcatttagctcccactaatgtggtatttgggaaaatccaacttttgaaagatctttagtctgctaatcatgaatggccaacataattacaggcatgccaacatttgtaacattgtgacactttccctgccattcttagttaaaactgatcttttgttccaaaaatttttgctaccaacaatagcctgtcctttatagttcttttatacttttgtgtcttctctctaactaaataatcaactctttcagcattccatccatttccctttctcctccctcttactcccaacccacattcccctctccattttaattttaacctgtgccccttcaagtgtactccagctttttttttaaaataatttcaagtgatactttgacttttgactgcatatggaagcataagtaacatgtcctttcatttttggataatgagtttcctgattaattacagctcaagagtaaaatgactgattactatttaattcattttgtgcttctttacaataaagtaaagacagaagccccagattcaggaacagacaaaatactttaatcgctatcacattttttttaagtctagtcaattagaaaagtcaaatctttcctcacagccaagcacattaaaaaaaaatcttctctggtaataaacttgaagctttaaataattctacaattataaacattttgtgtattttgcaaatatggcataacctgttggcataaaattccattgttccagaaaatatcggtaataaaattatagaaaagttaaagatcttcatttcttatttcgaagcgtttgggagacatttcagaaacggatgggaaatgttaaattctgcatgcctgcttaagtttccatccacaccgactagatgtaaacgagtgtcaccaaaagtacaccacaggcacccacacagattccttccataagggatccacaaagtttagatgtgaaatgtacctaaaggttcctagccgtctttcatccctccctctgtgaaacagggagacacatgtgttttaaggcagagatggaacttgggcgatgggcggggggtgggggaggtgggaagggacggcttaggacagggcaggattgtggattgtttctgccgccttggttgcccatactgggcatctctgcaggcgcgtcggctccctccacccctgctgagatgatgcactgcgaaaacattcgctctccccgggacgcctctcggtggttcagagcagggaaaatgttgcctcaggtttaaaataatctgcccaagcaccccagcgcgggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctagggagcccctgagctaggaggacacggaaaaggggattggggtcctgagattgggtctgttgggcccaggacgcgttttctggatgggtctaggatgctcccttgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcaggtgagactgagttctaggacatttagggggtctggtgcctggctccgccaaaaatggggactttcgggattgtgatcatcacggcggattgagcagggagagccgtggagggacaagagagggccgaggcagggtggggggcgcgggcaggtgcgagggggatgcggccaagaagcagcgataaagggaacattccacgggtcgggcggctgctgttggatcttagataaagctggaagggattaccggggcaggggtaatagggaccggggacgggaacgcgaaacaggtgaagcgctcagggcgagagcgactcggcttagggagtccgggagaagcctgcggctgccccctcgccgccgaggtcctgcgggtcctgcgggtcctgcgtgctgagccggggcgtgcgcgggcgggggccttcggaccgcgcggcggggcctgccctgacccctggcggcgggcgggggaggcaggcgcgccctgcagagtacagaggggtgtggtgtcctctgcgagatcctcttaaaaagctggctacgcgcaggcggtttctgtgcacggagccgtagctgtcggagcggttagttcgatttcgagctcgaggtttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaaggtaagccaaggcgaccaacagggaagggctgggacagctctcctctggcagttagcccgtgcatccttctttagcattgccgtgtacgcacaccccaccccgccccctacacgcgcacacacacacacacacagagttttgtgggtttgatgtgtgggagctcccgcagtcggcagaaacgttacatctcccttcccccatctccccccaatagttagttcagctgaaattcagctaaagtgagttttgtagaagttcctataactacacttttatcctagcaaatgagcctattgacctcagcaacagacggcccatactccttgggacggtgagatggttcctatccattcccaggttgaaagtctagtgacaggtccccactgcacgtggcattaagacagtcagataattgtgtcaggtcttgtgctgaggatgagtcagaatacaagatgggcatgttcccccaactaaaacgatgggaagtgattttcttaaaaatactacagtggatggaaatgcctaggactaaagacaaagaaaatacgtacttattcatatacatatgaaagttactttaactagactaacaagtcacttgtgcacaactaagcaaatttacaaaaccaaaaacaatgtatgcctcttggtttcttctatctatggacacctgcacttagatgtggaaagctgcttctttagtagctacctgggtcagcctgccctgagctaatggcacattcaggttggagttccttttcatactttcaggatgtgcttggtgagattaaaaataattggactgggttattggccagacttagatctgactcagtggtcagttttaaattatcattgttattagattttgacccttttagccaatctagtgggaggaatttattgcctaaacacatctggattgggatatcatgggctagagccatccttggcaaagggttttctctgagaaatggagggctaaggaaaaatcctggctcagggactgcagtgtgaagatctactcctatacaacccccagcaatcaatgaggcggatgagcaatttccacccaccacgcctgctatctatggatgggaggagctatagttcacaaaccgtttacattcatgaataatatatttcaaaaggggaaacagtttaatctgtaactggaagggaaaaaaaaactgtcagaattgactcccttggcttcctggagtaggaaaaaggaaaattggagcatttgcagctttttttgactagctggattatggaatatttaaaagcaacagcaacaaaagtaccttataaactagaaaatagaattgctaaaaaactatttactaaaaacattaccttaaagggagaggatatttgtgttttcccccacccccacccttctcatgtggctttgaacaagaaggagagttgccaggaaaagaggcagatttcagagagggctggcttcactggatcctccctgttgttccactgcactgtgagtgagattccctggagcaagcgaatctcccgggatgagtcagagaggccaacagtgtggatgtgggtctccacacatagcatgactaagttgagaaagaaaggccccactgggaaaagagacttcaacacagatggaaaaaaaacataacaggcttggaggaaatagcagtttacaaaacagcatttcaaagagcaagtgtggggatcctcaaattaaagaaattaaaagaaaaagctagagcaagctcctgctagcctaaagaaaccaaaccctgactacttgctcatagaactgtgagcaaaacaagacagtcaaaccaaaaaatccacctagaaaagaatttggcagtctcactcagatgcctggcctagaggggacttcagagaatgccctacagagagacaccaagactacaaatgcaaattctgcccaaagagtgcctggccgatgaacagggtcctatctacatcttatggagactcctattttataaatatgtatcctcaagtccaagcacaaacaaaataacagaaacagggatgattctctcccagtttccatgacagtaaataataaatttccctaaattttactttcaacaacatagactttttttatttttatttttatttatttatttatttattttttgagacggagtctcactctgtcacccaggctggagtgcagtggcatgatctgggatcactgcaacctccacctcccaggttcaagcaattcttctgtctcagcctcctgagtagctgggactacaagtgcacgccaccatgccgggttaatatttgtatttttagtggagacggggtttcaccatgttggccaggctggtcttgaactcctgacctcaagtgatccactggtcttggcctcccaaagtgttgggattacagatgtgagccactacacctggccaacaacacagacttcttaaaaaaatcatgacaataattttgggtgcttcttaaaagcacccaaagctttactgctaatgcatggtagcttaaaacttcacataataagaaagaaccagtggccaatggaatctactgttaaaggtacccaatcaagtaaggaaaagttggtcctaaaagcaagcagccctgtaaaagctgctctgtccaatatggtaatcactagccatttgtgtttccatttaaatttcaagtaattaatatcaagtaaaatttaaaattcagttccttagtcacactagccacgttgtgagtgtgcaacaggtaaagctagtggcacagacatagaacatttccatcagcacagaaatctctattggacagtgccagattagggtgttctctgcattgtaaaagcatccccttgccaagttaaagaaaacaacaacaaaactctagagaagaaatgaaaccccagtttcatttctggagaggaaagaaaactcatgtgtggcatgagtttatattcaagaaggtgcagcattattacctattttactagtaataatgacacacattatagtatacaatccagttccaataaaattaatttctcatcttactaaaagcttgctgctccacattatgagacaatttacccaaatatagacatttacccaaaaatattaagtagcttgtgaatactttttaaaatttcctttaattaaagtggtcacaaactcaaacccttcattctccctctgagatttctgtgtcatcttttgttcacattgttattcacatgtttattatgtacttattttgattttctagataaataaaatggcttcaaatctataattctgataaaattagccatcaattaatttatttattaaacccatgcaatatgctagattagatgctttgctatgtaattcctacaataaatcctagcaatcacaaagattacagttagtgagacgacatgcacacaggtaaaaagtgtttttaaaaaatacatacatacaaccaaaacagtaagtcactgctacatggaaactgattggtcctttttcctttttttttttttgccttgactgccaggaagcagtttcaaatctatagctggattttaagtttcattaattcatgttcccacatatggttctgtattttcacttcccccttttaactgacatactgtcttatgtgatctctactgtaagccttctcatcattttggaaacagaccaaatataatatatatgataaggaatcaaaagtaaatacagtagtgttgaatattgcataacaaaaaggtttttaaatagggaatggtatcaatatgaagtgttagggagacccagccatgaaaaggatagcagggtcagagaaggaggatgtattgcagctggtttaatggagaatggtatgaaggaggtgcagtttgaattgggtcatggaggacagatggattgcaaatagctggggcaaaagcacaggaaggcattctaaacgagccaggcatggagacaagaatgtctcccacaagggagttgtagtagctcaatcagactgggatttgagatttcatgtggcagagtggtaggtgataaaggtgaaaagactgatcatagtaaaatgcggagtctgtaaatccagcactcatgataagtttggacatcatgtcaacagtggacagccataaatgactgcaagcatcggtgtggtataatgaaggtgacgtttttgtaaaatgactctggtgaaggtacagaaggtaatgaaaagtagccagtctagttgagcagaaaagagttcagatgtaattgcatcatggtccagatgtgaaatgaagacaatgcgaagtggcattgtggatcgaaacatacatgcacaaaatgacagaattttagaatttgaagggatcatcatggttaccaggctggcctccaattcctcttttgtaatattaatagaaattaagggctaacaagtttaaaatgttatccatctttttacatagttactgcccaaagtgaatattttgaaatgtatcattaaagaagaatagataagattatgtgattcaccatggactattgtcatgagaggaaaaatgtgtttagatgattctgttagcactgagacaaatcaggatatctgaaaggaggtctttgttgaaaaacagaaatatgcattcataacttgcttttctaaaattggaatgtaatgattcttaaatatgcacagacacaaatttttctttaacagtcaagaaaatgcacgcaggtgataatcagatcagttttggttatagtacaaaggtttaatgcctccgtgatccctttcaacttgaaagcattctagagcaattggtgattaatatcagtataacagtcatttataaaattattatttatttgatatacatctaatcaaagcataagatttatttttattattattattatactttaagttttagggtacatgtgcacaatgtgcaggttagttacatatgtatacatgtgccatgctggtgcgctgcacccactaactcgttgtctagcattaggtttaaaagatcagattgtctcggcaccatgttaatatctttttctgttggcattagtattagttttgcttgtgtatttgtttaggagatagcttcacaagttggtgattgatattctaccatgtatgaagtcatgcgtggaattcagaatccccagcttgtaaaattgcattatgatcatctttagtgggaaattgttctcagaatactgagcaaaggatgataccaaaatggcagctattattcattcttaagcatatgaaatgctttcaggttcaacccaaaattacatacattttaaatgcttactaaaagagtcttttccctcctccatctattaactgcaatcaaaaaacttcggttttaactgaacatgatttcatattatttattaaaatttaaggcaaggtgcaccaagtacccttgaattatgaaaagcttcatgatgtgggatattctttcagttaacggcagggttggctacacttttaaggggttcaaagtaggaacagctgcaatagtgagctgcatctggaaagtccagtaatttgaaaaaccacctgtttatgtatcctgcccactcaagtccataaaataacagacactttcatattccaaatgaaactgctttttagtttgccctacttttaaacataactctttgtgatggaatgaccagaaacagctggtctctaagaggacagggctatgtgcgctcacctgcggggttggaccttccataatccccctggctgtggggaaagttgagggctgctgtctttatacaaagatggtttattccaagatacacacactcttcttccacaccctggagaccttgcatatttagtatcttctttaccataatctgaggccctagagaaaaagatttgcaaactatacttgttttaaaacaactttctaaaaaagacactctcagcccctagaaattatgcctaacacatagatgctcagaggcaacctgttgtagtgcaagaggattgtgccaagattagaaaacaaatatttgcaacttttgtaactgtcttctctaaaacttgaatgtggtgattctaaagtaaagaccgacacaaaattctttttctttagcagtcaggaaaaggcatgcatgaagtaatcagatcaggtgtggtttcagcataatggcctaatgctttcatgatctctttcaactggaaagcgttctagtcccactggacaccaaggaggaagaagggacggaaaatattaggcccataggtttatcttcctcagtagtccacgagatttgagcttatatgtagggagcaaaattgtttgtctaaaagcagttaataaatgccccaaaaaggctgggcgcagtgactcactcctgtaatcccagcactttgggagctcaagattggtggatcatgaggttaggagagcaagatcatcctggccaacacggtgaaaccccatctctatgaaaaatacaaaaattagctgggtgtggtagcgcgtgtttaatcccagctactggggaagctgaggcaggagaatggcttgaacccaggaggccaagattgcagtgagccaagattgcgccactgcactccagcctggtgacacagcgagactccgtctcaaaaaataaaataaataaaataaaataaaataaaataaaataaaataaaataaaataaaataaaataaaataaaaataaaatgaacgccccaaaaatattttgggcaaactattttgtgtttcttttctttatttatttatttcttttgagacaaaatcttgctctgttgccccggctggagtgcaatggcacaatcttggctcactgtatcctcaacctcctgggctcaagcaactcctgagtaactgggaccacagggatgtgccacaattcccggctaattgttttagccaggatataaatgctgcctacatagagtttgtagctatctccttgactttctttatgcagattccttcacaaacttttgatggattcctttaccaaattctactgtctgttaaaatcttctatctttatatctttagtccaaacaacacgtcatttataaaccttaaaattgtttctgggcaaataaacaaggcaaaataggaatatatatttttaggcaatttacttctgttttggtctcataaaaaattgtaattaaattgtagaaaatatttcaattcctctttaatatcctctcctcacatactggctctcaacttctaatcctcctattgaaacattgattgggaggccaaggcaggcggatcaactgaggtcaggagtttgagaccagcctggccaacatggtgaaaccctgtctctactaaaaatacaaaagattagctgggcatggtggcatgcacctgtagtcccagctactttggtggctgaggcacgagaatcgctttaacccgggaggcagaagttacagtgtgccaagatcaagccactgaactccagcctgggcgacagagtgagactccatcacaaaaaaataaaaataaaaattgaaatttgcagcctttttaaaaccccatagcctctttataaacccaaaagcactatcaaatttggcgaggtgtcaaaagaatcagaggaatgtttacaaatacagatgcctgggcccacctcagatatatatatatatatatatatatatatatatattttttttttttttttttttttgagacgatgtcttgctctgtcacccaggctggagtgcagtggcatgatctcagctcactgcaagctccgtctcccgggttcacgccattctcctgcctcagcctcccaagtagctgggactacaggcgcccgccaccacggctggctaattttttctattttttagtagagacagggtgtcaccgtgttagccaggatggtctcaatctcctgaccttgtgatccgctcgcctcggcctctcaaagtgctgggattacaggcgtgagccactgcacccggcccagatatattaaattagaatatctagaggtggagcctgagtatctgtatttttcagagtttcaaatgatcgttcttcaaatgattacactgtgaagtcagatttagaaatgactgtacccaaggttggctaaaagatacacaccctggttgattctacctgaagagagcaaataagatacacagcaaagttgtagatgttttccctgccagtagaatacttgcgggttaggccatttaaaaccctgccagagagttttgaaacactgtggagggctcccaaatcaacttgctcaatggttctccatcccttcaggctacttgggcttaaagccaactgcaagcttagagcctcagagtgacctaggaatggggtgaccatatattctaggttgtctcatacagactagccagcactactcagccgcaagtaatagcatccaggcatgctcagaagtgtcccatttggaggaaaaaaacaatattgtcacaaatgaattggcaatggcctgtctctgattcttatacctggaatatactggaagtccctactcatgctattttctagcagaataggcaaaatttctacattccaggcatgtcaggcctttccctgattcctttctctaatgtcactcgtctgctgtcttttatcacagccattaaactgcaccctaacttaaagaggatcccttatgttccaatctactcatccctcagatctttctttctctgaaacacagggttaatgagactgacatccttccatcacatattttctcagctactcagtaaaagatgtaaatgtttaaaatagtttaaactatttttcagttagtccaggaaacataaaatggcatgcttgcacataaaccattgtttagggtgggggaagtgtttttaattttgccttaaaggaaatctgcatgatccacaggctatgcaactaccaagggaattagttggtagaacagaattacacctgcacagaatacaaatttcctgcctttcatgggaactatgttgatgtttcagatatgaaatacatcttgttttctttattgaacctcgagaagatgtctcttgttggtcattatttcatggcaggggaagtacatattcctaaagacacaaccgagtttccctttaaccatcattagttgggctggccattaagaaccagacgcttttattttcaaagagacttaagttttgatgttgtacatatgtgcctaatattctatctcatagcaatttaaaggtgacgttttaaaaagctgcattcagtgtataaacttctcctgatcccagcaaggatgttgtgatgattttatttaaaaaggtaagttgtgtctagatatggcagtgggtcatctcatgcatggtgcagatgtcaaacacaattacattttcttatttgcaatgactaaaaaaagaagctgagcccaagcagtgagaaagtaggagattgggaggacaagaagcaaaggaaaaaagtaacatgagcaccgttctccctgtcctgccacttgctccattatggactgggctgcgatatctcatatcccagctccacaactcccaacaaccatttatgtgcatggtgcttccatgtgtgatgacccaatcaggctcaggtgtggactgagtagttaaattataacccttgtctctgaagagtttagggcttagtggggaaacagacatgtaaacaaacctgagtgaggtcatgtaatcaaaggacaggccacagtcaaccacaaagaagagagttctcagcagtctccaaagccgaacatatgtttaccaggaacagggtcccagcagagggagcaacaggagcaaccagagccttgaggggtcgtggcctgttctgggcaccagcagtggatcaatgtggccagagccagggatactagcagaagccagagcagcagggccttccttgtccagcaaaggcatttgtctctttgtaggccacagcgacccacagagggctttttaggccagaaaaaagccattaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagcggagcttgcagtgagccgagattgcgccattgcagtccgcagtccggcctgggcaacagagcgagactccgtctcaaaaaaaaaaaaaaaaaaaaaaagccattaaaaagggagtcatgtctcttgttggtcattatttcatggcaggggaactacatattcttaaagacacaaccatttcctcttaatcctcattagctgtgctggcaattaaaaaaccaaaagtttttactttcaagaagatttaaataacttctgagggtgtacatatgtgcttaatattctgtctcacagtaatttaaaagtgaagttttgaaaagctgcatcctgcgcttgtcagaaccatgtctgatgagatatcccctttaaagggctctcggtgcaatggggcaaatcaagggggtttgtgcaagtgggagtgagacaggagatggggtgcttcttccagcactccctataggctgactgagtgacaaagatcattttactgacacctccaatggccctatgagatgggtactattattattatcaccatcatattccttttgcagataaggaaactcaggcttagcagattgccagaacaacacaggcaggaagtggtagagtcagggtttgaacccaggtagtgaaactccaaagcccggattcttaaccactgtcctccagtgcctctctgtaataagtcatgatcccagaagccattggtgtggccacaatatggaaagagatgacagtgtcctcacactgggtgagcagcttatggtgattccagacatgatctctgttgggagtgacaggtctgagcttctaggatcagaccctagatcttggcaagtggtttgaggaaagagaaggaccaatgtaaaaccccaggcttcaaggaatgtggatgctgggcagggaggattaagccccaaagaccagaaatggggtacacagggcaggtgtggccagagtagaactagagtagaacttccagtgactagaaatagaaccagacacgttgcagtggtggataaggtagaatcgcttaagtctttaaagtgcccctgatcacccaagttggccagagaccctggggtggggctgattctgtctggatatacggggaggggtaagcatgaggaaaggaagcaggtcctgacaggtactttgcactaaacagctccttataaggttctcaatttgcctgctcaatttctacagacatttgtgggaccacaccagtacattgtaaaagcaggaaacaattgagaaaaacctgagttttatgttggtaggagaaatgcctatggaatatggcaaatcgtttctctgagacttcctccctagtaattacatatttgttctcaaaaacaaatgccagaaggaagaagcagatttaatagtgcattttacaaggcaccattaatctctaagaagaacaattaaaatgtctcagcaatcatggttcactgtatatcttttctatcttcttagaagtaatatatggctggaaatgggcataccaaaatatgtcaaggaagtggaattgcgttcattagatttcaccactaattattttagttagcttcacagatctctcttccttgcttgttcttgagagcgaggctttttagtaggaagagaaattgtctaaaacgattaataaccacaaattcaccaaactattttgggtaagtccctctatttctctaggtctaaagctaggaataagagtcattctcatataatgtactgtcccagaaagggcattatattagtctgttttcacgctgctgataaagacatatccgggattgggtgatgtatttaaaaaaagaggtttaatggactcacagttccacatgcctggggaggcttcacaatcatggaggaaggtgaaaggcacatcttacatggtggcagacaagacagaattgagagccaatcaaaaggggaaaccccttataaaagcatcagatttcgtgggacttatcactaccacaagaacagtatgggggaaccgccaccatgattcaattatctcccacaaaatgggaaaattatgggaactacaattcaagatgagatttgggtggggacacagccaaaccatatcaggcattcaaccaatatttgggaagcaccagccctgcaccaggcacggagcacgtcatgagtcctgccgtaccacagcctgcctgacagacctcagtcatcctctggagcttgcctctgacatctggacctcctcagaatcagcatctcttctccttgcccccgccatcctttgtttttatctctgctgtggcattcatcaaagccttccaactatcctgcgtcactgtccttcagtgtcctctctcctctcccttccttctcaccccactttgtgcctgtatccttcaagcagagcaatggcaccctcacttctgtggctgcccagtgccccatgcagagtcagacatcagaaaatagatgctgaattcagttgacactctgaaattctttttaaagtaagttaatgtgtgctttgaatgaaaagacactgggattacattattgagtgtctttcttcctttgccacttttgtccctattggccatatttgaaaatcttgttggaaaaaaaaattcaagaacttaataaataaattcaaaaacatttagtctatttacttaggtgaagagaaaactcattctaatatgtgtgtatatttaaaatatttgttatttagactttttttttaagtctccaggttgaggaggacacaaatatatcctcctaaaccttccagtaagcaagctgtggcatccagatgatctcctgggtcatgggggataaggctaatctcctaggtgtctggcagacaggacaggcaaattcccagaatgccaaaatataccatctgctgctgtttggcattgcccttaagtccagagtgtggaggctgggggtgggtctctggctacaggagaagtcccctggcaagggaggggtgaaaggagtgcctgttgaaccccccatctatccccgcactatggcaagattgagaggaatgactagatcagggaatggcccgaaagaaaaatccaaaacctcccaaccctggacaaggccacagctttgagaaaccgaagcctctgcttccttctctttggctttactgcttctagatgcaaatacacagagctctgagattttgtgtgctgggaggtgataactgttaaccctctattccaatagcacagaaatttctctttgcctcagaagtggtttctcatagatctcagatctcttttcaggaaaaagaaaaacaacaacaataacaacacattaatgactctgaaagagtcagacaccattaattccattattggtgtctgtgccaagtgaaatgaacgtcagctcttttcccagatatgtttccttcttttgcctcctataataagagatgattttactgtaataatataagactcatcaatttgactccaaatagctttcctatcaacaggctaagtgtaaaataccaggatcattattcagttgagaatagatagaactaggaagtagccatcaaaaaagaatgatgaggtgcattgtggatttggggtgtaacttggtatctaacatacagccagaatcacagtcatagcacacttaatattttatcagaaacttgcgtgaacaagttaagaggactctcaacttaaaaatgacaccaattgcaatgatcttgttaacatttgtgatgaaaataatagcaaagtgacttagacaaattacaatagcccataaaaataagataaagtttaacacaaagtaagatgatgttaaaagacttgaaataaaacagatatgttaagtaggcaacacataggtaagcatataaaaacaagaagataccaggatagagctgtcatttttgtgggagcctgtgatgtggaaaaccaagatgcctggtgagtataatggatatggaaaccccccttgtaataattccacagttccaaggggccaaggtctccaggttgagtcactattgtaaacacacccatagatgaatccacatgccatacctccttgagtaagtggggactcaaactaggtctgtcaattgttccagaaaattaagcatctaaataatttaatgataatttaaaagaagcacaatgaaatatttcaaggaatgtcacatacaagattctgtacctcttctgctttggttagactcattcagaataggttcctgctttgatcttaagagggaggtagagattctggagaagccctagggaagagcaaaaggaaaggaataaggagccaagaggaaacccagggtaaggctgaggagggactgtttcgtgtaggtgatttattggaagggttggaaggaaacatggaatgacaattacctttggttattgtcaggttagtatgagacttacaagaaaagcactgctcagacgcaattaccattcaagataagaaataataggaaaggctagcacacttagctttttatttaaaaaagtgttaggtaggctgagcacggtggctcactcctgtaatcccagcactttgggaggccaaggtggatagatgacttgagcccagaagcttgagaccagcctggacaacatggtgaaacctcatgtctacaaaaaaatacaaaaattagccaggcatgatggcatgcacctgtagtctcagctacttggggggccaagaggtgggaagattgcttgagcccaggaagtcgaggctgcagtgagccatgattgtgccactgcatgacagcctgggcaaccgagtgagagcctgcctcaaaaaaaaaaaaaaaaaaagtgttaggtgacatgagagaagatcttccaagtaataagagtggctaatcccaggaatgtgtcaccagaggttattttgtaatagtcgtgtgttaaattccttatttgtctatataacttctcaaatccttctgcctctacagttatagtttaactggcgcataacagccttcacacacagcctcataattaaacatagacatacatatgaacactttcccctatgccagcaggatacttggtttgtttaggggcaaagaggaattgatgtggcgttgtttcaatcagtggttgaaaatgcaagtggtaaacattgaaaaatagaacactgcaaaaggcatgcattgtatataccaaaaggtcagcatgaagcattatctgtatggcaagcctgcccatccactccctcctacacgttgcatattcacacagttttgcagcttgtataaacccctattgtgatagaaactcatgaaagagtgtggtctctgcgaaagctggctgttctgtgaatttagaccagtggttcttcaccctggctgcaaatcatctggggaacatttaaaaacactgttttaaacaccccaaccctagaaattctgatttaattggtctgtggtggggcccagaactctgtattctttttttaaggctctcaggtgctgctaatgtatagctaaaattgggtctggtttagactctcagaatttcttaataattaaacactttatcatgacaagactttcaggaccttaaaggccacagtggggtagttatcatttcactaggtcctcatctggggaggtccttggcatttttactggaatatatttgtcactcaaatttctattacaaaaaattctttcttgcacactgctttagcaactacatgagatatactttgtacatagcacaaatctcatatcacttatgtaatccagctctgtggttccttcctttcctttgcctgtttatttttaattcttcccaagaggaagcttagccagttagaacaccagagtatcatccccctcccccttttcccacctgagttcatggcttagacatactaggaatgaagctgacaacatgcactagtttttttcgaaattatgcagcaaaattcccaaagtgcgagtggccacagagatcttcacagggcccagggacaggcagacatcattctttctccagttcctggcacagaaaagagaccttaggttactgagaagataccagtccctcctcagagcagacaaggaaactgagcctcagaatgaaagactgaatttcagtcctttcttgaacatggacctccagggttatattgggccttggaaaaggcacttacactctggactgtagtttcttcatctataaaatcaagaggcagaaacagacaatctctaagttgcctttatttataaaattccgagattctagttgaccagtattcatacaagagttgaagcctgtaagagtgcagaaagcccacacaaagagacagtggaagacctctcatcagtagtatttttattaccctcttcctaggttttaccagtcaacatcctcactgttaatatacagaccgtggtatttaattaaatcatctttgaaatactgagctatcaacagatggcatgctgaatgcaaaaggaccacaaataaatatttggtactgaagaagatcaagagttggagttcatttcccattctgatctgggctcagaactctgtggtcttccctctaatcatccttgccaccaaattggctgtatctgttctaagatggatcagaaaatcagttccaaagttggctacaaactttcaggtttgggttttgttttgtttttttgttttgttttgttttgtttttgcaaccagccaattcatcttagttcacatgacagagaagtgcataattacttgcaactttagttagagcagtggccttaagaaggtctagctaaataaaaagtgctcagactttctgagtgctgacagttgtcaaattcacctagttcacatggccccatttctatcgtttgttttgttttgtttttgttttttaacagcccatctgtgagcaataggatcagatgactaagagctacagggcagaaacactgttacttagagtcaaattttcccattacctagctgtaaagagtttgtttctctctgactcatataaagtttaccatttaggcccctgcatgattttaattccatcacttaacaccccagccatatgattctgaaggtaaacatgaaggcgtttgaattccagaccacctaaacattcttaaggaaatcatcatctccacgggcagagctatgccaaaatctgtaggttttaactcaaatttcatgataagcaaaaattgaattaatttgtcttccattttgttcacctttttgccaaaattatgcctggattagaataaataaattcaatcaatgaatgcaatcactaattcttacgccagataataacacattcagaattctcctttccctgggagattttatcaggttagtgttcttgtaaacaggagaaagagaaaaatataacttagtaaatagcagtattcactaattcattcatttattcaacaaatattaatttactacctactacattccagggagcttagagtctagtatcagaaataataaccacacacacacatacacacacactacattaaataaggatgtgataggctagatgaaataaataaataaataaaaggtccaggtgagaaaagaaggtgggggctagaaagaagtcattgaagaaaaaacatttaggttaaaacattatgaataacttagagtgagccaagtgcagagtgctgaaggagtgctccaggcaaaatcaacagcaaatggggagtccttgatgtagaaaagggtttgaggaattgtcctgggagaaatactcaagattccagtctgaattctagaggttagtgatttagagaggcaagtacgaaaatgacttcctctcttaccttaaaagtaagtgcaccatagaaggaaatcacccttccttggtaataattcctgagtgagcctgagaagccagaggccatctctattttataggcactgtccccttttcagttacccatggctagctcattgaccttgtcctggtcgtttcctcatttcacttactccatcctcaaaacgtagacgcttcataaatattgtataaatgaatgaactcacaaagtcacagtacagcaaggcaaaagtgcctgcaataaacaagcattctaggctagaaatatttctcaacttcaaattgtgtcttattacattgtattccgattttctagagtggtagttctcagtcaagggaaagtttttcttcccttccaggggatatttggcattgtctggagatagttttagttgtcacgatttgggggatgcttctggctcaacttgggtagagaagcggggatgcttataatcatcctacagtgcacaggacagtacccccacccacactccagtaatgaagaatcattagacctaaaatgttaatggtgtccaggtagaaaaaccctgttgtagaggttggggactgcgtcttgacagccacattatacagtgtatcaaacaattctgtataatgggctgtaattatccttgcctagattttgcaagaaccctagtgtgtatctttttcctcacttgccaagcaatgttcaaacctgcagagatttatttcattcattttctgtgtgtttagtaaacagactagaagcactggaggaaaaaatattccagcaatgaggtaagacgaaagctattagtaaccctagtttaacttagctgaatagtaggaaacaacctctaccgtgaggaagtgtattgtagaaactgaaaagacgctaatgatgtttaaaaagctgtagttcaaacaaatgtgcatgcagaccaatgggtagactgaaaatgatgaagacatttccgtttcttgtgtctttgatagaaaagaaagagcttttattttctttagtgtggcaatcattcagatttgtcccatgacatgcccagaaggttgaagaataacaaactcccaagtgtaaacacagaatttagcgaagaatccaggcctctggatgaatccctgtaattgcatgtttggataaaataagattttcatacattaaacaaggtaggatttttctatctgggacggaactttcaacacttggaggggttgtagttatttctcctcaaagatggcaaacatgagtgccccgagttatccctcctctctgttcaagttcgctaactaatcacccagtatccatgctatcgctggcccttctgtggcctatttttatactgttcactgttcagtgtcacttgtttggtaacactcaacatcaacatgtgctaccaaattgacaccagaggacaaaaaagaatcaagatatgtacagcctgctttgtactgagccagctgccactagatgttttttgtgataatgaacacgtgaggccatgtggacgcgagagatggctccgggttccctcagacggctcacagccagctggtctgcagtgcggttttagattccgatgtgggaaccccataaaaaagaatatgcaggccaggcgtggtggctcatgcctgtaatcccagcaatttgggagcctgaggcgggtggatcacctgaggtcaggagttcgagaccagcctcgccaacatggtgaaatcctgcctctactaaaaataaaaaaaaaaaaaattagtcaggtgtggtggcggatgcctgtaatcccagctacttgggaggctgaggcaggagaatcgcttgaacctgggaggcagaggttgcagtgagcaaagatcgcaccattgcacttcagactgggcaacaagaatgagactctgtcacaaaaaaaaaaaaaaaaagtctgcaggctgcataaagaggtatgaaaatgttccagaaatcccaaatcctatccctgaggttcattttggtgagggaatgtgtgtgcattttctagggcttccctaaaaaagtatcacaagctggatggcctaaagctacagaaatttcttggggacaaatttcatgattctggaagctagaggtccaaaatcaaggtgtcagcaaggctatgctttttctgaagcctatagggaaggccttccttgtctctcctagtttctggtggtttgctggcaatgtttggcattctgtggattgcagctacataactccactctgcctccatcattaatggccttctgcctgagtgttttcatatgaccatcttcatataaggacaccagtcatatttgatgagggttccaccctactccagtatgacctcatcttcactaactacatctgcaatgaccctatatccaaataaagtcacattctgagtgtctggggattagaacttcaacagagcttgttgaagggggcacaattcaatgcataacaggatggaaactagaaacgggtatgtttttatcagtgtagaaagatttagcttaatttttcaaagtgtaataaaaaccccaggaaaactcatactccctcctaagaagagcaaaagatggagaaacccgatggttaccttcaaacaaaaggaaaggaggaataagatgaaaaggaattaatccaaagcaaagagagtggcttatatggaatgttggtgcaactttctctgacacatctgtgcactcatcagctggggcatcatctccctggggtacatttggtcactgtgtgcctcatggtaataaactccagaagcctcattgacttgctagagatgagctcatccttcttgcttgcttaatggcaaaatacaaaataagcagtcactgacatggaacgatttcaggaatgccaaaaggttctccttttccaaaatatctcttccatcttcccaatactgttactgacatcactaacacctctccacttccggttgagacacctgggccagagctcctgatgtggcaggcagtgccctaaacgttttgcataaattaactgatgcccagagcaacaaccctaagatataggtactatcataccgcatcttacagataagaaacttaggcacaaagaggtttagtagtttagatgagataaccctgatgagcagagattcgaacccagcctccatgctattaaccaggacatcatattgcctttcatacatgctcttcaaaggcaacacagtaatcgattatcacactcactcacatctgattgtcacatttttcagatctgctctcctagcagagaatgaagcctaaggtatccttgtttctcaaagtgtcctccccagaccagctgcatcaaaatgaggggatgaggtgcaaatgcctggaccctgcccttggagcactgattcataatctcaagtcccaagaatctgcattttaacaagcatccccagaaatttcttaagtatactaatgtatgggaaccactgacactaaagaaatggaataaggggaacgtacaatgttacagtaaaccaggaaaagccagaaagacatgacaacacagtgaggactctggtagccaatggtcagtcaaatgcccaggggccctggccagaagagagttaggttgctgaggagtaagagtgatgctgaatgtggaggcttgagagcagaaggaagccagccagctatatcctcttgcttggatcacacaccctttccttggtggaaatggttatttgcagagttagagaaggcatgttttacagtttggatggcaggtatggatgtagacaataaagagcaaccagagtccatgggttcagaaatccccatgtgtttctgtttgaatgagacgcttgcataaacagcacaaggagtttggggtggggttaaagagaatggtgtggtatagggagagctgaatgaggaactgagagagcaaaatcctgtgtttggttcaatcactgattacaacctccctgaggctcggtctcctaatctgtaaaatggggggaaataatacctgccttgcaggtcctcacacacagggcatgatgtgaatccactgaggcatatagcactgtgtaacatgagttattgctattccaaggcccgtaaaaggctcttgccttggaatatatctgccacaccaatgcctgcagtccattaatgacacataaaggacactggagataacgatgtcccttgttctatgcatccctcccacccatgccagaaaagaaaacacagtcacctgaagtcattctaaagagtatgcctgcctcttttcctgcacagacacatatacacagacacgcacatacacagaccatgcacatacacacacatgggaaaacatgaggaaaagtggagacaagaggcaccaaaggacaaagtcacttttgtcgcctgtcccttccccagcagggctgggcctgggctgcttctcctgcctcctccctgaagccccctcctcatcatattccagtgcgtgtccaccactttggggccaggtctacacaactgcagtgattcaggtcacgggagaaaacccaaacaagcacaaaacatgcttcaacctatattttctaaattgtttttctttaaaggtgaagacttctgagcttgaattatccccttgtcagtgggctttccatgctgtccaagtgacctaagtgataatcaacctccatttcattttgagaatggttgtggtattttagagctatggtgaataagaaaatcatttaaaataaaatgatttttatttatttattgtttttatttattttatcttaaatgaattttaaatcatttaaaataaaataatgggataaaagaggatgctaaaaataataaatatatatgtatcaaagtgtgcttgtaataccaggcaaagaattaataagagataatattatggttggtgaaatgttatgtatggctacatcctttcaatgagcatttatagttcctttaaaatatgcctactgaagaaatatttacatgctaattaacatgtgcatagtaccactaggtattatagaggataccagatgtttgtagtagacacagaccttgccctaagtcctggtcttgatgtagtcactttttagtcactacaggtgactacatttagtcactacaagtgaccttccttcaatggggaaataaaggactttacaaaagacgtagaagacaattcttaatataaaagtgatttagatcttcacaagtttgtgaagagaagcagatgagtgaaatagaacactatcaatgtaaaatattattctgaggcctctgtaatgactgggaagcaacaagagggaggtcatttcagagagagaggctctaggttccaagctggatgctcaggtcagtgactgcaggtcccctccacacccatcaccccacaccctaaccctcttcagttgctcacaaaggtagataaatacccacatttttgccctcttccatcttgaaaccctggaaacccttgcttccgccaggggaggttacttagtatctgtcaccccaagggaaccaacgtcgaagcccaagaataagagtcaatactcctaccagaggtttacatttttcccaggggtctaggtggatattcctgggaacccccgtcaacacaggcatctacagtacaatccaggcctcctgttttcagcaggggctgcaagagcactgcagccttttccccagaggtgtcagtttggcccagtaaagattgcccctgagaaaacacatgggcaattagagcaaagttcctatgttctggtaacatttaattgtgctatttctcaacctcctctgcacccacacactcacacacaacatttattccactgacttcaaaggaagctcaacgtgttaaaaatatgtgtgggaacaaagaagggagtttgaaattggtctaaactctgtataactgggtttgacacgtacattaggattttacaagtatgtatttaatctttttttaaaaaaagcgtttacatagggttcagaataatgacaataaatcaacatttctattgtccatttgtgtgttttcatagtaaataatgctcatttatccttaaccagtaatacatacttatgggcttaaattagcaaaagcctctcaaaaagtagctccactcatttatccaccagtgtccagatgccatccagcacatgaggagctcccagaaaggagcagggaacaaactagggctgtcaggagtggaggagaaagaatggcatatgcaaaaaggagctgtaattaaatccaagggaacatggcacactctagtcttttgcacgagacaaagggcaatcctggtaaaaatacagatccccaggccccaccccaaagagtctgatctgattctgaaatggggccggagaatctgcattttaacaagcaccttcaccaggtgatccttttgctgagaacccctgagaaatgagaaccctgtgctagtgctgaatggagcattatattccagagttgaagtttggtgatcagttttccagatggagctggtccttggtgcatacctgggtataaatccaagccaattcaggtatatgagctgatatttcaaccgaaacactatctatagcctaaattttttctaatattctgtttggtatgaattctagaaagttgtaaatgctatatttccttctcatctatttctggactttgtcccaagaccaaatcccagggcatctgatagacattcattgcatacatttttctgtaaacatgaaaactgaattgtctaatagaaaagggcaaggaagtagaaaataagaaatcatcatcagaagtggtttgttttggaattatattgtccagctgcataacaaatcacccccaaaattgagtcgcttagaacaacaaacattgatcctccacagtttctgtgtgttaggaatcaaagtgatttaatttaatggttctgctcagggtctctcgggggctgcaatccaggtctcaggctgggatcctttcaaggctgagctggggaaagatccatgtctaagctcactcacatggccgatggcgggattcagttcctcttaggctgtcagactgagggcctccgtgtctcagtggttttagccagagccctctctcagttcctttccacatgggcctctccacagggcaactcacaacatggcagctggtttccagtagagcaagcgagtgagagaacaagaaaggcaagcaaggtgaatgtcccagtcttttgtaacctcatctcagaagtgttaacccatcacttttgccatgttttattatttagaagcaaatcactaagtccagcccacaattagagggatggcattacacaagggaatgaacaccagcagacagggtcattgaaagccatcttagatgctgtctatcgcatctaagtgtgatttttccagatgaaaagaatatattaatttgtttcagtcttagtcgatgtgccatcccatttgtgctttgctaaaacttgtatcaatgtaaagcaaacattttctgatacaatttaggtagtgtattgtggtaatagagaccagtagtgttgaaaagatatgttgaggtcagaaattaagctcatgtttctaaaagaggagatatgtacaactactatgcaagccaacaggaaagagtgttttaagaatgctttctgctacaggtaactaaaaacctaaacagctgtggctttaaaataaaggtatatctaagtcacataagcaaaagtctaggggtgggcagctgctggcattgcttcagtagcttgataatggcaaaagcagcatctcttctatttccttggccttctaatcatgcatgtcacctcacaatcacaacataggcaacacctcatattctaagcaagatgaaaagggcaaagagtcatgccatatgcctctgtctcttttcataaggaagacaaagcttccctggaagtcccctctagcagatttcacttagatctcattggccagaactgagtcacatgcctgccttaaaccaatcactcaccaagaagactaacattatcatggcaagtctaaaccaactgtgactcatctctgaaatcaaaggattattaccattacccgaatccatcaggatcctgttggcagagaagtgggactgtaaattttgagcaggcaacaaacaagtcttctgtaaacttcttatgtgttgttttttatgtgttctatatatccagtagaatcacaatttccaataacagtctaaaaagatattttccaatagaaacagaatgtgtaagatcattacttatgaaatcccaaatgtacttaaggtttccttcttgaaaattccttattcaaaataaaatgtccagattttgaaacccagaaaagattctatattttaaaaatcctgtgcacatgtaaactgtttttcaaatattgccttcagatacattgaacagaatgaaatcttctgagatttactacatcagccaagtattatcaaaacaaacaggacagattgcttttcttgacgtctgctgcttgatttgtgttaactcatgtttctgaaattgtagtatcataagccaatgctgcacaaaggtatttcatgtcatttataaaaatctagtaatgtaaactgttaactccttataaagcatctgttgacacacaaaaatatcactgaagtgcatttatgcctttcttctttaggtctgcataatacttccctccagaaggccaagttgttccataaattacagaacagaaagttggttgtgggaggaatagctcaacctcatctgaggcatcccactctaagaaactaatggcacctacacctcttgggcattgagtttttaagcccatttttaattcttgttctgctcatattctaagtgagcacataaagtgctgctccaagcaagaccagcccttgtagaagggcaagtgcagtcagtcccctaggaaacgggactggggagtgatcgtttcaatgagagataaatcaaactgatgctaaacatgaacaatgagcccattagagattgtgagaaagaggcatcatcatccactcaacaataggcctgtgggacctcttgatagcctgaggatgtttaatttcaggtgcaggtatccagaatgtagcagctagactgatcaaggatgtgtgatgacagcaagcagtagtggaagagcccaggagagttcctaagcctgaattgcaatcctgtgctgccataaaatgggaagatatacttggtccagtcatctgacagctttggtcatcaatttctctatctcatatgtgactctattgctttaagaatccctttagctttaaatatctatgaatctgctgaagcagctgtgctttgattgatgtggatctctgaactcccttaaatacaaagaccaattatttagccgagctttgttggattcagtgcattctgaatacatgtcaaaatatacttggatttgtaaaaaatattccttcctgtttttttcaccatagatagatgtacaaaaatgtccgtgttcacaccgtggaaaggacatttctcataaactcacacagagatacctttcaagtcaatgccttagaaagcaatgagagatttaaaggagacctagagatatgaatggagtaggcagagaaggtatgtgaggagaatgatgtaacttcctagggaaaaagtatgaagcacaaggctggacatagacctgggaatcaggaaattagagttctaattgcagcttttccattgattcacttgggatcttgagaatatctgtctcattttaatcattctgggccacagtttccatatctgtcaattagagtaagagtccctggctgggtgcccaggattgtgagaacataccattcagagccataaaaatgcaatcagtaccaataatgtactagtaccagtacctaggatgcaaaacatcctagatactaggtgtcctaacttaaagtggaaacattaacaagagtaattctttgaatcatcaaactgggaatattttaggaagcatatctatctgggtgaaaactaagcaaataagacaattgtaaaggcttgtgatctcaggaatacaaaggcaaaaatgcgcagacttgaaatatgacaagttctagttttgtcacttagcatctctgtgaccttggataatttcttaacccccggcagtattctcatctgtaaaatgggaataatgacatgcacttcagtggtttgtggtgaagattattacaaatagaaattagctcttttgagccactggtggggtttaaattcccagcccttatgtgctttgcagctgttagttcctcttattacaattgtctatttaaaaacctagtcacagcccggtgcagtagctcacgtctgtaatcccaacactttgggaggccaaggcaggagaactgcttgagctcaggcgttcaacatcagcctaggcaacatagtgagaccctctcatctctacaaaaagcaaaaaattagccagtgatgcatggctgtagtcccagctattctgagggctgaagttggaggattgcttgagcccaggaggtcaaggctgcagtgggcagtgatcatgccgctgcactctagcctggatgacagagcaagaacctgtctccaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagacctagtcaccaaaagcaagagattttttaaatgctactattttttgggcatttactaatcatattgctatgctctgcacccaagctaagtaatttaaataaattatctcatgtactcctctaaaactaattactgctgtgtaaatggaggtagaaagaaactaagctttatttctgcctctattgtttctttaacctgccttgcttcctttttcagttgcacctaattggctgtacttttagttttctttaaaactgccttaaatttcaaagactaaagcagcaataactaactgaatatatttatataacatgttatttttgtcatgttgctttccacccctggagacctgctctaaattcacttggacgtttgaggataaatcatgctcactagcagtttctgaaaatgcagtttcactgaaaatgcaggcatccagaaatttagtaagcaacttaaaagaaagtgtaagaatctcctatgtattcattgaaaaataatttgaatttatgcttagaaaaatagaattattattaagaaatcttacacactcatgtttttaaatatcttcactaaggaccaattgtgtatatggtgtaacactgtcctcaaagaacatgccgggagaattgttgcagttaccagagggttaaatttggcaaactcttttttattaacgtgccttttaattatgaaatagcatactcaccttagataaaatttgaaaaccatttttgtaaagtggtacaatattgaagaaagttgataactttcagaccagatttaagcctcaaatctacctctcttttacctggacaactcattagcatttctgaacctcacattttttctataaagtgagaatactatattatagagttgttgtcagttaaatgagaacagtgtctgatcacaactagtcaacaaatgttcacaactcttcccctcctaggaaaagaatctcaaggcagacctgcttcgggtctgctctgtaaagaggtaggaatcctctgctcccggtaaattgcttcctaaccttctttggtaatagactattttttaataaaggtgatggatcatttcccattatacactcaaaatgtgtgtccatttcagggcagtcatggatgaccattgcccatcttttgaccccagattaagaacacctgctgtagtattttaattctgccttcaaatcctcttacaaaacaaagacatctttaaaaaataaaattctttaggtgtcttgcagttgaatgcaggaaaaccagagccccttatttttgatagttttgggaagaatgcagtgtcagaacacaaacccataatagacaaataatttgcacagaaacttcataaaagtattgacctgatttgccatgtatttgccaccttttaaaacacacaactaaatgtttaccctgtgtctagatccaaatgggtgaagaaaaatgagtgacaatacatctacttaagctcacttacataattgtggccatgccgtttttttcacattacattattagaacattggacaataagtcaagaaacagaatgttctacaaaataaactttaaaaattggtaagcatcatgtgctttttccagaagacattttattttgttgaatcaaaggtggctctttggcactgagtagctccgtggagtcatggcagtcctcattccctaatcctgagcctgcctgagtcgctgctgtcagtcatccacttgttgggatttcaaactgcattaaatcccctcctatagctgtcactgccaagcagttgcactggctctgtcctacctttctgttggtaattctgtttttaatcctgtgcttcagtgtagtttatataaatctttacagagggataaaacttcctgtaattaattgtttgggtgaacatgtacctgggagagctattgggaaaggggccaaatttgcattccagctcctttcatccccacccttgagctaaccaagtcctgtggattcttcccttagcatctctggaaccttcttttcttttcttttttttatgaccacctttccagtcctggcccttcaaacttgagtgacagcaacagtctccctgccttgagtctctttcctccttctcccagtgtgcatacggttgtcaaactcatcttgataaactactgcatcgattgtggctacactcccctgctcccacatcttccatagaccccactgtctgtaaaataatattcagtctggcctcaacctgtctttccagcctcggtgacacaggtctattctgcctgagacacttactatgacacccttgcttgttcctggggctttgacacatttccaacgtcccattgttcttcctctccaaatcagccaattgcccaagccctgctcaaatctcccacctcatgaagccttcttgatgcctcccagcacaccatgatctaatttcctgaagtaattatgctaattgggcatttgaagaattgttaaccgattatcaactaactgccccttaacattgcatgtgtagttgtcttcaaaggcagttaaattatgtcatgttccttacattgtactgagtgcctcgtatccttatccatgtttgggggttttactttaagtcaagaaatttaatcacatccatttggttttctctagagctgtagttctcaaccttttgtgtggtagagaaacacctagagaacatgtttaaaaatatcctgggttccacccttgagagataataaggtccaaggggaacccaaatatctgtgtttcaggtcagcttattggctcatcctattataccaactcctcagaaggccaaggtgggtggattccttgatctcaggcgttcaagaccagcctgggcaatatcgtgagactccatctcttaaaaaaaaaaaaaaaaaggattagccaagtgtggtggcatgaacctgtggtcccagctacttaagaggctgaggcagacagattgcttgagcctgggaagtcgaagctgcagtgagccatgatcatgccactgcactccagcctgggtgacagagcaagaccctgtctcaaaaaaataaaaatgaaaaaaatctgtgttcccaagttccaagtgatgctgatgctgctggttgcctttaagcatctcacaaagaacgaactcataaatgctaatacagtatatgtctatggatactgaatagtgggttttttttctcttttcttctattctgtgctcatgttgtgtcacttcttccttttagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaacagtcagctttattattttttcccaaaacaggtgtttatgtgtcagagtctgtgtatgtctatgtatttgtatgtaatgagcatgtgcatagtgtgtgtatgtgtttgtatgtgtttgtggggggtaatggtctcccactttaaaattattacaaagtcacttaggatatttctgctaaggtcatcaccatttatga

SEQ ID NO: 3 - DNA, 16293 bp, Homo sapiens
ttatctcctatgccagcctgagactccactccctttgcaacctcctggagaagataacttagggaaagactgtcactgctcagaggaagcatcccaaacccctcactggtttaggaatttaacactaccgagcaacggccccagaaggcaaggcgattgttaggaggaattaaacaggctagtgctggacccagccatccagtcctggcttacacagaggttgcttttcatgccttttcactctgttaatttggcttgttttccaaacatgggtcaaacaacccctctccagaagcggcagcagcagaaggaaatgttattaaaaatgagtctgttagtgggaatggtgtgtggatgaagtctttgggagttttggctgccaaataaagactttattgtcattcctcctttcccaagctccctccctctctcctcccctcccctccctccctcctccctcctctcctcccctccctccctatgatctgcccctccctccccccaagctaacctccccaccccaataggatctggtggaagaaaagtcaggcaaacacaagcacgcacacaccactgggagatcagatcttctagctggctctctgctgccacagctccgccgaagggagggggtggaagaggaggactaaactcagagctgagaggagaggcaggtgtgtgcaggtaagcccagttgggagatgggcaggagactgggaagaatctttcatccagtaagtttcctccagctctgtccatttattgatctagtctctatcctctcactccttccttcctcccacctctttctcctctcaaatgagttcaaatttagtcttcctaacttctttcctatagcctcttccttttcttttcatcactctgtacccctatatttgcttactgcaaaagttaagctttcctgctgcagatgtttgttgtagcacagagagccacgctgcacaaagtgtttctacagatcaggtgtttccatagaaactggactccagaacccatttctttgcaccttttgtgtattgtcacacattgtggaagtcacacacatcacacggaggctgcacgttcactaccatcaccccacacgaccatacaaaatgaagacatcctgtccattcacctctgccctctgcatctgacatgcagagctagaccacatcatcaccagacaccagcagacacacacacacatgcatgcacacatgttccctgcatcttgtctctcgccctctcacacacacctccctagctgtaagagcaaagataaagtacgttttcccactgagatggcagagccagaagaaaatcttgcatcccaagtccaggccgaatagggaggagataagcaagagcgggagctggaagggtttcttcattatttagggcttcactgggtaggagggagagaaaaacggctttttccaacctgcacagtgtcttctcagcagctttcaatttctgtctcactggtccaaaccacttggcttttggaaagaaagaagaaagcgacccagttcccaatccttgaaggtcctaattcccagctctggggacagttcatttttttatttttttttcctgcaggcagccagaaaaatatttttctttaaagccgttctgaaattattccaaccatttaggttggcaaaaggtcctgtggcagaggagaaaaaaaaaaaaaggcagcagttccttaagcagttggggaggggaaaactgaagggcggcccctctcctgctcccctgctcattcctctctattaatagagagggtctgtcccaaggcaggcggggtgtagggagatcaggggtcccacacacagctgatcttcacagtcacctaagggctggagagggaggagtgtggagggcttactaaaaatacagatgtcggctctcactgcagatctactgaatcgagacccaggaatcttgttttaatacttcaggagattctgatggtccaccagggctcgagaatcaggggcctgagagagagctttgctgtaatttttaagcccaagactccggcagtgttagctgggcagaaggactgtgtcctggaaaaggagcaccagagtgtcccaaataggccacctcttttttggggagtgggagtaaacagggaagagctgtctccctctctcctccttgcaagcacaagcagccatatataccacagaggaacattccagtaagaaagttcccccaagatggctccacagagcttctgtttcccctcacctgttaatctgcctgccccaggaccccaggagcatgtgctgggcccttcccctgacccttataggtccctgctcctccttcccagcagccacctgtctgggctctcacagagggtgagctgaacactttcttcatgccccctccacctccctagtgggcaatcccatttattgggcatgtgagtgaagcatttcaaggctggaaggggcaaaaagctgggagaagtcaagaatcgcagtggaactccatggcccactgaggaaggcagacttgcaccttctgtggccagtgtcccctcacctgttgcagaaagcatcggtgagaagttggtgaattagaaagacagaacaagctttccctaggtggctggggacttccagagtctcctcagttagttgtttctgagacccaagtgtgatctcacaagccacaaaggggaggaagttgctctgtgtggaagagctggtaccccactcacaaggatccctgccttcgagcagtgcatgggggctgccctctagccaggctggagggaaggagaccccattactttgaaataatatcaacaagaccttaacattcagaaaacactcactttgcatgtattaactcatttaaccctcaaaacagaaaagaaggtgttagtatccccattttatagagcagaaaagcaattgctttgcctaagcctacctagctaagcatctgaatgaagaactgcaggattgggtctcagatctataatcactcaaggcatcagacacactcttctaggctttcttcaaggcttggagatgctgggggaatggggcagaggatatggtaggtggcgggctgtcagagaagagtcgtctcaccctggtttcttccccaccgctcagaatggaaaactttctcttctaaactagtggcctgaggccagaaaatcttcattctgtttacactttgccttgtggtagacactggggagacagatggtctctccataatagtgttatttttatttttagcactttttgatctgtagtgcattttaaagctgctaactgcacttgcttctgacaattgggtaaggaatataggtatagggaagatttttttattcccattttacagataagaaaactgaggcccagaacagggttcgcatcactaggtagtggtggaggggtgagaatcttctctcctaactagtatgcaccacaggctctcctcccactgccccaggcaagctcatccttgtatcgtttcaccttcctagaaaggggcatcttgaagtcatcatgcccccataaggctcctttgttatctcaggaccacatcagccctaatgggggccttgaaagggcctcaggctcactcctctactaactctgctcataaattggcaaagactgcttgattctccctgcttccaacacccttctggactacaggaagagatacagagagcaggatggctttcagacacctaggttgagaacagaaagaagggaaaaaagagagaggggtgttccgacattcaccggcacagcgctaggtcagaagcagccccattctccactgcagggtagctctgggtcaaggcatggaggcttaggggtgaccaattagacaggagatctgacaagtaagaagaatgccagttcagagtgcggcgtaaccctgctgctagccctgcctagccctgggagacaaacccaacctcattcccagcccaacctcaacctctccatacaaagccaattagccttaaatagctgctcctaatgacttgaccaacccatcaggacttccacccaaccctgccctgagcagaaacattccaccactcctgggttttaacattaaattaatgagagagatagggaagggggctatctcactttaaaaatcaaggagtccttggggcgctgtggctcatgcctgtaatcccagcactttgggagactgaggaggacagatcacttgagctcaggggttggagaccagcctgggcaacatggtaaaaccccatctctacaaaaaagacaaaaattagccagctgtggtagcacatgcctatagtactagctgctcaggacgctgagatggaaggatcacctgagcccagggaggttaaggctgcagtgagctgtgattgcactactgcactctagcctggtcaacaaagggagaccctgtatcaccaaaaaaaaaaaaaaaaaaaaaaaaaaaaaatcaaggagtctctctagagaatctgctgtttataaacaaataaatgagtaagtaagcctctgccacttgcagagattttgcactttataacatgccttcaaatgcatgatctcatttgatcctcacacagatgaggagcccgggttggagagtcagagccaggagtcaagcccagatccacaatagttggaattgaaattagaatttaaaactctcttagaggctgggtgcagtggctcacacctgtaatctcagcaatttgaaaggccgaggtgggaggattgcttgagcttaggagttcaagaccagcctgagcaatacagtgagacccccatctcatttttgtttaaagtgaaaaaagaaaaaaaaattaagattctcttaggaaacgttctttaatgtggagagtgaatgttgggttgggcaaagcaattgcctttctcttccgtgaagcagcagcttttccagaactgatggtggagagcagaactgcatgcagttggctgttgtaggtggtcaacaaaccttcactgattgagcaatgagcagagcccagtagaaagctgtgggtggagaagtgcacttgtgaaagcataagaaaaatttaaaaacacacacatggacccatcctaaggaatcttatgattggacagaagtttctagaaggcaggagcatagagtgtgggtctgaggctttgtaggagggactatgactacccatggagtccaggtaccctcagtctgtcacacagattctggtttcagagacctaggacatcacggagcactgccagagagaatggctgtgctgtcagctgtcagaacttttcatcctgcctcatggcaaagctccggcaggaaggggcatcaccccatgagaaaagccttagaaatgaatgctatttccttaagagagaagcatccctgcacttggaatggttctgattcagccctggggctgagggaaggggaggagagcaggctcagcttccccacataacttgctcctgggagcatttcctggggaacctcctgttggctctgggagcagcttggctaggcccagaggtttggaatgtaaacgggtcagaggactagtgaaaagataagttcccaaagggtctggtgctgcacatggggatgaggaaggcctgtgtttactgtggatgagaaggcgcgcacagccagcctgctgggtggagctgtgagtaacctgcctgttcctctcacccctgacaatgaagaccagggctgccctggcactgagccaaggaaaccccgccccgcccagcacaggtcacagccacagtgcctcactgcttttgctggaagccctgggcaaattggtgcccagtccctggcatatgctttcggtgacaaaggcaatgaagggatatagaaaaactcccgccagtgctgggagcctccttgggacagggcttctcacagtatgaaagatttctagatcatttctaggcttctgggtgattagaaaataaatttttttttttaaatcagggtcacaaaaattgaggcttttagaaatgtttgttttagaataccaatgctttaactacccccttaatttatatgcaagatgactgttctgttttccagaaaattacagaacttacacaatgttaattcatagttcaccaattacaagtgaagtggggttcagccaacaagactcaagcttaaagttttgcaattaatgccttctctttttaacccttgcaatgtatctctgacaatgttatatccttaacgggagatcaagccaaaaacctaactgcaaggtcctttgtgataggaggccagggaaaatggccttccagacctccttggagaggcctgccttggaagagaccaccttagagggaggtggagaaagacagtctctgccttccttcccttccgccttccttctttccttccaatactcagtgtactgcgtatgggctcatatacgcacacagaggataagtgagtgagtttgcttatgtgcatgggacctgaagaggtgtgtgtgtgagtgtgcagactggatctgctgttaaacagcatcttggccttggcgagccacttcttccttccagtcctcagtttttgcaaatggtggggtctggagttgattggtggatttcaagccatttttagcaaagaaacgtgtcccctgcccctcaacaaatgaatgcttcggctaaacctcaatatatataataggtttttttaaagagagctgctgaggttggcacagggatgggttgagggtaccccagggccatctcctcagtctcctccccacaggggtatgtcacagaaatgaaagcagagttggaaaaccactaggttataggatctttaaggacctttctggatttaaccaggacgctaaggttcatacatcctaacatccctctcatgaagacactgatgattttctcatgctgtgaatgggaggactgagggccagagtggttaagggtcttctctgacaagccccaggactcctgactcggagtccagtgtgctttctttctttctttttttttttttgagaaagagttttgctcttgttgcccaggctggagtgcattggtgcaatctcggctcactgcaacctcctcctcctgggttcaagcgattctcctgcctcagcctcccaagtagctgagattacaggtgtccaacaccacaccctgctaattttttgtatttagtagagatggggtttctccatgttggtcaggctgatctcgaactcctgacctgaagtgatccacccgccttggcctcccaaagtgctgggattacaggcttgtatgccactgtcccaccagccccaatgtgccttttttttttttttttttttttttgagatggagtctcactctgtcacccaggctggagtgcagtggtgcaatctcggctcactgcaaactccgcctcccgggttcacgccattctcctgcctcagcctcccaagtagctgggattacaggcacccgccaccacgcctggctaattttttgtatttttagtagagacagggtttcaccgtgttagccaggatggtctcgatctcctgacctcatgatctgcccaccttggcctcccaaagtgctggattacaggtgtgagccaccgcacctggccaccaatgtgctttctaccagcatgtcccccgccctcttcagagcaggctcaacacatcgagtggctaagccaatggccagggaatccagagcctcaagcccttgttattcccttacctgctgggtacaggcaaacaaggagatgcttccacagctccctgagctctgcccatcttccctagagctctagttctgcccaactctggcttcaaaaacatgacaactagttactgagggcccaaggataatgaccttatgtgtcttctccctgcaggtgcatcacctggatcatgaggtcacccctctgctggctcctcccacttctcatcttggcctcagtggcccaaggccagccaacaagacgaccaagacccgggactgggcccgggcgcagacccaggcccaggcccaggcccacacccagctttcctcagcctgatgaaccagcagagccaacagacctgcctcctcccctccctccaggccctccatctatcttccctgactgtccccgcgaatgctactgcccccctgatttcccatctgccctctactgtgatagccgcaacctgcgaaaggtccctgtcatcccgccccgcatccattacctctatctccagaacaacttcatcactgagctcccggtggagtccttccagaatgccacaggcctgcgatggattaacctggacaacaaccgaatccgcaagatagaccagagggtgctggagaaactgcccggcctggtgttcctctacatggagaagaaccagttggaagaggtcccctcggccctgccccggaacctggagcagctgaggctgagccagaaccacatctccagaatcccgcctggtgtcttcagcaagctggagaacctgctgctcctggatctccagcacaacaggctgagcgacggcgtcttcaagcccgacaccttccatggcctcaagaacctcatgcagctcaacctggcccacaacatcctgagaaagatgccgcccagggtccccaccgccattcaccagctctacctggacagtaacaagattgagaccatccctaacggatacttcaagagctttcccaatcttgccttcattcggcttaactacaacaagctgacagacaggggactccccaagaactcctttaatatctccaacctgcttgtgctccacctgtcccacaacaggatcagcagtgtgcccgccatcaacaacaggctggaacacctgtacctcaacaacaatagcatcgagagtgagtggggtgggccggggcggggccgaaggcaaggaggttggcttgtgtagcacttccaccctctctagggagactcagggtggggtggtataaaaagcatccactttggcactggacttcaattcatggccttgccacttgctatctgggtgaccttgaaaagatatttgaccagtctgggaagtttcctcatctgtaaagtgagaatggtaacaatatcttctatcacaaaggtgatatgaggatgtaatagtttaatatggagaaagtgcccagaataccatacttggagggtcataggttttcttcctccattcttcctcagccccagttccttggcaactggatctataggtagggtagacatggaatatactcctggacattctgctaaaaacagaacagagacatttaaatacctatcctgaaatgtcctgggtctgccctctgcagaaacctgcccctgtgggaagatgcttcttcccaagcctgagcctgggttttgattcagggtatgcaactggtaaaaatgtggcagtcaggaaaagaaggtctgcatgctggtgctttctgaatctatctggaagggtgcgatgtttaggtgcacttaaggaagagtttgcctaagtgacatttacagggttctggacttggagtatcaattgcagcccaggagaggaggctggaagttgcagttttgcttcaatcaaaaatttcagctcggagcagagcattagcagaaaggtttagaagtgaaataatattttctggtccttgaacaaaatcagcctacattcacagaagggatgcagcagcagaagggaagagagggattgagggaaaagagaaggacccctagaatgatatttggggatccttaggttccaaaccaaagaatgagatggagattgttggtgtctctaccgacaccaacaatgggcgaatagatcgttcactcatttgggataatttcaagaagtaggggaggattttttttttaatcttacaaaaaaaaaatgggaaaaggggaagactgtataattttaccctggagacagcacactaaaataaaacacattacccccaggaagctatgaggccaaaatacagacagaagggataccttgattaataaatggctgataggtctctaccagattgtggaagaacaggttgctggaggatatcccaaccttctaaggttgaagtcagagaactcacacctcacccacatgagcccaccccatccagcctgtctcctgtgccttttacccgacagaatgggctgagtggggcctaggtcagtggggtgattacgttcttcacaatgaccataatgctgccactggtactgtctttaaacagcttacaaaatgcctttgccaacattctctcccctgattacagggcaggcaccactcttaccatttcacagattgaagaactcagcatgagggtggctaggccacagccccaagctcataagagaaaacccccgtgtcagggcccttctgctactccaatggcaaagaagaaagacgaggaaaaggaagaggaagacaattacaatgaagatgatgcctactcttcctcctcctgctcctccataaatgataagtgaggcaaggcttagggagaataaaacagttcatttaaatgctggcatgcctggtgccacaggcatccaacaagatgtgatggaggaaatggaatctcaggccatggacccttcagaatcagtaggctcatcatgtcccgggggttccggagctctccccagatcctctttcctcttcctgtcatccttatttcagttaccatcttttgcccatcctcatgtctcacatccaattcaaaggaaaacctgcagagtaattttcacatccacctactggcttcagatctcaccttactccattgcttctccacagtgtagccggattatctttgtacagcataaacctgaacatagggatctctaaggacccttccagatttaacgctccaggataccatggttcaagtatcctgttaataacatcgctctcacaaagacagtcctgttcactgccattcctcagaccagagatcaaaagcctcttagtgaaagcctaactaccttcccagcttactctccttagtacatcacattgggcactattactattcccagattcgcccacaagcagaattttggcctccacaacttcattcaaacagattcctctatcagaacaccatcccccaggtctccacctgttgtaattctacctattcttgaaggcccagttcaaaatttacttccaattctctagagttaacttgcaataacagttgttgatcaattccaacttaattcattttacaaatgagtaaactgagcctggaggtcaaggcagctcatctatgatcacacattcccaaagctagccagtttcagagagaagtctacagtccttgctctcgggtgtcttcccccttccccttcctcatcttggccgccagcctccactcccttctgatttctcgtcttctttttccgtagaaatcaacggaacccagatttgccccaacgacctagtggcgttccatgacttctcctcggacctggagaacgtgccacacctgcgctacctgcggctggatggaaactacttgaagccgcccatcccgctggacctcatgatgtgcttccgcctcctgcagtccgtggtcatctaggccctactccgccaccggatctgctctgaccgcacttgaaggctggggcccaggcacctgtgccggccattcgttttctctctctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtctaaagacttggtgtccccttctctctcctcccccacccgccactcctgggtacatctgggccgtggactatctgatcttggtcctggccgagcaaacagcccggaggtaaggttcagaaagtccccctggggactcctccatcttcggcagctctggctcaaagaggccgagaaacccagttctcctgggccaaggatcccttctggcaaagctgctgctccgccgcttggttccccggcaccagacatcgccctggccctgctggcccgggtatcgggaaggaggagcgagggaatgacggaggtagggtgcagggtcagggctcccgcaggggcctgcatctggccagcaggacacagggatgcgcagggcgcccccttctgttccagggtgaacatagcacacgccctcctggctgggcctcaggaggaacagccaaggagaagaatggcccaaggaactaggaagcagccatgggagaggggaagggttcaagcccgggatgggcccgcgtgacgtcgatgggtcctgcggcccccttgcccaacctcgggtttagggaggagggttcacagtgtttttgtgggggcgggggaaggaagaggcagccccgcccccgccatctgttctccatcagtgtgcgcggcccagccatttccaccctcgggaggcggctcctgagaaacagggaggaaggggcggagcacctggacgtctcccagaagcccctccacgtttgaaaatgcgcctcctcctcggagacagacgcatcggtgccacctagtggctggtgggagtaacagctggtcccagtcttgcgcctggccctcttcctggggtgattttcctcggtggaggaggcccgtggggtcccaacacggaagagccatgggccgtgtgcatggtgtcgctctcctctagggtctagcgggcacaaacgtccccaggctgggctcattcccatcgtgagtgagcccaggtgaggacatagtcggctcccgtttgttgtaggcccttcccaggtgccttctcagctccctcatctgtaaaccgaggaggtggataagatgctcccggccgggcgcggtggctcacgcctgtaatcccagcactttgggaggccgaggcgggcagattattgcctgagctcaggagttcgaaaccaccctgggcaacatggtgaaacccccgtctctactaaaatacaaaaaaattagccaggcatagtggcgcgcgcctataatcccagctactgggaggctgaggcgggagaatcgcttgagccggggaggcggaggttgcagtgaggcgagattgtgccactgcactccagcttgggcgacagagtgagactccgtctcaaaaaagaaaaaaaaaagatgctcctctgaggtccctccggcgctcatgttccgagtctgcagctccacactttaaatcatactcgaatgcaggacaagtcctaaatatttgccccttcccttgcagtaatttattttctgtatggactgtccctcccccagaggcttccccaccctccattgcctggcccaggtgagcagcttggcaggtctccaagtggaacccggtccagacagggctgcctcgacttcacctttccccctaacttcctccaagggatgctgccccttctcagccccctgcgtgtgtatattggtgggaggcatagaggatggatgttctagaaatgagtaagacacagtgcccacccccaagttaggatgaaaaaagttccagaggtttttaagaaattggattaagctgggtccctaacttcaagaaattcccattatgctccttctcacctttcttttttgctaattatggaaaatagggcccatttcatcatagcctccttcccccgtgctccactacaatcgccgcattctttctagctgcagctggtttcttcaaggctcctgcttaaagtccacacgttattatggccgaaagcaacctggtgcttcggcctggataagagccccttctgcatcttattcacagcttgcagcctcagcccctttgatgaggccctcaggggagaggtcattaccttgatcctgcaaacccagactcgttgagcagcaacgcaatcaccatcatcccactgcccaatctagaatatgtctgctctcctttgctctctgcagctgtaagccagaggggattcaaggtaaataggctttacaggctcccctcctccaaacacacacagaatgggctggtttctttcaagtttaaaaaaagcccccttctccatgcacaagttcattccctccatgctgtcgtcatcgacatatacaggtgtgtacgtaggtgtatgtgtgtactctgcacgtatatctcttctgtcttgaagaccctgttaactttgtgaaataacttccacatttcaacacacttcacagtacaggaaataaagtaatatgaaaaacaccctgcgtgaactcaacggtgtgaacaggtcaagaataacacttcaaagtcatcttgccagccaggcgtggtggatcacgcctgtaatcccagcactctgggaggccaaagcgggcagatcacctgaggtcaggagttcaagaccagcctggccaacatagtgaaaccccttgtttactcaaaatacaaaaattggctgggtgcggtggtacatgcctgtagtcccagctacttgggaggctgaggcaggagaattgcttgaaccctggaggcagaagttgcagtgagccgagatcgcaccactgcactccagcctaggagacaaaacgagacttcatttaaaaaaaataaaaataaaaataaaaataaagtcatcttgccacccaccccctaccattgagccaccatgcccagccccaaagcctcttaattgctctaacaagatgagtggggaaaagattatactcttaagaaattcctacgaaagctatccaaaagccttttctttcctcttttcttattatttttaaatagaggcagggtctcattatgttgcccaggctggtctggaactcctggcctcaagtgatcctcccaccttggcctccccagagtgctgggattacacacgtgagtcaccatgcccagccccaaagccatttcttgaagaatttctcgcaaactcacaaccctcatgaaaaattaatcctcagttccacgagactgcccacccacagacaaaaaaatatatatattcctaaagtcggaccagaaatctgacagctgcctttgaaacccaaagcctcgggttctttcaagctacatgtactaaattgtcgaaggtctcccaggagctctgtactgaggcagacacagaaagacacaaaacggtcgtctttcctgcccaagtaaagcttacagactaactggggagatgtagtgtgcatacaaaacagtaaaagagccatctcaaggacagagagcatagaccaagtcatctggaatggtctacatgccatgcggaagtccaccgaagggttagaacagggtgtcccagactctctcttctgagggaaggttggttgcaaaagtgggattcatgaccctcccaggctacaccatcttctttagaatgagaactgccaggtgacgccctcgctgctcctacctggctactaaacatcgacttcggttcacttcacggatgttcagtggatatcggtcacatgccaggtccccagctacgcattcaaggatggataatatacatagcagcacatccttgaggaactcataccttggtaaagggaaagaaatccatgaatggatacctctgtgtcctaagtgtttgtaataatgctgtgtgtcaggcctctgagcccaagctaagccatcatatcccctgtgacctgcatgtgcacatccagacggctggttcctaccttaactgatgatattccaccacaaaagaagtgaaaatggctggtccctgccttaactgatgacattaccttgtgaaattccttctcctggctcatcctggctcaaaagctcccccactgaacaccttgcaacccccacccctggccaccagagaacaaccccctttgactgtaattttccattacctacccacatcttataaaatggccccatccctatctcccttcgctgactcttttcggactcagcccgcctgcacccaggtgaaataaacagccttgttgctcacacaaagcctgtttggtggtcgcttcacacagacacgagtgaaactactgtgtatgaacagtataaaggaaagggcttttacctctacctgaggaaaaccagaaagactcctaccatgtgagctggctcttaagggataaatcagattttgccaggtggatgaaagaaaaaaagacgccacctggacaggaaacagcatga

SEQ ID NO: 4 - DNA, 8460 bp, Homo sapiens
ttctatttcatatagaattttatattttaatgtcactagtgccatttgtctaagtaacaagctactgcatactcgaaatcacaaagctaagcttgagtagtaaaggacagaggcaagttttctgaactccttgcaggcttgaacaatagccttctggctcttcaataagtacaatcatacaggcaagagtggttgcagatattacctttatgttacttaaaccgaaagaaacaaaaatccattctatttaattttacattaatgtttttccctactttctccctttttcatgggatccctaagtgctcttcctggatgctgaatgcccatcccgtaaatgaaaaagctagttaatgatattgtacataagtaatgttttaactgtagattgtgtgtgtgcgtttttgtttttttttgttttaaccacaaaaccagagggggaagtgtgggagcaggtgggctgggcagtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggtacagcttcagtttgctactgggttgtgcattcagctgaatttcatggggaagtccaaattctaaggaaaaatatttttaattgtaatgctgttaaacagacttaaattttctagcctttttaataagcagattagatacattgcaggtctcctggaacaaaggtgtctagatattttgaatgccaatcaaatttaaaacttaaaaatacttccactgggtcctcaaaagaacggaaaccaccgatgctaatcagaaaatagtaaaattaaattcccctttggaataattatacctatataattttcagtgggtgactgtgcaggaatttaaaagaaaagggatcttttatgctaattaaaccaattacaatgctattttttaaatgatgtatctcacttttaaggggaagaaaaccctttctgaatatgccactgctaaatttagctgttaaaatattcaccaagatacctgtatgacactgtgtaggcttattattacaaatagaaaagctgttggctattttcaatgttttcctttgaatttcaaatttttagaacatcttacttaaataacaaatttcagagatagtttgatttcacctaagtagcacctacttgataattaagctaaaagtcacatttaaagtacatgttggaaaaatggataaagcaaatttttttcatttttttctgtgagttttttcttctctaaaaaatattcccatactagcttattaatataattaagttactgttgatctgtttgtaggtttagagagctagatatataaggtagtaatggtataatttctggaactctaaattttaaagttgaataaatacagacttgcaaaatttccctttcccttgcctaatagtgaaagatggataataggtggcaatataaatattaacttgaaagactataatactaaaaagaaaaggcatctctaagaagtagaaaagattctatagaaaatatattttatttgtgatcattttgtaatgtggtagtataaaaaggtatcactgttgtaacctatgaagatgtcagctattccttatgaaatattttgcaggaaaactcactaccatgagaattgcagtgatttgcttttgcctcctaggcatcacctgtgccataccagtgagtacagttgcatcttaaagaaaattcctgaaaataactgaattgtgtgcttccatgtgctaggaggacattcttgtaatctttcttcatcttttctgtttctaaggttaaacaggctgattctggaagttctgaggaaaagcaggtaagcatcttttatgtttttatatagttaaatcatttactcaattatggcgagaggtgcaagaaacgtatttgctgcgatattacttatcttctcagtcaaatccattggtttacaagtattgattgactgcctgctatgaatctaggccagtaccaagcacagtatagtttttaataaatataagtttataaaaccaacccagatattttaaatataataatatctaggcatgtatgatgagttatcgcatgtaagataagttatatgaagttgtgtgactttttttccattagtccacatactgatctaaaagcagaaaattccagcttttgctttgtttagtggattgctaagtttaaaattcacattggatattagtcagaactgtttgtatgaccataatattcacaatattgtctgagatattagctgagaagcccattgtgaaaagaaagtctatgtgtgctgtttgtatctattgtgattgtcagctgatgttagatcacattttctaaccaaacataagaccaaccaaactctttattataattatttgaccagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaagtattctgtgttcgtttgtgtgtggaggggtgtgtgtgtctgtttttcaactgatttgaaaatacaggtgttgaatcctaataataaaccagaaaaattaacatctccagagaagatagaggtcatactatttgaggcaagaattagcgtctttttaataaacgaaaatatggcaaagatgcattttagaaggcacgtggagctataacaatttaagaaatacgtgaagagctcaaggctcagccttctagaatcccagaaacttaaagctagtaaaaaattggggaagtctctaaggatatatgcctgaaaatacacactggttatctgtgagtgttaggattactgggtggtttttagtctattcattttgcttacctttattttcttcatattagtttttaaaaattataaatgtaacttatacatccattctctctgagcctgtattacatgtgtcatgagaatagatagatagatatgaaaaagtgaagagaaaaactctgaactcatctggtctcactgtttttccgccttctttttttttttttttttttttttttgagacggagtctcgctccgtcgcccaggctggagtgcagtggtgtgatctcggctcactgcaagctccgcctcccaggttcaccccattctcctgagtagctgggactacaggcgcccgccaccacgcccggataattttttgtatttttagtagagacggggtttcaccgtgttagccaggatggtctccatctcctgacctcgtgatccaccctccttggcctcccaaagtgctgggattacaggcgtgagccactgcgcccggctgttttttcatcttcttaaagcaaggaaccccttctttcagcaaaacctttcggagaagcccaatactaagctcctctggttagagccagccatgagagaaactccaagtacttctgactggttctctctctactcatccaccccttaggtggctgcagaaggaactctgtgcaacccccagagttctcattctcagtgacagggaaatgtaatgattggccctggatgattcagcagatcagatgatacttactcagagcaatttccactcctttgcagtagcatattatcagtattttccagataaataacttggctaaagaaaaatccatttcatttacatctttggcaccttacagcaatagaacttttgtgcaatgattttaatattatatttctacattggctgataagatacatatggctattgagcactcaaaatgtgggctagtgcaactgaggaactgaatttttatcttctttttttttttttttttttttgagatggagtcttgctctgtcacccaggctggagtgcagtggcgcaatcttggctcactgcaagctctgcctcctgggttcacgccattctcttgcctcagcctccccagtagctgggggtacaggtgcctgccaccacgcccggctatttttttttatttttattttttttagtagaaacggggtttcactgtgttagccaggatgttctcgatctcctgacctcgtgatccgcctgcctcggcctcccaaagtgctgggattacaggggtgagccaccgtgcctagccatttcattttaattaacttaaatttaaatagctccatgtggttagaggatactgaattagcacagtcttagagagttccttcttgttccatggactggacacaatgaagattaacagtaattaaggtcacttctggtttagatgtgctttatctgagaggaaaattcagccagcaaacatacaaaaagaaagcacagtgtgaagttcggtgttaagagctagtttgcctgcgtttgaaccctgcctggctctgccatttcctaccacttaactgcactgtggctgagttttctgatctgtaaggtgggaataataatgatacctatctcataggggaatgaaaggatcaaatgagttcatatttgtaaagcaatttgaaagagtgcctagcccacagtaagtgctacataagagtttgttaaatgaatctgcaaaaaaaaaaaaattacaaaaaggtacctaagggtccgggtgactatatgcttccatcaagactagtgaagaatggttgttttttccattcatccctacatttctttttttaataatgataaacatgcaacttttttgtagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataagtttagcattacagaagatgtttattaatgcctgttatttgaaacattaatctgcttgcaatttatttaaggtattttgtagatatctaatatctaataagcatctaattaatgcatatcaaagctaagattttgcctttaggaaagttttctttcctaataaaatagtttatttgacaactattctttttattaggatcattcatatatttgctaagcaaagagtaaatttattttccttaagattcaatttgaatatactaagaatattaaagcaagttagataaattacccaatatatttgtcaatttgaaatttgatagacattagttgtttaattcaatgggcagttttgagctgcagtttatacacacatgcataacagagtcacctttcaattatccatgttaataggaaagtggttatagattttagtacacacattaaaatatggatactcttctcttttgataaatctcatttcaaataaaaaaaccagtctcataattatgtatctgtatctattacatcattgaatttagtaaataatgtttaatatgtataaggaaaaacaatgttattgacatgaagattatactcacatatttggcttgaaaatatctataaaaataatttctgttgcaaagtaagaaatgttcttcagaatgttattaatccctgtgttaaaagagaaattggaagatgctcactttagctcctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgctcaagtctaggaaaccacagtttgcatattcattcattcattcatccattcattcatccattcagcaagaattcattcatattctactttatgaccattgaatacaaatctttttctgcttggcggtttttgtaagtctacataatttctctctagatttgattctcaaacacaattctactttttgaaatcctggatcacttattttcagattaaaataaatggaaaacaccaattatttaaaaaaaataatggtcatgttttgaagttaaatacctaagaggaattgtagttgcaaattacactgaatccttagtcacagaatctggatttgacatagccttgccgtttactattctctttactttttaactaacaattcacttcctctttatgtaggtttcaatataatgaaacctacctcataggtttcattacatatgtaagtgatgtagttattaaactaaatgagatgacatatgtgaaaggccttggtaaagtactatacaaagtaacatgctagtattatttcagccagatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaaggtttattttggtttcaattgatacataataagtgtacatatttatggggtacggtgtgatgttttgttacatatatacattgtataattatcaaagggtaattatcatatccatcacctgaaacacttgtcatttatttgtgctgagaacattcaatcctcttttctagctattttgaagta

SEQ ID NO: 5 - DNA, 6163 bp, Homo sapiens
tttccatcaaaataaaaaaacaacctaagcagtgattttaaaaaccagtggtacccccaccccacctcccccatttccagtggttggaaagcctgagcaacagaaaaaccagaagccagccttggagaagcctaaataccatcaaggaatggtctaggccaagtatgaccctcctatcctagaggcaaggggcagagaggtttgggaaaagggcaggccctggaaaccaggccccaacacgagggtactgggtaagggaagagaggctagttaccccgtatcctaggtcccctttaatcaacggataccagatctcatccatcctcctccctgcaccaagcttcccccatatcagctgctctggctctggcacggctggggtttggttcaatgtgggttctggtttctccttccacccctcatcacagacaatatcctgtgccaggcagcttggagctcaccctgaggccagagctgtgaccctgcctgctcaccctcccctttccacaggaatccggacatcgtggctggcaagtgggcacacagaaatctggcgggctggggcgggactgcccacagaacttagggtctggcagccagagccgtccagggctggtccctcgacctgccccaccccctcccgcacccctcctcacagtcctggggccaccgcccgaatgtggcatctgccaagtacacctcggcgccactcagccgccaccctgagacccctcaggggcgggtcctgaccactagggttggggatgagggatggagatatttcggggcgatgaaggaggggggatggtgcgactgtgcttgtggcctgtggtttccaggtgtgtttgccattcctgtgggccactctcccccacttcccacttctctgcttagccttcagcggtggaaaaaggggatgagggcgccggcgacagaaacgcaagcggggttggaagagaggggtgggggcgcgcccgagggtggggaaggagctcgggtctacccagggccagcttcggcgcgtcgagtctgaagtgggagaccgacgccggggcggctctcacgctcggcaggcgccgcacaagcgcccctttaaagcgcaggcagctggcccaccgcagggagacgcatccagctgtccggccccgcttcctcccgcctcgcatccagggcacccggccgagcgtgtgtggatggcgcggcgtggaggctcaaacctgagcaaacaaataagttgagggaacgcctccctctctccgatgtaaactcggggctccagacataactattcccccttcccagaaaagccccgggaaaggcggtaggcagaggagcaccataggagagcggggggctacagccggggctcagggctcggggctcgggggccacggtcccaccccctcatgcacggtagccggctgggggaacggccccgcccccttccccgtggagggcgggggcgcatctctgggcgcgagcgagttaagcccagtggcctcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtgctgcgcgcaggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcaggcgccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaaggtgagctcctggctgtgggctctgccctggttccttcttcccttcctggaggccccaggagccagggccacagctggcaccatcccccgtccccaggttccctgtccctctggctatctccaaggtgagcagctctgccacctcccttcctcgccttgtcacatccctaccctaatccctgtctgctgccagtctcgaccactgccctcctaggattcttacatataaaaggagtgggactgccctggccccacaaaaggccccctagggccatctccagtgcttccaaacccccaactgtgagcagcagccacctcttcctgttgggccttccacccctcctctgctgtttttcccgtctccagtaaacctaccaccccataaaggaaggtttgtttattgaggagccttccagaggagctgggcagatcaggcccacaaagagaccctgttcctggtgggggctgtgcatgtgtgctaagggggagtgggggactggggagtgaggggaagcaaatgcctgaggaagacattctccatgccccatagaggccctggtggatggccctgcccaatccacacagacacaattcactgcattctcaagtccattgcagctcagtaggcgtgggaccaagggctcccccaggatgcaagcatcgtgcccatgggctccgtgaaggggcaaaggcaagaccactattgtcaatccttggcccaagaccccaggtgtctctccacagagaagactggcgtgactcactgtctccagactgctaactgccctttgccctcctccgtcactagacccatctcctgtctgcatcctcactcattcctttctcccctggggtgcccagtgtctggccaggtggggctaccttggatcagagcagaatcccttctctgggactggaaaaatcaccctggtacaggggcttcagccaggaggtttgggtggggaaccaacaaggtagaggagagtctggttactggagaccttcatacctcaatgtgggccacaggaaagggtgcgggtgtggagatgtgggcagaatctcacttgggcagcagccaacctttgtctgggtggaaggagcctgctcaagcctgcccttcttcagccctgcctctccccagctgaagttggagtcccctgtggcccaccagtgccagagtggtctttcagtgggcagcagagcagcgaattaggggctggtttggggcaggggaggccagacaggaattgtggcgcctgggcaaaggtgtgggcaccaatagaacatttcctctggagccgtccaacctggccaaaggctccaccaaggtggcttcacaaatagcgtctggctggcagtgggggagcagtgaggacagagctgagggaagtcctgggaccctgggactgtggggagcctgggcccactgcccactccaccaagcacagaccaagttcaccgtgtaccagtttggattgctggggccaaactctggcagccccacagtcccagtgtttgtgcagggattgtggtgccaggggaagaggagctgggtgtggtcctgtggctactgtttacccactgctgtgacccagggcaaaggactgcgctttttccgtttccccatttgcatattgaaaataacaccacctggctgggcgtggtggctcacgcctgtaatcccagcactttgggaggctgaggcgggtagatcacgaggtcaggagatcgagaccatcctggctaacatggtgaaactgcgtctctactaaaaaaatacaaaaaaattagccgggcatggtggcgggcacttgtagtcccagctactcaggaggctgaggccggagaatggcgtgaacccgggaggcggagcttgcagtgagctgagatcgtgccactgtgctccagcctgggcaacacagtgagactccatctcaaaaaaaaaaaaaggaaaaaaaaaaaaaaaagaaaataacaccatctgtctcaaagggggttgtgtagattggattatctgagatcacttggtcatactgctttgaaaactgggaaactcctcaaagtgctatggctcaggttcagggaaggatcctgcccctctggcactcgggtgcttactcattcactcatgaccaccttgctcccaccttgctcccaccttgctccccagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtaagaacacttccatgtcactcccagagcccaccctcatgtgatagaggcacattagccctgcactaagacatgttggacatgcatcctagatctgctacctaataagcatgggaccctgggagcctcagtttccccatttgtaaaatgaagatgacagcttcagactatcctgtggccaagtcaatcctggccccatagttcactgcccttccccccagcactcccaccttcttccccagccccagcaagtttctgtctctccaggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggtgggggccaggtaaacaggtcccctatgtccctctttggtgattccagcaagtgagctggtatcttccaggataccccctggccctggagggtcaggcagaccctccatttttacagagagaggaggggacgactgggtcccctgttgaagggaggaaaaggtcctgcccaggacttccaccattttcttcaagcatcatctgtgttgttggagtactgacatcgatctttgcctctttgcaggttctgacccagccagtcctggtgactggcctctgccttccaccggagagactactgaccttctcacctccacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtattatatttactcccctgccacctatctccttcacccaccaggtgctgatgaggtcagactatcttttctcacatctgctttctggaaggagggctggctgagagggtctcctttgaacatctggcctggactcatccccatgtctgtccatctgctgtcatcccaggcctggcctgcccacagcccgggccgcagtcacca

SEQ ID NO: 6 - DNA, 57423 bp, Homo sapiens
tttcctgttctagcgctggattacaactgctggtctccctgcctgccttccctgcttcccagagcacgaagaagcttgcctccgcaacccactatttgtgtgaccttggtccaggaactggactgggctctcctcctgaaagtgggtaaataatgtcaccgacctaatgaggctgttgaggcatggaatctgatcaggcagataaagtgcccctggcaaacctcaattttctgtttctcaacaaagctttggcgacttataagaatttgcgggaaagtgtccagaacccggagtcaggagccctgacttctagccctgaagggccgcgtgaccttggccaaagcccctaatccttctcagtctcagatccgggggctggaaactgaggaggttctcccggcaagcccctcgggctagtgacattctaagattccaagagctaaggagctagaggggtggggtggaggagggaggcgggcgcgccggattggcctctgcgcgccacgtgtccggctcggagcccacggctgtcctcccggtccgccccgcgctgcggttgctgctgggctaacgggctccgatccagcgagcgctgcgtcctcgagtccctgcgcccgtgcgtccgtctgcgacccgaggcctccgctgcgcggtgagtgggctgaggctggagaggggagtcgctctgggaaccccttcccgggggctgcagggacacaagaaataagcgcccagtcatcggctgatgggtaccccccgccaggagcagggacgggagggcgcggtaacccgagagtgtcgcagactgggtgtgtctggggagcgcagcggagcaaatctggggtcggggcggagaggcgcgggcggagggcgccctggctagggggaggggagggagtcccgttgctgcagagggtctggttgagggtcctgggcgccggagctgagccaggggctggtcctgccggccttaatttgggggggctcaagagactttgaaggtccggggttggggtcagctggacgccagtcaaaggacccgcagagaagggtgtggctgaggcccaagactgagagcaagagcgttggaccctccagctgcttataaaatggcttgtgtgtggtgtcgggggagggctgcctgcgtgcagagagctgaacgtccggtcgtacatacctcagggcctcattggaccccatcccctttgggccactgcttgtctatgaatgcagtctcccaacggggctccgaggcctcctatggtgaggcaggggcactacccttctttctgcatcccctaagcggtctaggccttcccaaagtttgggggcttcaaataattccccatataccagcatgggagcaaaataccctgaatcggaatcccagcccctgttgcagtgtgactttgggcggtggctttccctctctgagcctggatttccttctccaagtccatagttgagaaacccagtctctttcaaaggaaacaatggctttgaaaactgatttatttgtcagctgtatggaatgattgcaggtttgggagtcttgattatagatttgggaagcctggcacaacccttgtaggccctacaaggggaaagggcaggaggtcctttgggacaactaatctggccacggcttcctgcctcctccttcctttccctagattctagtgggtcttctctgacaattccaaatttggacatatggctcccgggtttgtgaaaggactctggtttccccccaagagtccgcccttttccctccattattccttcccccttgcccaaaacatgcttgggattgcttccactgacccagatggcatatcctgacctgcgtagcccttcatggtgaagtgaatgaccgccccagtttcagcccctgtggaccctgacctcctagcaggcaggccctgagccacgccgagggcactggcctggggtcagaggaaagcccggttacagtccggatgtgctgggacttcttgagcaagccctttctctaaggctttgtgccccatctggagcaaagtctgctgaactggctgccactgccagtgcagacattctaggattcaactgttctaagatttaggattctgggagttggatgggactggggagggcaggaggcagaggctttcatccccctctgcagctgtgacaatcactcatccatctttctttgccttatctaccctttgttcctaaggcagcatctgctgagatacagaaaatacttgcagtttctggataagggccacagctgttgctggggcaaaatgtagatgtgagtgtgcagaggaggggccagggaagcccaaggcctggcctcttgagactgactcctgggatgaagtgggggagactgcagtgctggatagctgccagtgactggcacatccgcactgcagcatccagagggagccctgggccaccaggatccagcctcggacccagcccctgccctgccactaatcagctaggcgccctgggcacacctactacccctctggggcttagccccttcctctctacagggataggacatatacccaggacaccccactggtattaataaaatgggttgggtctgaatggcttttgctctaccattctaggattttctggggaggcccagtggaatcaccagcctcaccccacccagcctctccgatatacttcctgggtggcgacaaagcacaggatgtggtctctaccgtgattcctgagcatgcatgcaccccttctcctgccaatagaggggaggaagtcggaggggtgtctttatgcctataaacttgccttggaatccagcctcactccctttcctcctggagttgagaagcccccacagagactggctatgggggagtgactgtctataggttccttggatgtcctgcctatctgcaaaatgagaatgagatcgataccttcatgaggctgtaagatggcagatataaaagtgctgtgttatctcaaaagggtgtggtgcttgagaaggcaggcgacctgagcctcaagttcctcttctgaaaaatccatgtcctggtggtccttaaataatagcaataaaatggtaaccactattacctctcgaacccttaaatttgccaggccccggctgaagccttgctatgttagacgctgttattaatgcctattttgcagacatggaaactccagcccttaacagtttaaggaagaaataataatgacaaatgcttataaaatatagtgcttcctgtgtgccaggtcctcttctaagctctagacttgtcttaattttttttatcctcatcataactcctatgagggaggtgctatttttatcccttttttttttttttaatatgaaacaggcacagagaggctcaatacttgcacaacaccacacagctactaaatatcaccctcaggcttcaatctcaggcagtctggctccagcatctatactgtgagacactactttgctgcctctcacaaaagtgacccaagctggggttcaaacctaggctagactagttccaatcctgaggcagagagatgatctcctgaggccttgtccagtcctaggatcaatggttctgggtcaggagaggaaaagacactgctccctaagaaaccccagtcgtcaagctggggggtgtgcccacgcacagagccagggaaggcatttaccccagcttcatcagaatcaaggctcctggagggttatggagcgggtcctgggtgtcttcctgcagaccgggggagaagccagcaagaaagggcaaagagggaaggatctagattttataggccaggggccttctaagtgggatggatataccccaggacgcactgaagatgatcttttgggggtacaggaagaaactattggactccttattaaatgtacttttaatgtcatattttaaaggtatatttctgtttatcatggtaaatactcaatttttctttggttatgggttgtgtatgggatcaatatatatatatatatatatatatatatatatatatactgcaaactgccatatgacatcaccttatcaccagctttgtggggccaggagccttgtctgtctcattttctgttcaacccccaacttctaccagtgggcctggtttgtaggaggtgctcaaataaatgtttatggaaaaacacgcccctgcttgatgactgattttcttctgatgttgggtaagtgacttaacctctctagtttatctcctggctatagaaagaggagtaaagcacagtttgaaaaccaatagtagatggttccatttgctgaggtcactaaagaaagcatgaaagccacttagtgcattttacccccaaccatccataggagccacgccctatgggagggggtgcaggaaagaggcatatgcagtaattttctaaaaagtgtaaaattatgactcatgcagatacaaaaatgatcatgtgctgttctacttattaatcaatgaccacaccaggccgatgttataaccagctcaaaagacacatttgtattgaaagaaatgtgcaattagagacaaaactctttttttacctgagggggtgggaaatcaattggacctttacaaaatagggcaaggagtatgtattagaattactttgtgttaccatcaattatttgcaacttactgacctgtaaaatcactcaaagacaatgaaagtctcgagtcagacaacctggagggttttcctttgaagtacagattctttcccataataccttggaggctggcagcccttatctaatggagaaatgataaatccacagtggttgaccaaagccagtcaaatcaaggtggtttcagagcaccctagcgggggaataccttctggcttgttagaaaaggcggcatttgaatccagcagataacagtggttctcagcctccttggctgccattaaaatcacctaggaaagtttttagaaattaccaaaggccaggcctcaccccagcagttgagtcagaatctctaagggctgaccttaaatctttggtagttttgaaaaattccccaggttctgttagtgaagctagaattgaaaagcactggtatagattctggaaagctggattaaaaatgttggtggaaggcgttcctggtttagcagggaagacagggcaaagaggaaagtggtgatggcaaagaagtcagtaaggagaaccaatggcctcgactgctgagcttagaggcccagtattaaggggcaccattggagacttgtgagcagaggagtgctgtggctcaggctgtagcccctcaggcactcccctgaggcagaggtctgggtgggtttttttgcatgattttccatattatttcttttttctcaaatcaccctcccaccacacctggtttcacccccttacgctcaacatctcctttccctcaaaagtgtactctgttcctccacagcccaagctacctttcgatgacagaaatgctttttcttaccctggtgttactattcttcctggcatgcccctgcctccattccattgaatccagattttgactgtgcacctctatcagcctgcacccctaatattttctttaactttatacatgtataacaaataaaaatgggacataaaagggcaagattaaaacatttggaaagtggtgatactcttgtcctgcaccccagtggattgtcatacccattacccctttttggagactactgctgtaataatgatgattgtggcaacagaagtcaccgtttgttaaacatttaatctgtacctggccatgctaagtgttttacctgccttatttcattgaatcttcacaaaaaccttacaagagggtcatttcaggatgaagaaactgaggcagagaaattccataacttgcccaagttactgagctcggaatttgcatggtcaggatttgaacttgggcatcgaccacaaatcctgcattgattctaatgccacattgcctccattgtaaatgtttgggcttattataataaaagccaccatttattgagcctttactgtgtgccacgcactgtgctaagtgttttccccccgttacttcatttatttctcagtacctataggtatttctatctgcattttgcggatgtggaaattgagattcagtttaagtaacttacttacatcacaaactgctgggcaacatctgtgcctgaaggcccatgccttcacatgacttggataaaacccttcccctatccacatctctgtggttgggcagtggtgagccgttccttctagagtcagcctggaactctcgaaggggaaggaggaaaacgtgattgattgcaggcaaaaggatgaggcaaggggtggccacagcagcacaaagccacccaggccattcattctgctcctgtgtgggtttcacgaatgatcagtcatgataagtcgtcacagtatatctcatctagatctgagagaatcagggttcctgggaggaaagaggcacaggtctggaatgaccctgtttactagtcttgaacagctctttcaaccaaggtgatgaatgttgcatattggcgggtggagatggggaggaatcctgtggcctgggagatgaccctcctaggactgatattctgctgtgaaaatcctgagttgaagtctctaaaagcctctaactatagatcctaccaaagagggagtgatgtattgtcccactttagagatgaagaaactaaggctgagagagggatctggcttgcctgaggttacatgggggcagactgggaaccagaaccagggtcttattctttggactcttcctggtgtcccattgcagccaagacccacagttgtgtggggacttgttatgatcgagggctgctaggcagagatgttggctgcttcctgggccctggcaagtcactttctctttctgagatgcctttaccccgtctagaaaatgagggacttggagtcatggattattaagggcccttgtgggattcagaaacactagatgtaaaatattcagccaatttgagcagtatggtctaggttgctctgggagggatcagaagccatcttaaagccagggtaaatggtgtgtttatgattagctcaggagcttcccagaaccctcagaggcggggctgtggaatcagcagggggactggccctcagaactgcagtctgaacatctagttctggaaggagcttgctttttacatatgaactgtgcactcacacaaggcacacagaaactgctctcagagctgagaatattttcccaaacagtaagaggcccctccttgaagccatctctccttggaaaggggagctcctccagatgggcctgggctgcagccagcagctgaaattgccagcaacaagcccagaggaaagtgcttcaaggctggagatgcaggtgacaggcctcagccctccctctgtctgtgtcaactaacttcctgggtctcattcagtccctggttctctgctagccttgggcttccttcactgtctccccctactatcccccaggtcagaggaaaccgagagctggcctccagcctcatcccggggtagatgtgggccccctcctccccccaccacacactggaaagggggtacagtttccatttcctggtgagagctgcacagttgtaccaaggggcccctggttgccagggaaacagcaaggtttcctgaagctgagctgagctgagctgcatttgcaggcagatccgtcctctgccttccactcccaaccccatatgatgactgtcctcagctgactgcagcttggggaactcataatcagccagtgaagacacagaggcaaacacgacagaggccctgtcctcaacttcccaccagcacagtaaatatcaccatttactaagaacaggtcttgtgcctggcctcttatgtgctgcctttgacataacttaggtcttatcctccaacaaccctacaaagcagaaaagggaaagcttcagttttgtgcttgagatcaccttgaactcaaaaatgagcaataagcccacggtcacatggctaagattttccctaagtcttgggggaacagggaatatgtggagaactggaaggcattgagctgaaatgtctccatgatttctactctcctagttctgttccttttaggtcttactgggtaaatctgattgactttgttatgtttacttttttttttttttttgagtcagagtctcactctgttgcctagcctggagtgcagtggtgccatctctgctcactgcaacctctgcctcccagctcaagcgattcacctgcctcggcctcctgactagctgggactacaggcacacaccatcacacctggctaatttttgtattttttcgtagagacggggtttcgcatgttggccaggctggtctcaaacttctggccccaggtggtccttgccgcttggcctcccaaagtgctgggattacaggcatgagccactgctcctggcctctgttatgttcacttttaaaaagcaatacatagacattgttaaaagagatcaggccaggcttggtggctcacgcctataatcccagcactttgagagactgaggagggcagatcacaagggcaggagttcgagaccagcctggccaacatggtgaaacccatctctactaaaaatacgaaaattagccaggtgtggtgccgtgcacctgtaatcccagctactcaggaggctgaggcaggagaatcgcttgaacccgggaggtggaggttgcagggagctgagattgcgccactgcactccagcctgggtaacagagcgagactccatctcaaaaaaaagagatcaaattgcccagacctgcttaaagtggaaagtagtggtcctttgtttctcttctccttctcttaagaagattgttaaactttcatctgttgccctcctgagtgctcattagccagctccctacctgcttctcttatacttcccaaatcagttacatctctttttgcatttatttttacgtatcatatctttgttccttcactgtagaccctgtctcctgatatcctccacccgcattccttatccattttcaatgagatatgtgtcctgttttcctgtgtgttcctgtctttttttttttttttttttttttgagacagggcttgccctgtcacccaggctggagtgcagtggtgcaaccttggctcactgcagcctccacctcctgagttcaagcaatcctctcgcctcagcctcccaagtagctgggactataggcatgtgccaccatgtccagctattttttttttatttttttttaatagagatcgggtctcactatgttacctaggctggtctcgaactcctgggctcaaattatcctcccacctcagcttcccaaagtgccagaattataggcatgagctaccacgaccagcctgaaaaatccagtctttacagtggcctcaggcaccggtctcagatcctacatcctaccacaccactccctgctaccacaccagccacactgagctcgtggtggttcctcacttgcaccaccccgcggtgtgccccagtcacactcgtgagatcctctgacccctccacctgggactacaccccttgtcactttcctgaccaagccttgtcttttctctgtagttcttatctcagcctgatgagtgcatttgttattcattcccattacagcataagctctagagaaacagaatttaaaaaattgctcatatttctgcatgcacagtgcccagagcaatgcctgactaggataggcgctaaatgagtgcatactcacttgttcaggaatgacagtccttcagatattgcagcaggtggttggaagcactttgagtcctatctgcaggcggtcaagctctgggttctgaagccatccttgttgacttgaaaagggggcatgcatggtgcagatagtatagactctgggatctagaaattgttgaattcagttctaagctgtgtgatcttggctcatttattgcgatgctccagcctcagtttcctctctataaaaaaggagaatctgatgtgtggaaggatttctgagagtagtaactgagacggtgctgagacaggtaccctgcctagtgtggaggagtcaaggggtcagtggtgggtcagtgccatgcccgccctcccttggggatccgcgtccctttcccatactgctgtgaatgtctggacaccatctagtctgtccattgtcttctgaaaaaaatgtgattggccttgagctgggtcattgggtctgatttaacctgaagggctgggggcagctggaaaacagcagagggaggaaatgtaagggaaagaaaggggatggttagagttggggggaatctcacatgctgtctttcttctctacagtggattctgctgcgaaccggagaccatggccaaaccagcacaggtaaggggcctctctttcctgaaggtggtactcagccttctctgggcctgggatcctcctggagccactaggcctgctacagagacccctggtaccttcagcttgaaaaaaggaggaaaggttcttaggctttgcttgctcctgttacaagtcatggctcttcagatgcaggtcaccataatgtaatataacccacaatatcctaagcagaaaaggatgtgtattggcttatctgacagagaggcccagggcttcaggtctggttgaatccaggggtttccaaatgatagtgtcaagattctgcctgtgtgagctgggcttcttccggtggcttcattcttgggtaggttcttccttgcattggcatggtagtcatcagcagctccaggcttccattctgctgtcttggcagcccagggagaaaacaacataactcatgcccagtgattccaggggaaggcccaggtctggttctcattggctgtgcctgagtaacctgttctttcttggagcaaggaggtggagttggtcccacctgaactgtttggcctgacgaagggaaatggatacttgacaggtagaaagacatccttgttgacttctctgctctggatatagaaatgttctctgtcacacccatttgggattgaatttccttggcttgggagactctaacctcagtctctcatgtctgactgttctgccgggcaatagaattggaggcacctgagaacttttactcccatgtggctgagactaggttctggccatggtcagaggtaggattctgacctcgactgtgctctgttgaggctgggcacggtgactctcacctataatcccagcactttgggaggctgaagtgagcagatcacttgagcgcaggatttcgacaccagcctggacaatatggcagaaccctgtctctagaaaaaatacaaaggtggcatgtacttgtagtcccagctgcttaggaggctaaggtgggaaactcacctgatcccaggagattgaggctgtgatgagctgagatcatgccactgcactccagcctgggctacagagcaagtctcaaaaaacaaaaaaccccactctactctgttggggtttgcctgagggtgctgtctgttggctggcgttggagaaagccatgcagtcagtgtgacgatgggattggcagggagaagaaacttggggatcttgaagaaaatcatgggactgggccccgttgtcccttactccaacccagaactactggccacagaatgcacagacagaagctgtctgtgaggtctttgggcctcatgttccccttacggaatggttgaattcagtaataataaaactccatccatccttgacatcatgactgcccccagtgaacctgggcttataggatattcacagtttctgaagagcacaggatgttataggatcagtaccctcagagaagtcctagctgtggccttcctcacagccactgaggagtatactgtgtgtacaagtggcctctctgaccaggaggagaaaatgttactgattatgggcaaaaatccaaggtggaactttcactgttccccatttcctatgtgtagtcatactagagctacttcctgaaaggcatttgaactgcaggattctagatgatccaagtggacaggccaggccctggaagatcagagaggccaggacctagggtgcagatctttggaccttggtccagtgctcctgggccatgccttctgcctggctgatctgtggtttcttgttgccatggactagggttcagtagacctcctgcaagtgagtcccagggtggcagggccttagggaaccctcctcctatgggatgagttggcaccctccatgcacagtgttctggtggggcagtaaaggagctctggggcatgcaggagggcaccccacctaggttgaggagagaggggaggctgcctagggagagctactcaggggaggaacaagggggctcagagtggtctaggcagggacaactgggacagaggctagaaggagagcaaatgcagcgtgctcaggggagtaaaagtaatttggtatgcttggggtgcagtggtttgggggagaggtgagggttgcagaagacaataacagagaaatgtgaaaaaagcctccctgccgttgagctgcagttgttccttccagttattagctcggctttcaattattagcttgaatctggtgtcctccaaaactccaacacacgcacacatgcatgcatgtatacacacgtgtgcatgcacacagcaaactgctccgtcttctctggcctagacaccccccagttccttccactgtggttattgtgctgttctccctatctctccttttggaagaggagaacttgaggcccaaagacatgaagaagtaggatggtgccatggaagacccaggaggcatggcgctgtggcctccatttcacagggacgttctgggtttgaatgcaataatgaacataaaaacaccttgaggacagggcaggataggcaggtgcttgtgcctgggacttctaggagctgtggaggtgagacctaggtcagcaccggccaaggcagctctcagctggagtcctggccatgtacctgtctctctggggacatcatctctgctcccaagaggccactaggactcctgctccagcagcagcctgggtggggcccagccccacagagccccagggcccggctgctcaccagctggcaccaggacctgctgaatatttcagggtggaaagtcccttctctgctgtcccctgccttgatcctgggttcccgcagccgggaacctgtctgccggaggtgtgacaggcagtcagggtggggtgggtgaggagaagcctgtgtggttgcacaggtggcgcttagagatgcagaattcatgaagttggtgtgagaatgacacggtgggaagcctgggcctggatgatttgaggggctgtctctgtatctccaaatgtgactagtgctaagccccccacctttgcttctagtggctatgatcctgtggggtcccaggacaactaatctagtaggtcatcacttggaaggtcttattagtcccgtgcaaagaactgtgcaggagcccgagcttgctgctcaagaagcttgtctctaagtgagcgtttggatcaaggcttgtgtaggtcattaagcacccttcccccagcatggcacttcagccccttctccagacactgctgtgaccacccacattgtatgagggggagaacagtggagggggaggagcagcaataggaaattggggtctgcgtgctgcctcatcctccgcccttcatcctggggacatgcttccctcttctccgcatcccttcccggcagcttacaatcccatgactttagcgactttgggcatctaactgtgagctctgaagaatcagactctatcttaagtacttgtcaccgcccacacacccctgccccagcagacaagttaaaatagtttctagatcccacatatcaaccagacaggtatttgtatgaaatacctgtcacatgaaccatatgaaatctgctgctatttgactgtttttaatctacatacaaggcaagttacatggctcaacgtagtaaagaatgccagatactagggacagggttgtgagtggtcagctgagtttaatgggtaaggaaaaccacactaggatgttagagtcttgcccttacccaggtcctgacttaggtgttgtgcccaggccagcccagcagggctagagctgcccttacaagagtctgaattgtttatccccatcatcttctccagcctcatctctttgccttccccgcttctagtggatgatcttagtgacagccagcatctgctctgagccctgcagactctgggctggctttcccgaatgccccttgcttccctccaggtctttgtcatgtgtctcctctgtgtgatgccttcttcctcttcgccttcccctccctactctactccttggggccagcctgttgctcatccctcaggactcagcttagacgtcacctccagaaagccttctctgatctgcttggaatatattcgcagtcattcatccatccatttatgaaacatattcagtgagtgcttgattgctccaggccctgtacttggtgctagaaatgcgtcagtgagcaagagagacacagtccctgccctcccggaacttcgaaaggaaatatttcctgggtcccatgctgcccttagcatcgtatctgccacactgtcttgtagttgaagctgtcatgtatctctaccagattctgagttcttagtggtccctggtcctaagcatctacttagtagactctcagtaaatgttgcttgcttgcttgattgaatgaatgaatggtagggtagccctagctgccctggaattgtgagtatctgaatgtgagaagcacttaggatgctgtggattggacagcattgctgcctttttatagccttgaatatagggtcgaaatggcatagaggcaaacagcacagggcaataactcaaatgcttcagtattcaaggagaggggcaggctggcatggttgaccaggaggaagcagtgggctatgtggtggttgtcccttcttatctccagctcccacccagatggaatctgaggggaagggagagatggtctgttagaaagagccttggattcccttcccagctgggcctctgacttgctgtgtggtcttgacatgtcacctgccctctctgttctgggtcttctgggacacaagtggtaatagacctaccttcctcatttagttctcagcttgtggttctcaaagtcctttccctctcttattccaagtgagccgtgggagggacatcctatgactgaagtggattggagactggtgctgctgtggattaggacaggttggtcagacaggtggaaggaaaaacagccatgaatcatggcaacaggctagcctgcagagggcccggacagaccctggaggacctgcccctggtggcatctttcaaagcttaatatttccacactggtcccaggaggtcctgacattggagacagcattgctagggatccagtgccagggaggtctcccttcactgtcttccccttcggcgtcctccatctcagagcttgggccgtcatgggtgtctccatccattcatttagcccagtcacagttacttccagcctgtatgccaagcctgtgctagagctggggctccacggttcttcttaggcagaatgatttgtcttattcacgacagtctccattctccatggactcaataactgagtgggaagctgaactaaaaggtctttaaggatcgttgcaaagaaataattttgagcctctgaaccttcttgtttcctttttttttttttgagacagagtcagtctcattctgtcgcccaggctggaatgcagtgatgcgatctgagctcactacaacctctgcctcccaggttcaagtgattctcctgacccagcctcctgagtagctgagattacaggtgcctgccaccatgcctggctaatttttgtatttttagctgaaacagggtttcattacattggccaggctggtctctgactccctacctcaagtggtctcccgtctagcctcccaaagtgctgggattacaggcatgagccactgtgcccaggcacctcttgtttctccatccatcctagtagctaatattgcctgctgtgcttttttgatatcgctggactggaggtgtccagaaagaaagagaaaaggatttagaagtgaaattcctggaggaccccagttgtttcgtgttcttgttcattttattcatgtggcaaatacttgagtatttggtcaatctctgtgcagtgggcagatggatctggtatctgctctcagaggtttctggatcaaactgcccaccggggtggagaaggcagcaggaatttctcaagctccggccgtgaggtctgaagtaaggccaaggggagcgctggcagtaaagcccccatcctgcgctcactgagctccttgcaaggcgccctgctctgggtattcggcatgtgttactctttaagtctctgcccaggggcgtgatcaggttgcaggggattcccaggtggcaggaagagagctgtgttcctttctggtcagaactttaaatagtaactccacgccgacgcatgcatacctcagaggagccagcctctgcagacagagaccagagagcatccagaggcctggccggggtcctgcagtgcagacgttgggaggcacggagacggggagagggggaggcggtccaggactcactctgctccacctctgactccttgaaggcaagatctgtgtggcccaccctccattccctcttttttggattctttcctgatttcccgcagctggatcagcctctgctgttttcccacattaccttatttttgtcttaatgtatttactacaagctttatagtaattgatgtgcttgtctgtctctgccactgggccaggagctcgtgaaagacaggaattgggtcccctttctccccaattcctcagccattagtgtagggcctagcacaaatgaagtgccttgtcactgtgctgtgtgctcggtgacaggctctggcatcctccactctgccagctctcagctgctctcccagaccccccacttttcagtgccatgtaactgacccacatctgacttctctgtgaaccagtcccattgtgcattcaggttcaggttcgatgtctaagatcccctggctctctgccgcttctctccttcccctcaaagaccaagccagcttgtcctcagatgccagttcacagcgcagtttactgggcccagaggggcagtgccttgtcttggcattgaaatgagagtgtctctgggccccctgtgcccaggaccccaccctcagtagctggcacctgcaaggttcctggagctggagagcagagcggggctggagagcagagggaaaaggtctgagttctgtgtgacctcccacaagtggctcttctttgggcttggcttctgtgatagaaataatcttaagagcgtctacaaatggctacactaatgacattcacagaggtgaaagtgtaaacataaaatgccataaaaatatgaggggctggctgggtgcactggttcatgcctgtaatcccagcactttgggaggccaatgtgggaggactgcttgaggccaggcattcaaaactagccagggcaatagagtgagaccccatctcttaaaatatatatatatatatatatatatatatttgactcttgctattcttgcagggatcattttcatctcctatactcagccaggcttttttaccctctcctggatgctttggaaggtggtgcagggctgcaggccttggccaagcccccctcccttggggaaatggcactgtcctttgggcgggttgcagcaggtggtatgggaaagtcatccacaccgctccccagggtgtatgtggccagcactggattttgcagggaaagcagctcagcctggaccagggtaggcatctgacctgaggttggggctgggagcttggtctcagtccggggttggcagctcaccctctacttttttctccacagggtgccaagtaccggggctccatccatgacttcccaggctttgaccccaaccaggatgccgaggctctgtacactgccatgaagggctttggtgggtgccaggcttcatgggagcttgaggggtatcccccaaaagtagacacagcccagagcccttctggtggtggtggtagggtctgtgaaatggtgaagtgcacttattcatttttttggtctcctctttttattaattttcatgatgttataataaaatgtttcagaaaaaaagtataaagaataatagaaatttcacccatagatttaccaccaaatttaagaactagtgcttcattagcatagttgaagtttccttggtagatccccctcctgataatgccgcccgctgcctttgcccagaggcagccacaatccgaaggtggtgcttatgttcttctttgtcttgtggtggaaagaaccctgtactgggtgttaggatacctgggttttctaagccaggttcattgtgagaccttggacaagttcttgcccctctctgggccttaatttcctgatttgtgcagtgaggagctggatcaggggccttctgagcacagatattgtgtgtgctgtgtccactttcagtcgtgacttaataaatccccatgaccctctgccctgacaccagcacctgatgagtggaaggctcatgctgaggcctgcagggagctactaggcctgtgtccagggaaggaagtggccctggtgggcttcctggaggcagggtgggtaggatgatgattgctctcccctattccaggcagtgacaaggaggccatactggacataatcacctcacggagcaacaggcagaggcaggaggtctgccagagctacaagtccctctacggcaaggtaaccacagcaaccggagggcccatggggtgcgggtggaagaatgatttcattcacctgtgtgctcgttcaggttatttcctggatatggcactccaggttagcctgtgggctgacaccttaccctgctctttttcttctcatcagctgggcgtctttcagcctttaatacacccacagcacctgctgtatgctgggctcgtgctaggtgttagggctgcactagtgaataagatgggtgaggtgtcaactctgtggactgccagatagtgagagagatacacagtaaacgaggaaacagacagtggtggggaagtggcacagggctgtggacctgaccctgcatagccgtttgctagcagcatgacatggagtaagacctctgttgtttctgagcctgtctcttagggttggtaacagtacatacctccaagggtgatgatttaatgagattacttagcccagcacctgccagagtaagtgctcattaagtgtaattcttaccgttgtaactactcttcctctttcctcttctatctcctcttcttccccacctgccaggacctcattgctgatttaaagtatgaattgacgggcaagtttgaacggttgattgtgggcctgatgaggccacctgcctattgtgatgccaaagaaattaaagatgccatctcggtaagaagtgggggtgtatgtggtgttggggtggggatgtggttaatgggaagattctgggctcttccaaaagcaactggtgagccccatacccacccagcacatgtgtcctgcttcaaagacacatctaaatttatcccagaggagcatcccgatccgcacacagagagatgcagacagatgtcaacatgatgcagacccccttaccaggagcttgtagtccaaggatacaggttatagggacatggagacaaattgtgtccaacactcctgaggccaagggcacactaaaggtaatcaacatgaccctgggccaagggttgtttgagagggcatcttaaaggataataggatcaagttaagccccaaagcccagagaggatttggtggatagcagtgtcaaggtcattgcagggtgtaaaaatggcaggagaagttgtggatctgtgtttagggtatgaagagtagttcagcccggttgaggtagaggtagagaattgccccctaggaaaaagagaggcaaagccctttaagtgtatctagcactttacagtctataaagtgctatgatctttgtcttctatgagctattaagcatgaattcattttataaactgatgcacttagcaatgtgagattattatcttctcaatctccctgtgagtttggcagagcaactaatatcatctacattttacagatgagaaaactgaggcccaaaaagatagtttctgaagagaattcacaaagctggaggaggcagaactagaacctttgtgttttagtccattctcacatcgctataaagaaacacctgagattgggtaatttataaagaaaagaggttgaattggctcatggttctgcaggctgaacaggaagcattgtggcttctgcttccggggaggcctcaagaagcttccagtcttggcagaaggcaaagagggagcaggcatctcacatggtgggagcaggagcaaggcgggaggtggggaagtgctacatacttttaaacaaccagatctcacaagaacttacgatcgtgagaacagtagcaaggagatggtgctaactattcatgagaaaccgcccccatgatccaaccacctcccaccaggccccacttccaacattcaggtctacgattcgacatgagatttggtggggaaacacatccaaatcatatgaccatgtcttatgagtctcaaggcaggagttcccaatcagtgcctaagagctgggtaggaacctcctgagtcctggggtgtcatagctctggccactccctgatcccaacctgtgtccagtgacctcccatccctgcccttaattcatgcgctctttttctacccccagggcattggcactgatgagaagtgcctcattgagatcttggcttcccggaccaatgagcagatgcaccagctggtggcagcatacaaagatggtgagatgggcaggaggggccgcttaggatcttcagatacaaaatgaggatgattgcaacagtggggacactaagattctagccatctaccttctctcctcctttcctctgatccatttgtccacccatttatctacccaataagtacttgctctgtgctgggtgatgtgctaggttctcgggataaaaccaaaggggtccctctctcttaggccaatgagataatgagataatgaaggagacacacaataaacaggtgaacagataaacacagtgatgatggattttagctaagtgttgtacaggaaataaggtaacaagaatcaaacttttaccagtgaggtcttgggaggaaatgaggaaccaatcgtataaagaatggagagaagatccttccaacagaggtcacggcaagtgcaaaggccctgaaatagaaatgagcctggtagccggtacaaggctagacaggtagaggacagggcaggatcacacagggcctgcaggccaagagagagatggtgttttattctgagtctaatgagaagttggggagtatgatgatcagatatgggttttaagacagccatccttgttgccgtgggttggaaaggaattgagaatagaggaggagagaaccatcggaaagctgtagccactgtccaggtgggccgtcatggtataggtgggctagagagaatgaacagattccatttcatcatatcatggtcagtacgaagagctgtgaaaatataccctgggtcttgccatgatggacgtgtagactgggttttggaattcttaaaaatatctgatcattttgggggcagcagggccctttatcctagatccctgaggtctctggggatgagactagagcttgcgttcctttctgcagcctacgagcgggacctggaggctgacatcatcggcgacacctctggccacttccagaagatgcttgtggtcctgctccaggttggttcacagcctatttttttcctctggagcttgggatagcttttgtctggctcatctgggtgtagatctgaatgtccagggtctggtcagcttcccctggtttgcacaggcaggtgtatttggctaatcctctttctctttggcacacagtcctctcgtgcccaggagtgtcttctgctgtgattttcttcctctctccacactcgctcctcccgctcctctctgggcctccttcctgccattgcttctgcagctgcacatgcagcatttctggaccccagcattcctgtggctactgtgtggagtctcccacatccgagccttattgcctcctcaccgcccgcccaaagtatatcacaaagagactattaggaggctacaaattggtgtctgtggctgaattcaacctgccaagttggattttttgtttgttttcccataaaatgtgttttaagaaagaaagcaaaacaagtttgagttagttgctaacatttaaaaattgtgagattttgctcaaaaaccagatttctggattattttaatgtattgaaagttgcggtagcagcagacctgcattctgcacgactgcagtgggctggagagcatatgcgtcctgcccgtttcaccgtgaatgttatctacctggctctgtaggtatctctgtgaccacaggcacgatgggaacaggcattgagatgtctcaagctcagctccaaggaccaaatggttatgaaactttatatataaattaagccaccactatgtttcctcgttcccccatttcccttttataccagctcctcccaactctgttcctctcattgccataacaatcccatattaaccagctggggaatgatcaggagaaacctcaggagtgggacagtgtgacctgtgccccattttcaaagctgcttgttctggagaggagtgtcctatccctgtatcttggagtcaagcgttttgtatcctcaaggtttgacaccaagcagcagcgcggcacacattgtaagcttgccagctctgtcttctgctcagtcccaaagagaaccctgggggtttgagatcctggaatgcacaatccagggggaagaggggatggccatagacctctccaggccacctgcagacctctgcccacgtaagaaggagttgagtactgctcgcccctcttccctttgtgcatcctcctatgtgtaagcttcctctatcagatgaggcaaagggcatgggcagaacaacagaagcaccattaggatttggtgactttgtagcttgtgagctcagatcttgggacctgagtcccaaatccttattggtgaattctttaagttaaggtataagagctcctaatagaatgcaaatgttcagatcctttgcccctgtggaatcgttgctggaggagtgtcatgggccatgcaggatctgtggcagggaccctcgagaacctggggccctgtcctcagagaggtcctcagggcaaggctctgcctacctctgggctggggacacctggaagaaccttggttgttcttgggactctcctgtgtggacccagccctgacgaggaagggaaaggccagagggagggtcccttttgattggctcacaaaatagatactgtggtcttcatgcaatagcagtcactgcttctggacacatctgggccaccagggttttcctgctttccctgtctccaccactggcatccaggcctccctcctgactttgcagtgtttgaaacacatgttctttgtctttctgcccagggaaccagggaggaggatgacgtagtgagcgaggacctggtacaacaggatgtccaggtaaacaagcaccactgaaagtccctgaggcacagcagaagagccttgggaggggagaggttggggccctgggaagggctggaggtgaagtcatttgcatcaaataccagaaataacccagccacagctgtcatgtataccggtgctttgttgaagaaaagatataagttatctttcaaaggtatatcccatatgtaatattggtatattggtgaggtgtactttggagctttctttattcattcagtttttagatattattgaagtaaaatacctagcatgtgctaggcactctgccaagcatttagaaatcactaatgaacaaaatcaagtggtaccgggagagacaggcatacattaatcacacaaacaccttctctatcaatatactgtacattgcaggtgttttgagtacccagtacatgccagcagcactacaggggctgatacagagaatgctatgacatagtccctgttgttgaggagctcatgcaatagtgtggagatagacaggtgaagaaatcattatcatatacagtagatcaaagtgataaagaagtagaaagctatgggagcctaggagagggaggaaaggagggaaatagaactgtgcctgggggcatcgggaagtactttgagaaaaaaatggaatacttaatctgggccttgaaggttgagtaggagtttctccagaaagaaaggaagaaaggcatataggtatagtcatgtaccacataatggtgttttggttaatgatggaccacatatatgatgctagtcccataagattatggaccagatatgtgatgctagtcctataagattataaccccatattttcactgtgccttttctatgattatttatgtttggatacacaaattcttgccattgtgttgcagttgcctacagtattcggtaagataacacgctgaacaggtaggtgtgccgcctaggagcaataggctataccacggagtctgggtgtgtagtaggctatgccatctaggtgtgtgcgagtgctctatgatcacacaatggcaaagtcgcctaacaatggcagttctcagaatgtatccccatcattaaatgatgcatgactgttttatttgcaaaggtcttcaggctaccaattactcgtgtgttcagggatcaggcagcagttctgagtggcttggtcagtgtgtcctgtctcctgaggtttcctctttcagtcaagtgccacctcttccccttcaggacctatacgaggcaggggaactgaaatggggaacagatgaagcccagttcatttacatcttgggaaatcgcagcaagcagcatcttcggttgggtaagctccagagaagacctgaagctgctcccttgggttgatgccaataatgcctttctttatctcttttcttttctttaccactaatggaacatgatacctacttcattcccaacccaaactttagtcctgagtttattaggttggtgcaaaagtaactgcggtttttgccgtttttaaaggaatggcaaaaaccgcaattacttttgcaccaacctaatatcagacagcagtttgtatagtccctcagcaaagtcattaacaggatgcttggccttccatctcagtgccagtcctgtctccatgttaggggatgagacacagtctctcaccagctatgaagctcatctgcacagcgctggtgatgtgcgtgacctcccagtcgcctccatcatagcaccagccctagcttcatggtggacagtcgtcctggccactgtgcccccctgctcttgaagtcctcatttcttctcgggggtacagaggcactctcaaacctccctgtctctctgtctgacgcagtgttcgatgagtatctgaagaccacagggaagccgattgaagccagcatccgaggggagctgtctggggactttgagaagctaatgctggccgtaggtatgtcctgacgttgcattcctgggggctttaggggattctggaacactggcctaggaacaaggggctgagaatggaaaggggaattacatggtatagaattgggaaggagaaaaccatgtgggccgtgaattctaaaggtttctccagggcagcatggctgaggctggggacgggaagggggtttgagcctcaggtactgacttcctccagctcccttctccaccactggcagggggacaaagagctctgaacttgggttgaggataatgatgatcataatagttgacttttgttgagcatctagtgcatgccaggcactgtgctgagtgtgtaatctttaaaaaagacccagcagtggccactgccatgatctctatttcacagatgaggaaactgagtctcaccaggctgatcatttcctgaggggtagttttgtaatgagttgggggtactgagaacgtgaggatgtgaggaactggctagtcagtggtggagccaagattcaaaccagggcttctcccacatgggcttggagcaagtcacttctgcttgctggacctcagtttcctcatctgttaagtggggtgcagggtgtgggggcaggaaggatggactgccttaattgcctccccagaagcccttccaattctggcattccagcagttagcatgtctgagtcagggatatgttgtgtgtttgtatttcttgggggaaacctgcagctcctttatcgtccctcccagagccatcccctgccctccctgtttgaagtagtcagccagtgggactcacggtgattcagtgggattcacaatgattcagctgccagtacctttctggtgtagcaggtctaaaaaacaccttttcctccttcgccccagaccctacccccaccccagctcaattccctgttaaaaccaaaaggactagaaagataaaggcggtctttgtgatggacttcaaaaggattatttcaacaagattatttcctgtttattccctgggtgtgcggtaaaagtgggttggtctggggtgatctggggctgtgagctatcaggaacggtggttcttcctgtattgagctaggtggccctcaaggaatagaaacaaagagggagtcaggccatcccatcccccttctgaggcagccagaataactctacctcttcctccctcttcacagtgaagtgtatccggagcaccccggaatattttgctgaaaggctcttcaaggctatgaaggtgcgtggtggggctgatgtgaatggggtttggggagaggactattgggagtctttgacaagtccttgggatccagtggccaaagagagcccttcagggatggccacaggactgaccctggtgaaggtgctctgtcgcaggtgagctgtagagccaggaatgctgctggtcacatgtcctgccacctgcatacctgcctgacgtcatgagtcaacagatgaacttagggtggcagcctgcacctgatccctccagccaaatgggttggcggctcggactttgaagaagtattaaccagaatgtttttatacagcgtatgtaggcaagaccactttggccttgcctgctaagactcatgatgctcaccctgtgacagttccactctgggtgtgtttctgagaaagcttcccaggcttttacacatatgacgcacaaagaaactggtatttttgtgatgcactggaggaaatgaatgcagttatttgctgccagaggcctgaggcccgagacacaggagcttgggcctttctggccctggttggccattccgaaaggacaaagtagactgtcggccattctctgcccaccagtgtgccataatgaggttgggcagctcagccctagagagatgtttgcctgtatgcatgaattcattaagaatgcccatcacaaggctgagtgcatgcagtggctcacacctatgatcccagcactctgggaggccaaagtgggaggatcacttgaggcccaaagttcaagaccagcctgggcaacatagtaagacccttgtctctacaaaaataacaaatagaactagccagggactgtggcacatacctgtagtcctaactactcgggaggctgaggcaggaggatttcttgagcacagggcccctgggtttgaggcttcagtgaacgcagtgctatgtgatcacgccactgtactctagcctggacaacagagtgagaccctgcctcttcaaaaaaaaaagaaaaagaaaaaaaaaacttataacagtattgcttatattaggaaaaagctagaaacaacccagtgaccatcaggaatagtacagcaaaaacctaaatgcacagtggtatatttgcagagttccaaaatgtgtaaatctaagtgtattgcttagagttacaaagctatggtaaaattataaggaaaatcaagtgtggaaattatacatgaagagagaagaggtttataacagtgagagggccgggcatggtggctcatgtgtgtaatcgtagcattttgggaggccaaggcagcccttgaggccagttcaagaccagcctggccaacatggcaaaaccccatctctactaaaaatacaaaaattagccaggcgtagtggtgggtacctgtactcccagctgctcaggaagctgaggcaggagaattgcttgagtctggaaggcagaggttgtagtgagctgagatcgtaccactgcactccagcctggacaagagtgagacactgtctcagaaacaaacaaacaaacaaacaaacaaacaaaacagtaagaggagcatagagagagcttcaatgggaatggcaatgtctgcttcttttgctctaaattttaactttttattatgaaaataggattttcaactaagctgggagctatcagcactctagcctcctctcaagtccatgttccccaaacccacttgtcttgcagggcctggggactcgggacaacaccctgatccgcatcatggtctcccgtagtgagttggacatgctcgacattcgggagatcttccggaccaagtatgagaagtccctctacagcatgatcaaggtcagcagagctcatgggggcagagaagggagcaaagagctttttgccaagacagagggcttggggactattcccaggaaaaggaaatgtcctaggaagtgggagtctcttggacattccaggagctcctgccttgtggctcattcaaggaatttaaggatattcaacagaaaagcaagtgttaggggtgtttgtgagtggtaaggctacagaaggaggcaggggctgggtcatgaaggacacgcaagctgaattaagtgcgaggactctgccccaagggcagtgatagttcagtctcctggaagaaggctgggaaacactgaagaacacaaatgagggttaaaggggaacctttggcctgggccgggtgattggtgatgactctgggacatccggcccctgaggctttatcaggagacatatgtaaagctaggggttttccctttttttttttttttttggatgactgaaataaaactttatggggtgacagagaaagagatccaagttgtattctccaaagtatgtttccaaagggtaatttttttaggtgttatgtgcaaaatgttctatgggaaaataagtttgtaacaaaccacaataagcaaagataaataagccagtttctttacctcagaacttctcacagcctttcacattttgaagtccattatgaagccccaagagggatatggaatatgcatctatacggatatgtgcatctgtgtaatatatatttgtttgatttttttgcatttcccaatatttttgctcatggaaccccatttccatgcatatttcatgtggaaggactgggctggggactgtctggtggcagtgctgtgctggggcactggcttgaaagggcagcgagcatctcttctcaactccgcatattggtagcaaagtcatattggtaacttgaaattgtccattgctagaagtatttacaccacagaaataggcaaatgctataaattagggcttcctccaacctgcccgctgagaaccagttattcaatattaaccagcacaggagggccagggctgctatgaataagtgttcattcagccttcccctctttcaggctgtgcagaaccttcacctccttgtctgagaggagcccagggctgggtgagaggtaacctttctttctttctcttcagaatgacacctctggcgagtacaagaagactctgctgaagctgtctgggggagatgatgagtaagtggcttcttggcccctggctggagggcatggccttggggtgccaggcggggactctcctggctcgcatcctgatgggtggattggatgagctggggattcccctgagccaggagcgtcgcacaagtgaaaggcggcttttgctggtagctgctgtgcttgtgggtctgtgtgtctgagagtgtgggggtctgaacgtgagcgtggtctcctgtatatggagatgtctgctcttgtgaacttggaaagtcagtctggggttgtggactaggaaccagaatatgagcatccaatccctgctatttcatagccatttctcggtttcatcacctgttaaatgggaaaaggacacattcctgctctgcctactcatttatgcagcatatttgtgttaagtgccttctgggtgcagaccctgtgaggaagcccctgatgaaggccacagcgcagaagggtatagaccagtttccagaagggagcagtcctgtgctggggagaactggctgtgccacatagaaagcatatataaaagcacacagagatgccctagcccagaccaaggggagactctttggagatacacggtgagacccaaggaggaaggggaagagccaggtgaagagggtctggggacagtgtttgggtggaggaaatcacctatagaaaagccgaggagtgagaaggagtggcctgattcattcatatgtccgaagtcatgcatttatggagtactagagagagaaataaggcagagaagtgggagggcctgggggcctcttcccagaatgttaaattgggacattacttgaccagatttgtgtttgagaaagggaacaggctgcgctctgatttcctttctctggatcttataaagatccaattacagaagggatgcaagaatttcctgtgaacctttggtaaggaccataggggttgatgcagttcagcagatattactgagctcctgatgcatccaggcactttgcaggaggagatgcagggctggcatggccatagcttgctcaatggcctctttgagaggggagagttggatagaagccattcaaattctaaggaagaaaggggaggctgaaggattggaaaaatcctatcctgcttggactctgcagccaggaaggctgcccttaaaagccagcattggccggacacagtggctcagcgcctgtaatcccagcactttgggaggctgaggcgggcggatcacctgaggtcaggagttcaagaccagcctggccaacatggcgaaaccccatctctactaaaaatacaagaattagccaggcgtgatggcgggtgcctgtaatcctagctacttgggagactgaggcaggagaatcgcttgaacctgggaggcagaggttgcagtgagctgagatcgagccactgcaccccagcctgggtgacaagagcaaaactccgtctcaaataaaaataaaaaataaaaaaggcagcattgcagggggtctcaagagatggaaggttctcagaaatggagggaggactctggcgaatggaggaggcataggctggagagaaagaaagcttaatgtgtgtgtggtgtgtgcacgtgtgtgtatgtgttggggtgtgtgtgtgtgtgtgtgtgtgtgtgttggtgtgagtgttgcccatgatgacattccttcctgtcctctccctaaacccctccattccagtgctgctggccagttcttcccggaggcagcgcaggtggcctatcagatgtgggaacttagtgcagtggcccgagtagaggtcagaccttcccctcctcctgcttgacctcttgaccacagcttctctgcttgcaccttcctgctgctctggttggcacccagctgccccctggcggccaacccgacacgttgattctcacatctgaagcttccttttctcccttggagtggtgaactggtggaggggcgcacctggtttctgcattagcttctgacacgctggaaagggttctggcccacttactaacagggcttgctgaaatggagacctggctggttccatggaggggcctgtcccgtctggagtcgaaacagttggcctcagagacatgaaagctgagaacagatgggcatccctgggtgcactggaggatttcaggttgtcctcctgagcatcctcagactgggggtccacaaaggacaggaatgaaaggtttcactaaagtactttaggcaaaccattccagagactgcaacacttggtccacacaaaaaagcatgggaccttggagctctctgttacttattcgctatgtaacctttggaaggtgccccctccctctgggcctctatgtctccatctttaaagtgaggggttaacatggcaatctcggtgatctcttagggctcttgagctctgatgttctaggacagtgttccccaaatgataaggcaagagatctttgcagatgattgtaggtgatgtgagaagtgaatttagtttggcagggttgaataacgctgaactccacagagtgaatgagaaaggcactcctttccaatttcatcagcgtttctgattacgtcaaagaggaagtcttggtttggtgccgccgtctctgcaacacttgctgattttcctttttcacaaagagaaagctgagagagctcgctttaagtttcagagcttctggcaagtagaggcatcatgttaaatttcatggtatatcacctcttttgtttttattatgttgatttttgtggtaaattgtcagtttatgatacatggtatcaacttcctaattcatggtagttatataaaattaatttcatccattcctttttttttttttttttttgagacagggtctcactctgttatccaggctggagtacagtggcatgatcatggctcactgccacctccccaggctcaggtgatccttccacttagcttcccaagtagctgggacctcaggtggacaccaccacacctggctaatttgtgtagagacagggtttcaccatgttgcctgggctcatcttgaaccaatgggctcaagcgatcctcctgccttggcctcccaaagtgctgagattacaggcatgagccattgtgccaagcctcattaatccacttaacaattattttttgagtgtgcctattatgtcagacactgttgtaggcacctgggatatgtaacaggataaaacggatacaattccttgccttttgggagtaattttaaatgcacttcaaaaattgatgcatttaagtagacagaaaagaagttgaattacataaaaccattaagagatggcatagtgtgtgtgctaatttggaatagtgaaagtcctttaggagtgactgaaatttgggaaactctgttctggtatttcagaacttttctgctgccttttcagggggaatgactctttaagaggcagagggggcctcgggggcagggtaggattcagaagaattggggatgccccggtggaataagcagccaaggggcactagaaccgaggcagatcccgtggcaggcgggagcctagccaatttctcttgatcaggacttgccctgctcccagccctgagtccctctctccctctctctatatctttctgtctctttctctctctctctctctctctctctcagctctcgtgcagggtctgtctgctgtggcttcacctctgcctctttccccacccacgccgcttggtttgggctcatggggtgagcttcccaccctcgcatgctgtctttcagcctggtccccaggggggccttcagacacctgctgagtctctttctgcttctcacagctgaagggaactgtgcgcccagccaatgacttcaaccctgacgcagatgccaaagcgctgcggaaagccatgaagggactcggtatgggggatgggaagggagcagggttggtctccagggcagcaggtgtggtgggtttggccgtgggctggcaggggatggagtgaggtttcaaattagagtctgcaggatgaggaaggcttgatctcaagtttccaccctcctagctcccagagtatagagaggaggggcaggagagggttcataaggaacttggcagaagccctttccagggaccaaggtgtcccccagcctcctggaagcagtatcctggcactgaagaaagtaccaggtcacaaaattggcatggtgccctggctctgctgctgactcaccgtgtgactctgggtgagcctctccgccactctgggtctgaatttccctatgtgtaaaatcagggctgtggaccctggaacccaagagccctccctcattctgtggtgggagtgtgccctgctgggcaggtctttcagacctatatttggcaccagtgggaagagtactgcacccacaggttcagatcagctgggcctgtgctcagaaagtccagcctgggacaggccatctagggtttggctttctttgcctttctgccccatctgtctgacagcaactcccaggaggctttaggttaagtccatcaccctcctgagcctcctttccatgtgtctcatgggaatgatgatacctgccaagctcgcctgggactgtaggatgctagaggtaaaaatgccatgaaagacccctgtgctgggtctgtggttgatggcattaatctgagaagcaggaagtgatattctaatgccttccagagtcaacctgctgtggttagagggactcagggtccagcttccagagagctgaagagaaaggacatagagttgctaacaggacttggactgtcagggttggaaggatcccttggtgactactccagcctcttcatgttacagatgtggaaaccaagtcccatcaagggaaggggacttgcccagggtgggcagccattgccagagccagaactagaactcagaggcactgactcccaacccagtgctctctacctcccagctgtcctttttcctcagcgtgtcaaaaggaaagggagggaggagtccagcagaaatcagtggcctgagccataggcaagcggactgcagggactcaggagcacatggccgcttagccaggcttctaccctgacaaagatcgatgaggggccatcagtgggcggtgcatggggaaagccgagagccacaggccttcttctgaggcatgtggctttggtgactcagggactgacgaagacacaatcatcgatatcatcacgcaccgcagcaatgtccagcggcagcagatccggcagaccttcaagtctcactttggccgggtaaggacctcctcctgggctctctgtgcaacatgcatgcaccttgcctgattgagctcagcctgtccccatcggttctgcacagttgggcaccagggtcttcatggcagagggaccctgtgtggtcatatgatctcagagtgtctccagcactgggtttgggcagacatatctttccatgcccccagttccttgtgatgggcaacacttgtgtgagttgctcagtggactcagaggcacagcatggggccaagatcagggctatgagttgttttcagtgtgctttgggcatcttgcaattcctctgcacagacagagctggcttcaaggccccaactgagtgtcagggattattgcacattggtggcatctggcttaggttgatgcatttccccctgagtggaaacagtgtccttcagctctgctgccttcccgttcctgtctcctgtgtcaaggagagtgggtcttcctcctggttgttttttccctaccctctttggcttcatctaaataataagtacaacatcagcaaagacagacacaagcttccatgatccctcatgtggaacccctgttttctctttccatctctcccatcctgagtcatgtgtgggcaagtgctgatgttggcatgactgtggctctgccctttgcaggacttaatgactgacctgaagtctgagatctctggagacctggcaaggctgattctggggctcatgatgccaccggcccattacgatgccaagcagttgaagaaggccatggaggtacagtgtggcaccagggggtctagtgtctgcgggtgccaatagggatacaggtgatcctcataagcccaggtggattagctgtaacttcttggtagaactcctcccatactcagttcaaactggcataaacacaaaaggagatgttggctcctataactgaaaactacaggactagctctgagtccagagactcaaatgatgttctgtggacccttggctcacccctgtcttggctctgctgtcctcccttctggcttcactctcaggcagcctttctcctcatggtggcatatgtccatcccgccagctagcggctccagcagaaagagttccttcttcctaggagctccaacaacaggcttggcatttactccaagttgattcagcttaagtcacatgcccactggtgtcagaagggtctcatggagccgctggaggaagtggggtgggtctcgaacgaaagcaccagcagttggagtctgtactccagcctagacctgccactcactcacagtgtgactgggccattccttacacttcccaatcctctgtgccttcatctgggaaatggaaatggtcacctctgcccttcaaactaggacaggtcaatcaaggtcacaggtatgaagggcattgttaactccgaagacctgaccctacattaaacaagaaagcattatgtcctggcccagaagttgctagaactgctttgcttcccaaggtaccaattgtactaatggctactgtttataaagagcatatggtaactctcccaggttaggtacattagttcaattagttgcctcctcaagccacaaggcagggctcttattttgtccccattttacagatgaggaaactgagacttggaggttaagttgcttggtcatggtcatagagctatgaagtagcaaagctgaggttcagaccagtctttctgactctagagcctgtcttgacaaccgcataaaaccagtagtgcttttggccccttgcgcattaagaggagggcagcaatggggagctagaggactttataaaaacattgcctaggctaagcagattgagatgattgtttcttaaaatacctaagccaaaaagcaaacgatctaaagacacagggttcagaaatagaagagatcgatgaggtaacccaactgaatcctttccattttcaaagtttccaagtgggaaacagagaggctcagagagtcagtgagttagggggagacgagggctagacccagtctcaggactttcttgattgcctcaccacacacctgcttctaacaaagaaatgattgaagatctcaatcaggatgaatctcctaggatctgagaaggcaggaccattagagcactaggcagtaacctctttgaggacagagaacatgtcttgcctcttgcctttctctttttttttttgagacggagtctcgctctttcgcccaggctggagtgcagtggtgtgatctcggttcactgcaacctccacctcccaggttcaagcgattctcctgcctcagcctcctgagtagctgggattacaggcgcacgccaccacgaccagctaatttttttgtctttctagtagagaaggggtttcaccatgtttgccagcgtggtcttgaactcctgacctcaagtgatctgccctcttcagcttcctaaagtgctgggattacaggtgtgagccaccacgcccggacttttttttttttttttttgtagttgtagccccagcaccttgcacagtggctagcacataataggtgtcttaacaagtacctgaatgagtgaattagtcattgactcattcagtcaatcaatcagtcaatcttgcctgcctcctctcctccctgatagtttccctgcttccctgtgtgcagatctttgcatgacaggtccccagcctgccttagtccagggcatgtaacgcctcagttcataaatcactcctcaaatccaagagtaaacaaatgtaagccagccatgatggctcacgtctgtattcctaaaactttgggcttgagtccaggagttccagaccagcctggacaatatggtgaagccctgtctctacaaaaaatacaaaaattagccaagcatggtggcatgcttctgtggccccagctacttgggaggctgaagtaggagaatcacctgagtctgggaggcggaggttgcagtgagccgtaatcatgccactgcactccagcctgggcgacagagcaagactctgtctcaaaagaaaaaaaatttagcattttatcttaagcacaaaactttttttcttctaacaaaataatacatgttcactgtggagacttgaagaaatagagtaaaaaagaagaaaatagcaatcatctgtgatccttcactcacacagagaccaaactgctagttaacactgtgaggcatgtgcgtgtccttctgttctcttccaatacttacaagtagaaatttctattcagatgttcatgtgtatatgtggtgttatacacacacgcctatataccttttctgtttggggggctggaaggcaaagcagttcacatgggaggttctggggatcttgagaggctggcatagtcagccttggttgtgccaaggtcttgggcctgagggccatgtctggaggtgaggagaaaatccaggaatgcttggcctgagctttagccgtccgggccccatggacctctgcacaggaggtcagaactatggctgagatcatctttgccttgacattccagggagccggcacagatgaaaaggctcttattgaaatcctggccactcggaccaatgctgaaatccgggccatcaatgaggcctataaggagggtgagtttgggaggcctgggcccagatgctgggagaacagccaggccccccaacttccaaccccagcccacagctctgcccaggactctggcctgtctcctttccctcagtccttgaggatttgataagcctcttgggtgtgcccatccctgtgtctggggaaaagacaggtgtcctggtaggacaaaggcctggaggtagaaaagggcttggctggaagtgggaacagagaacattctggcctgctggagagagggagggcgactctaggggtgtgtagtccatgcagttctacagggccccacagccagaagggccccacacttggttgcaagctatgctgtcactgtccagaaattcttcatttttaagcgagtggccccatattttcattctgaagaatcttgagtaccagtcaaaaatgtttaaatcggctaggtgcagtggctcacacctgtaatcccagcactttgggagtctcaggcaggcggattgcttgagcccaggacttcgagaccagcctgggcgacatggcaaaaccccgtctctacaaaaaatataaaaattggctgggtgcggtggttcacccctgtaatcccagcactttgggaggccgagatggtggatcccttgaggtcagaagttcaagaccaacttggctaacatggtgagaccccgtctctactaaaaatgcaaaaattagccaggcgtggtggcatgcgcctgtagccccagctacttaggaggctgaggcaggaggatcacttgaacctgggaagcagaggttgcagtgagccgatatcacgccactgcactccaacctgggagacagaatgagactccatctcaaaaaaaacaaaaaacaaaaaaattagctaagtgtggtggcatgtgcctatagtcccagctactcaggagactgaggtgggaggatcacctgagcccagggaggtcgaggctgtagtgagccttgatcatgccaactgcactccagcctgggtgacagagtgagaccctgtcttgaaaaaaaaaaaaaaagtttacattttttatcttataagcagctttaaaatggcagaatttttgagtacaggagtgacatagtcagagctctgcttttgggtttagcaactgccatgcaggagggaaggtagaagagagaatgacaacagggaggtgacttaagaggctgttaaatattaaaggcgagatgcaatgggacctcaactgggacagagctgaggggatggaggggagatgatgggttgatgggaatgcccattgtcttacaaaatcagcaggaggatggctggatgcccccatgagccagttacaaaccctttcatccccacctccccctgccaatactgccctggctcaagcctgagtttcctggacctccctccccgcaaccaaatccttcttggccagcagctacccacaccccctttctctgcctcagactatcacaagtccctggaggatgctctgagctcagacacatctggccacttcaggaggatcctcatttctctggccacggtgagtgaattcatgggccccaggtcggcttgcccatcgggaggcctgggaggaagggaaggtttactgagtggagggcacaggggagttagaagtgcactcctgatggagagggggtgtctccccacttgcctccttagagttccaccgcctacccctgttgttcccttgtcaaagttggcgtggtaccaccttctccagacagtcctccctggtggcccttgtcctggcttgttgggcccccagctcacaggacaaagccatatgggtgaccctctcctgtgttgttacctgggagcttctgtcaccatctcttgaattcccataaccaaaatggcagaccctcattgacagttaccgagagcttgctgtgtgtcaggcattggtgctaagtgtcttgcacacattctcagttaatgaccacaacagcctaccttatagaggcaggattttcgtccctgtgtagctgatgaggaagagcattcagagaggtgaaaatgagcagggtgtgtggtggtacagagatggagatgggtcgatgtttggggactgaactttcttgctgctcctgctgcaggggcatcgtgaggagggaggagaaaacctggaccaggcacgggaagatgcccaggtaagacccccagcccaccccagtcacctctgccgggtgtccctgagatgtaggtccagcttatgcgtgtctacgccgggccctgtctgtgagtgaaggctcctggcaggggcgtggttggtttgattggttgatacttagactgtagaaatgaggtttagaagtgtggtgctggtattactggcatttcctaggtgaatagcaggaccctcagagctggcagggacctgcagatcacccaggtcaaagccctcatgttacagtgggaaaatggaggtccagaaagggcaaatgacttctgaaagtcacacagcaaatcagtggccccagtagaattgacccctagagagctggtctgggaacttgctgagaagagggcctgagtgctaaaggcctcggtttattatctgtaaaatgggaccgagattggagggagtgtcctgggacgagcctagaaagtaagttcctcaagggctggaatcttcattttgttcactgatatatccaaagtaacacatgatcagtgctcaataaatatttgttgaatgaatagcagggaaaagggttctctaggagtctcttggctgctctgcctcagccctgctccttagcctagtgagcttgaggtctggaaatggcttcttctggaggttggacaaccccaaattcattttccctgagggttctatggctgggcagtccctactgaggccagtgcattgtcccccactgacctgcaccttgatcccagcacccagtagcctgacccaggtccatgtctccatctcttctgactgcctcattttcccgcccccaaaagctgtgtccagggatgtggggcacagacaccacagacttttatagacatccagcccccttcttttatagttggtgagttgaaaagagcactgatggattgagagtcagggaaccaacttttctgttcccaggtcccataacagaagtgtggtttgctacaacagcatctgagctagaaaaatctttagctggaacctgacagttacagaattgtaattataatttttagaatgcatactatatattgagaacgatgccaagattattctatacgtttttatgttctccctttttactagaagaaaatgaagctccttaacctcttcaatgaaagaatttctaagtggtggtggttttatttgaactcaggcttgcctgatgccagagtctatgcttaattccatttacagtaatatcttccaagacccagtagagttaaggtcccctgcagcttccacatcaaatagctgttgttgtccagttgtccaacccttgctttggaatatggttgtcaaaagctgcagggttacatttaaatgtatggcatttcagctacattgtgggcacatggatgggggttaggctgagaacccagccagacactagggtggcttgctgaggccacatttcattcactcattcaacagacgtttattaagtattactgtgaacagcctcgtgtgctgctgagagttttttaaaaatctcagctctcaccccaaatccatcctccaaccctgaattgatcttccagggaatgcttctgcctggtgcctggtttgccaatgaggctgtgcttccaattgccgctagcagggggcagtggtgggccttgctgacagctgcttcgcaaaaggagagaagtggagagagagaacccgggtggaaatagctaagggacccttgagcgagatccctgcccaactcggctgcttctccagatttaggatgctagacccaagctcattttcttataactagcagtacattcttttatagaaactagaaaataaggagaagccaaaaaagactccataacctaatagtaataagcattgtcagtattgtggcatacattattctagttgcttctctatgtatatataaaagtggattctttatttctgacagttaaaaattaatactatgtgaatattgttgcatttttaaatcaacgatatcatttaatggctatatactgttccatatctgaatctaccatgttatttaaccagccttcttcctagtagcaaactcttttatcacattcatgaattattcattagaatgaatttccagagatgaaatggaaatgtgggagcaaaatgtatataaaaattaagggcatttgatagggccgagtcaagctcccccttagataacgcacatgagtacttggcagtttgtatttgcctgttttacactgcctccctggcggtctctcactctggatgtctagaacaccctcaagctcttagaagtctgggactgttattaaccagttgaacatatgtccaatttccaactgtggccccacagtgattgttaattgcttcccctttcactctgttgtccaattagagcaataaattataaataattattatagacctaccatgaaatgaaggattgtggtcatttttagataatcaatactcagacttttttttttttttttttttttttttttttttaagacggagtctcgctctgttgcccaggctggagtgcggtggcgcaatcttggctcactgcaacgtctgcctcctgggttcaagcaattctcctgcctcagactcccaagtagctgggattacaagctcccaacaccatgcccagctaatttttttgtatttttagtagagacaggatttcatcatgttggccaggctggttatgaactcctgacctcaagtgatccgcccgcctcagcctcccaaagtgctaggattacaggcgtgagccaccatgcctggcccaggcttttaaaaatataacagctttcttgaaatagaattcatttaccccactattgacccatttaaagtgtacaatttggtggtttttagtatcttcacagacttaatgcaaccatcaccacaatcaattttagaacattttttcacccccaaaagaaactccatacacattagctgtgactcctcatatcctactaaccccccagccctaagcaaccactaatctactttctgtctctccagatgtgcctcttccaaacacctcatgtcaatacagtgatattaatacgtggccttttggactggcttcttcacttaagaaaacactaacctaaacactatgttaaacacttaacagtgttttcacgggtcatccgtgttgtagcatgttggtactcccttttcattgccaaataatagtctattatccattcatcagctgatggacatttgggttatttccaccttttggctattatgactaatgctgctctaaacatttgtgtacaagtttttgtgtgcacatatgttttcatttctcttagatagaattgctgggtcatatgagaactctaagtttaaccatttgaggaactgtccagattaatttttgcatgaagtagctaggctaataagaacaagcttttgtggtgaatattaatttagtgtcccaccactttttttttacattacagatattattatcttaaagatgctttgaaaaaccgagtatgtctagggtactctgacccgcgtaagtgagaacaattgggactttggattcttttctgttaaattttttaaacatgtccctctctctctctttttaaaaatgataccgttttatttagcataagtttttacaaatttttgataaaatacatatcaactttaccatattaatcattttatatatttatttattttgagatggagttttcctcttgttgcccaggctggagtgcagtgttgcaatttggctcactacaacctccacctcccggattcaagtgattctcctgcctcaccctcctgagtagctgggattacaggcacctgccaccacacccggctaattttttgtatttttagtagagacagggtttcaccatgttggccagactggtctcaaactcctgacctcaggtgatcaacctgcctcagcctcccaaagtgctgagattacaggcgtgagccatcatgcctggccaatcattttaaagtatacagttcagtggcattaagtacattcacattgttgggcagctgtcaccaccagccacctccaaaactgttttcgtcatgcaaaaccaaaactctggacccactcaacagtcactccccattctcccttcccccagcccctggcaaccaccattctttctatgtctgtgaatttgactggggacttcatgtaagtgaaattatacagtatttatgcttttatgactggctttctttacctagtatgatgtcctcagggttcaactaggtttttgttttgtgatgtttgagatagggttgagacccaggttggagtgcagtggcacaatcttggctcactgcaacctccaccttctaggcccaagcaatcctcccacctcagccccccaagtagctgggaataacggcgtgcgccaccatgctcagctaattttttggtagagtagggtttctccacgttatcccggctggtctcaaactcataggctcaagtgatcctcccaccttggcttcccaatgtcctgggattacaggtgtgagctactgtgcctggcataggttgtttttaatacagaaaaatattttaaaaaccagaagcagcccataatcctagtagccttgataactcttatttaacatttaaatttaaaatgaaataatatctttgcatctttaagaaattttcaggaagaataaaaaaaatgcgaaagctttccctcatagtccctctcctcaaaggtgtctcgacagtttcttaagtacttcccaggaagtatgagaaagtgagtgtctatttttttttgaatctagataaaagaaacactatattacacaaaaatatgctatactttacttctttacttaatttaaatggaaactctccttatcagcattgtagataatcttatcctttgtaaaaactgcatggattgtttccattgattggataagtcatagcctgtttaacaagtcaatctcaggatggtttacagtttttctctagtatgaaaaatgctgaccaggtgcagtgcctataatcccagcactttgggaggctgaggcgggtggattacctaaggtcaggagttcgagaccagcctggccaccatggcaataccccatctctactaaaaatacaaaaaaaaaaaaattaactgggctggtggcatgcacatgtaatcccagctactcaggaggctgaggcaggagaatcgcttgaacctgggaggtggaggttgcagtgagctgagatcgcaccactgcactctttgggaggccaaggcaggaggattgcttgaggctagactggacaacaaagtgagaccccttctctacaaaaaataaaaaaattagctggatgtggtggcacacacctgtagtcccagctactcaggaggctgaggcaggagaatcgcttgagcccaggaggtcaaggttgcagtgagccgagattgtgccaatgtactccagcctgggcaacagagcaagaccctgtctccaaaaattaaaaagaatgctgcagtgaacagtcttgtattctatcgtggaaggcttttgccagtatacctgtagggcaaattcctagcaatataattgcttgatcaaatggcatatgccttttaacttttaacggacattgccaattatgcaatgaaaagaagaggaaggtttccagagtataggctattgtgaagtttataaagagttcagtctatccaatagaataaagtcagcagagtttctgggggaacggcgaaagcaatacgcagcctaggtacatgagcctgggtattttgttcccaggctctccaagtcacagctatttgcctaacaaaatagtgtcctaaccacagaattttgtgctctgcatagtgcagtgattaaaagtaacccttgtaaaatgactttcccatcactgtttgctgtgtgcctccaggcaggtcagctccccttaaggcctcagctggccagtctttcctgtctgtaacatgaaggctaaaattacatgtctcttgccttggaactctgaatatgctaaagggtgcagagaactttgcactgctcacatttacatctcagtggttctgtaaggaagtggcagggattatttccactttcagacaaagaaacaggcctggaatctcctctgggttttggggtgcgaagggcagagttccccatttctgtgtctttctcttacccttcaagtgaacacgtttttagttattgccaggcctatccgcattctgagctccagcccaaaaggtcataggaaggtatttttatcttgtccctaccccccttcctttcgcatcccgggttctctcaggtctcttgggacctctcccactcccagccaggcccctcaccctgcaccccagggccccagcaccagcctccccaacctcctctgactcttgcctcccttctctccctcctctctcccctccctgctctcaggtggctgctgagatcttggtgagtgtcctgttcttcatttgggttttaacggcctctgagtaaagtccgcctttactgggccgagcggggcagtatcgagcagtgatttgggagcttgctgtgcggcttctctctctccccttccgggccctgcttggtaaaagataggccaggcaagtgtttcccaaacttcagctaatcatctctggcacgatttgtgctgtgtaaccaccagctattaatactgatctttaaatcgactcactcttaaacccaaaatgagttaaggggaatttactatcagtataaatagaactagtagctagctagaagacaatcatggaaacactaatgtgcagtgtgatcgggtgtgtttgcccttgaccccgcttggggaaacactggccaggccatcttctctgcatatgaccccatacacccttcccagaggggcttgcagaaaggttgagggatggaaggggaactcccagttgctatgctcagagtctatgtgggtcctcctaggagccccagccccacggtcctgaggctaggatggaagtacccagtgctaaggccatctttgtcagttcacagggtccttgtgaactggagaggggagtatagaagccattgtgcttgaggaaggaagaggggaccagtctcggcccccttggatggctgggtgagcccagcttctgactgccctcagcccaggcaaagacatgaaagtgaataataaccaaggctttctcatgtctcccctcccaaatccttgctccaactggggctctgcaggaaatagcagacacacctagtggagacaaaacttccttggagacacgtttcatgacgatcctgtgtacccggagctatccgcacctccggagaggtgaggcctgacctcctcccttcccagctcagcaggaagatcccagaatctgatgagagcctctcagctctctgtggcaagaggagcccgttgcccacccacctcctccttaacccagcagtagcgtgtcatgggtgacggcgactctggagccctgggttctagtcctggctctaccacttatacctcaccttctttctcctccttagggaagcaggtgggatgcccgggattaggtatagcaactggatttcacctcaaaggccaactctgattggtagtagctgcctagagtgctgtgttaaggattctggggtcccgcgtcatgattcactggcgatgcctgccaggagcaaggcagcgagaggtggtggtggcacaagacccacatagacatctttgaaccacaggctgccgcatgctcagggcacacctgtatgcagtggccctggcactcggtaatcatgaagtgtcctgcactgagacatttacattttaatgtctggcactacattaaatgtctacatttaatgtctggcacttctcagtatttaaggtgctttaacatagtggctaaaagaatggacttgggcactggacggccttgatttgaatcccccacttaacagccatgtgacctcaggcaagtcaccgaatctctgcgcctgagctcccttacgtaggaatcagggttttagctctacccgagatgattgttgtgaagatacaaaaaacataacacacataaagcactggcgcaatgcctgactcagtgagtgtttcctgagtgttatcattgtgtcttcatcccaagcggacacaggaggaagaggaggcccaggaaggagagggatcacccaaggtccctcagtgagctggggcagaaccatgactaggacccgtgctccttttactaccccagcctgggttcccagaacttggccgaggttctaagaccattggccaggcacggggactggcgtgggacagatttggctctgagcccacggcagccttgatgtcagagcttctctatcgggatgatcttgcccaatgcatttaggcctgggctgtggccatatttgctgcccttccactttctcaggcacagcctgtgggaggcactgggtggggctgaggaggggtcctccgcctcctgcactgaagctcacccccacctctggggcttctcttgtggccagtcttccaggagttcatcaagatgaccaactatgacgtggagcacaccatcaagaaggagatgtctggggatgtcagggatgcatttgtggccattggtaactggcagggactaagggaagggctgggggcactgggaacttgaacagattctctggaagaatagaaccttggcagcctccgaagctactactggaaagtaaacactgtcacagttcgcctccaggggtgctgccaaatgtgtgattgtgcaggaatgtcatgaggtctgtgcgaggctgcaggagagggtgagaaaataactgttgctagggaagaaccaggaagactggggcaggcaggggagggggcacgctgtcctgcacaactagggtgtatacacacacacaccacacacacacttgacacacacacctaacatatacaagacacatactatacacacacacattctcacatgtgacacacactcatacataaaacacgttacatatgcatgtgacaggtgcacaccacacatacacacatcacacacagaacacattatatatacacatacatgctacacccccacaagacactacacctacacacacaccactcacacactatgcacacatgacccatgcacaccacatatacgcagcacacatgcacacacatacaagacacatacacgctagatgcagatgacacacacacagaccctcgtctcctctcagtacctggctttttggttacgcttatataatttgagctcttgactttgaaaaggtttttcccttttggatcttaattccaccgtgtataaatatggatgagtggatatgggttagggctgaagttattctcattaatattcatcattagtggtatcttgtttcatttactataaaacacattgcatcaatgcacttttaaaaaatcttaccaagaggtatccgtggaagattttcacataattgccttcaattataaaacacatcttgatttcagagacactaaaatgtgggggaaaggtgtgttagatttgggtgaagtagaggtggtggtaggggtgttgtttagcacgtgatgggcctttaccacccaggagcaatatctaggaggcgggatagcccgacgaataaaagcatggaatccaggttgaatccctgctctgccacttactcactatatgtccttgggcaggtcacaaaacctctgtgtctcaatttcctcctttgtaaagtggagataacaacagtgcccagcccatagggtggattttgtgaggctgaaattagttaattatatgtaaagcacttggaacggtgcctcttggcatgtaatactcactggacaagggttagtttgtatttgtattgttgtttcccaccaagccctgcgcaaagttagttgcacgcaggtttagttacattctcatcaggtgctcttaaccagcttattttacaaaagaggacactgagttcagagaggcttatagcagtagaaccaggactcaaaccacaggctgcctacctccaaagctcatgttcttaacaccagaataattagcctttggagacactttcagattcctaccctcctcgtgtatttccctcttccctttctcctcccaccttgaacaggtatacacgtgcaaacacacaccacaacacaccatttcacactcctccatccaatggcaggcatcggggtcccatgtgacagatggacaggctcagtttttaggaagacttgtggggttggttacagaggagagaagtttctgcccagcgtgcttcttagccagactgataaagccctaggtctgaagtcagggaaggcttcctggaggtgatgtcatgactgggggcatggacatcaagtacagccttgaaggatgggatttgatttagagagataatgtagtgaagggcagataggaaatgcatctatccaggaaggacagagagacacaggaatttgcagtttgttctgggaatgggggagcaagggccatgaggttgcaaaggaggccaggagctttgacattcaagccaaggagcttgggatttgtttgggaggtagtagggagatatgtaaggagctggagatgggaggtgtgtgatgtgatcttttccacagggttcctgagcctgttgcagaggagtcttgcttgactctgccactggggtacgcaactccagcctcttgccgtctgttctcattatatccagagtcattccagctatagtactggtgtctggttcctcctttttaagctgtctgagacacctgtgcgtgggctctggagccttgcagtcaagcagctgtgaagggctagagaaccctaggctttgagaaagggcggggttggtgaaaccaggcaggcattatctgcagccagggtagggagcaggggctgccaatcctgcaagattgttcaggccctggggaaacactcagccccagggatttgcatggtcccttaaattttaccaacggacagtcattctttggagcaatatttctctaaatcagtaactctcaagcattaggctgcaccagagtagggtggccaaccatcctgatttgcgcaaggctttcagtgctgttaggttggtgcaaaagtcattgcagttttgccattgaaagtgatggcaaaaattgtaattactttggcaccaacctaataaaacctggagtgtcccaggcaaactaggacaagctggtcactcacctctagagtttcagattcagcatctctggaatctggaatctgaggcatgagaatctgcctttcttccaagttttcaagtgatgctaatgttgttggtccggaaaccacactttgagaaccactgctcaaaatctttccaaaatctgaatctttagggtggagcctaaaccctgagttttaaacaagctttttgggtgattccaatgcatttaaaaatttgaggccccgtgccttgggttcatgaggagttaattacctttgaatcctctcctgaccttggttagctgtaagcaccttagaaggaagagagttgcaaccaattgagagccaggcctaaggatgggccagaggaggaagcatggggaaggggagcaaaggtgtcgtctgagcatgaccctggggttgacaatgatctgcagacccatgcagggatagacgaggtggggagatgggggaggccggtccagagtctgggttcacagcctctgaccacgttccccgcatctctctgctcttcctaccagttcaaagtgtcaagaacaagcctctcttctttgccgacaaactttacaaatccatgaaggtaagaaaacatgctggcgttcctttcccttcaagcactgacttacatacacacacaaacacacagatgtgcaccatcccccagatcaggattcctggcagctgtttcttcccatttgacatttattagcatctgcccttgtctggctctaggatggtatttcccagttgggggtgatttcccccgccttcccccgccccggaggatatttggcaatatccagacacatttttggtcatcacaacttggagattgttgctaccagcatctggtggggacagaacagggatgctgttaaacaacctcagtgcaaaggataagcttgcgcaacaaagaattatccagccccaaatgccaaggttgagaaatgtgctctggaggcacacagggctgggtaggacacagtctctgccctctcagagctcacaatctatccggggacacagggtctcctaggacaaatagtcatcaaaggtcacaagcgctcccctctgagtctagtcctgcccttctgggagagcccaagccacactggccaccctctcagccactggagtctcaactgcagatagcctgggcaggtgggagggtaggaaggaacctgagaccctcaccctacagtctccaaatgtgacagccattcattgagcactcacgatgtgtcaagcctgtgccaagggcttcatctctctgaccacagctgaccctcatggcagtcctgtgaaattgtggtagcatcctcatttgatagaggaggaaactcaggcctaggtagggtaaaacgttgcccacatttacatagctcctaagaggcagagctgggactcgaacctagctctgactcctaggctggtgcttgtcgctccctgggggcagaggcagctctggctgcccacacattccatgccctgtgcctgctccttgggcccggtggtagtttcctagggctggtgtaacacattccagaaattgggtgacaaaagaaatttattctcatagttctggaggccaaaagcccaaaatcaaggtgtcgcctgggttgggtcctcctggaggctctgggggagaagcactcccctgcctctcctagcttctggtggttgccagaagtccttggtgtttcctggctgtgaatgcatcactccggtctctgcctctgtcctcacctagccacttttctgtgtgtatgtctgtgccctccctcttctaaagatattggttattggtttaggcttcaatctaattcagtatgccttcatcttaactaattacatgtgcaaataccttatttccaaattacatcatgttctgagtttccaggtggacatggggacactattcaacccacacacatcttttttgcgtgtcagtctggccagtcctgggcacagagggattttggtcaggactgtttgcagaagacagaggtggaacatccgccctgtttttggaaggaacaagggagaaaggcagatgggataccactgtttcttgcctgactgggctctatctctccttccgcctgtgtctccctcctgcctggctccaccagggtgctggcacagatgagaagactctgaccaggatcatggtatcccgcagtgagattgacctgctcaacatccggagggaattcattgagaaatatgacaagtctctccaccaagccattgaggtaaggggaggggctagaggttagcaggaagcgggtgagtgtcagatccctaatataagattagaagtctttattcccatggacttttttccagtgggttaccgcttagaacagccaggatattgaaatgaaagggggtctgtattgcattgtttataccgaaatcaattccaaaagaatcaaaggtttataattaaagatttccaaataaaacaagagcccattttttgctttttttaaagcaatgttatggaagtataacttacatatcatgggcaggcatggtggctcacacctgtaatcacagcacgttggaaggccaaggcaggtggatcacttgaggtcaggagttcaagaccagcctggccaacatggtgaaaccctgtctctactaaaaatacaaaaattagctgggtgtgttggctcatgcctgtaatcccagctactcaggaggctgaggcaagagaatcgcttgaacccaggaggtagaggttgcagtgagctgagatcacgccactgcactccagcctgggcaacagagcaagactccatctcaaaaacagacaaacaaacaaacgaaaaacttacatatcataaaattcacctgttttaagggtacaattcaacagtttttagtaaatttactgagttgtacaaccattcccataatgcagctggtttccaaacacttctatcatcccactaagctctctcatacctgtttatctagttccatccccagccataggcaaccaccaagctactttgtgtctctgtagatttgccttttctgaatatttcatataaatggaatcacctaatatgtgaccctttgtgtctgactttttgtttgtttgtttgtttttgagacggagtcttgctctgtcgcccaggctggagtgcagcagtgccatctcatctcactgcaacgtccacctcctgggtttaagcaattctcctgcctcagcctcccgagtagctgggactgcaggcatgcatcactatgcctggctaatttttgtatttttagtacagacagggtttcactgtgttggccaggctggttgctagctcctgacctcaagtgatccacctgccttggcctcccaaagtgctgggattacaggtgtgagccaccacacctggctgcgtctgacttttttgacatatggagcttatatttttgctctttgagatcagccaagatcttaaagtctgatgcttggttctacttggctaacgagactatgggcatctcagaggcagtctcttacagacttagtaggaatgtaagtaaattgttggcacattttgatactatattatgttttaaaatcatacatcaaaaaatacaaggacaaacaaaatcccgaaaaccatgtctcataacaatgataggagtccctcagaagggagatccataccataccatgggtcaggaagtttggcctccccagtctgaacgtataccagaccactgtgatgtgtggtgagcgtgatggtgtttgtacccattcccagcaatggcttggcagttagcactcaatgttgtttgttcaaataagaaatcacctaacacgatatgccaagggccatgggggagggtatcagcagagtgccaggggaaccaagggaggccagagttcactgtgcctcctgacgcaagagagtggccagagtgcttctcagaggagagggccctgctggcaaatgggattgggggtgcacaggggcatgttggacaggggagtgacaggtggagagaggactgagatgctcctgggggaaaggaacaggtgaagctgcagagctctgcacaggtcagatcccaaagggccttgaagccaggccgggagcttgcatatcttcctggggataaacaaaagggacgtggtcacatttatgtgtctgggagatcccagtagcctacatgtggcatgggatcctatgttggtcatggagagaagccgagggagatgtccagacagatgggcagccgggaggagggggcattgagactggaaggactgttttcactcactctgctctctgcctctgccagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatc

SEQ ID NO: 7 - DNA, 8497 bp, Homo sapiens
gcctgagaggacatccagacattcaatccttgtctagggccttgtgggaggtaattgtgctttcctggggccagtgggctagtgtgtgctcctgaggccgcatgggacactctgagggagggaatgcctcctctcagccgaggctggccaatatgacctaataaggtggcctgaggactagtctacatgctagttgaatgtgcaggtgaggacctgtgagtgtgtgtgtgtgtgtgagatggtgggtagaaaggccagcatgtgaaagcattgtgtgtgtgagtgtgtatgtgaaagagagagggggggttgtgagtaggaaggccagcatgtgagtgcattgtgtgtgagtttgtgtgtgtatgtgtgtgtgcaccagagagtgggagagagagagagaaaaaaacatgttgataggtatagataagggatttgggagtaggtgtggaggaactgggtccctgagaaggtgactaagttagagattctgtaaacgtgggtcttttggggtgcagaaacaggtcatctagttcggagaaaccaccaagcgccccccaagttccacatcaagggattccccctcccaacattcctggctagtcctatgagcaccgcggacagcggcattgaccatgtcaaaccccgcaggacagaaagagcagcagccccgccccttcccttccattccaacctgagtcactgcccactccttcgtccaacgtcagtttcctcaactgtgtattgggaggttgaggtgggtgtgcgggacgtgagttggtcctttgaagaagaaaactgcagtttagggcaagagatcataacatctggctgcttctgggcaccaattaagtacattaagtggggagcgacagcagctaaacaacccaagcccataaagccttctaattgctccgacccacgtggtcacagtctccccacttatataaaaggcctacagaggtgcaagtagtgaacgcctgacgccccgaccactgtgctctccattcggacgtctccatcctcagaacctcctctcttccccaaaaagcaccatgacttgtggatcttactgtggtggccgcgccttcagctgcatctcggcctgcgggccccggcccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgggtgtcctggatcacacccttcctgaacccccaccacctacacagccagggccgggcactaaggatggagtcagaggcacaaagacctctgcctgcctgagatcccagtctgatgggcgaggcacacagacacacagacagacagacacatgcacagacacacacacacaggcactcaagatgcagactcagctgacagttcagatagagggagcttgtgaaggaaaagtgtggccaggctgctctggggcacaagctagacatcagggagttgggggaggggggcatgtgaccactgctgctgaactcagaggggtttgggcagccccagggtgagagagtagggtgcactgacttccagatgacacaggggaagggctgggacagctgagctcccttccagatggcctgtgacaccctcttcctggcaccatccccagaaacctcatctgtgatctgaacctgagtactctgcctgtgtgggttgctgatcacctagtttcatagtgagggactgagcctctacttctgttcatctgcttgggtggggggtggggggggggtcactcaactccccagggagcaggcactgacaccacccagcccttgctccactcctgagtgggaaatctagacacagatcatgaccaggaaatccagaaattgtctgtctcccactgcccacctctactcaatctcagataagctccagatttgggggttcccattaaagcacctcccctgcgagcccccagagctggctttggggcaccagacaccatctgccccaccttcccacaccgaatggcaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtgagtgcgggcaagagggatgctgggcacaggaatggggtttaggttaaatacactggattagacaataagaactcccaggtagggtgagtggccatgaccactagattgaccgagggtggcggggtcttttcctttgtggaatctttgcccagacacctgtgtaagaggagggctgtgactcccatgacctgtctctgtcccacttcagccttctctccctgaaccacatcacccagcagctctcccctgcgctgggtggggaggaagcctctgcagggtccaggccttctctcctgaccctcagcccctatacttgtagcacctgtcagatgtgagcccagggtctctcatgagtgacaggtcttgggctctgggtgtcgcactgccttaggttctaagtcctgagggtctgcgggtccaggaggccccatacctgagctgggattgataccagtgaggggaggctagggctacaggccctgagagtccacgctgtccactcccaggatggggctgggggctgagtcctatttgcctcctgggggacctcagagcccctttgggaacaggactgggaggtcccagatgagcactctccatccccagttcaaagtggatagagaatcccagacacatcccacatccaactagaaagcactaagctaggctgccaggccggggctgtgtggaggtgtttctagtactgtccccatggctgtgatgaagtgtgatgtgatggtggctctgcagagacctgccctgccctgacctcccctctcttccctctgctctgtctcaggtatgaggaggaggtttctctgagagcaacagctgagaacgagtttgtggctctgaagaaggcaagtgacacaggattgagaagcacagatctgtgggatctcagaatgacagattcttcctggggacacacagggggtctcaacctcagcgtggggcacaatgacctttccacagcaggctaggactgcccagatgcaggcctttgtattgagcatccagggccttgacaaagggcaatgacttgggaatatctaccagcacctaccttgggcaaggggatggctgcactgtcctctgtgtgtcctgctctgttccagaggttgtggtctattgctgaggcccctggagccatagcagatacaatgtctctgctgagagacagtgcagtctgtctagcattttggggagtctgaccttgaggcagagacacaatcccaggttctaaggggggatggagaagaaccaggagtagcccttgggcttttggagcactgctgggggacaggaaagggtcagggtgtgagagctggggggtcagtctgggcaggcttcctggagcaggagaggggagaaaggagagataagagggtaaggagcagtgaaaggctggtgagccgtgcccaagacaaacagggtttgtcctcagaatggcagaggatgccaggtcaccccgggaagggccagaagggaaggagagggcatgggaatgagacactggggactcctttccccaggcttcatggaatgggtgggaagagagaggaatctagaggctggatcaccagggtccttgagctccaacactccccacctttccaggatgtggactgcgcctacctccgcaaatcagacctggaggccaatgtggaggccctgatccaggagatcgacttcctgaggcggctgtatgaggaggtgcgggctcaggggccaggcagagacctggcagccagcagagaggagagatgggggtgggagtgttggacaggatgtgggtagaggttgcagtccctgaggctgtgtgagggggcagggttggggaccagagaaagcctgaggaggtggagtcaggacatggtgggtggggctgtgttctcaactaaagtcactgccctcacctcctgcaggagatccgcgttctccagtcccacatctcagacacctccgtggttgtcaagctggacaacagccgggacctgaacatggactgcatcattgccgagatcaaggcacagtacgatgacattgtcacccgtagccgggctgaggccgagtcctggtaccgcagcaaggtgagtggcacaggacacctgcctgctagacatggcagtgggagggatttgagattatctattaaataggcttccttttctggggatgcactagggatgagaagagatggctgccactctgatgttggggtggtagggcaggactgccatgtgtggttgcacaggctgagcactgcacaacctgcaaaatcatctgtcatgccctgaatgggtgggaggtcccaccctgaacctcatgagcatctctacttcccccagtgtgaggagatgaaggccacggtgatcaggcacggggagaccctgcgccgcaccaaggaggagatcaacgagctgaaccgcatgatccagaggctgacggctgaggtggagaatgccaagtgccaggtatggggcatctgtgcccaaggtcagagagaccgagggtctaaccatggtcacacagcctatgtgtgccctatctggatctcagcattcattctccagcccctctgtccatgtagagtccctggttgtggtctctgtgagtcccaggtgatgaaggcaagaggctctgttctggggtgctcccagcttggtggggagcatggtctcatcgaggtaagcatcagagagacccagggactctaatctaccttgttctctctgttctcttcagaattccaagctggaggctgcggtggctcagtctgagcagcagggtgaggcggccctcagcgatgcccgctgcaagttggccgagctggagggtgccctgcagaaggccaagcaggacatggcctgcctgatcagggagtaccaggaggtgatgaactccaagctgggcctggacatcgagatcgccacctacaggcgcctgctggagggcgaggagcagaggtgggtcccatagacctttccctttcccagccctgccagggttctcagtgtgctctgtcctcacactcctggcagcatttaagttttgtttcttaacctccccaccctgcaaccagacaggtaatttgtgtaagtcctttaagtatgatctagccccgtttgagtctctcatgttcacccaggcactgatctgagattgcagtcttgttcatctcagttgagatccagtaatctggcagcaggtattcctgttactgagaagcctaattaaggcttggggtcagcttgcctgggtagtgcttcttcccttccagctgtagctgcatgtgcttctcaggattccttctctttttcctagtctggccctggccccatctagacctgggagttcagatgtatcccataaggacagcttcagatagatgacactatcaactcatgcttttctattatagtgccaatgagcatcccaaagtggtattccattgtggcaggtgggaatgagttaggcagagagcaaggacttatcccttggggcagttatgccttgctttcaggatttttgcttgtttgcttgcttcagaggtggggggagtggagaagacccattggtcactcagccttcctatggctggaggccagcgatacagctggagggcagctatacagctcctgctcccagaaggacaacactcccagaatgtgagctcattctttgcccttggtttctttcccctagttggtcagttggtctcactcgaagctcctttttttttgtggacagtcaggcccttggccctggggagaggagggtgaaggttggggatgcagagggagcatcttgtttatttgggaaatggggaacacaggtttgggacctagaaactaaagtgaccatatgacgagatttccaccaaactcgagttgttccattggaaagctcagaggcaggggtctgtctggctgggcctggggaatttcataagtgaagaattctgggaggaggagttttccaagtctgaatttggaagttggagaaacacatggagatggcattggaatctgagtggcccactcctccatcacacggggctcttggagtgaactcaggagctttggtatgtgttacctagggaacctgggcatggaatgatttgatggtggccatggcttctcttatctgaagctgatttaaccaatccttggccagtgtgctttcaggggaactccattttcttcccttaggggaagctattgggagggaaatgtggggtgggtagaaatgagtgtctggggtgacagccctgccttgtcattggatatgtcctccttctgggcctcagcctttccatctgccggatgagaggactgtggtgggcagtctctgagcctgttctaaaatcccatttgtttatctaacagttttgtattgagccaggcattgtttttaggtggtgcaggaaggaatagacaaaaatgtctaccctcctgatgcctataatctaatgacaccaatcagactggatttcagaagttaaatctgctcccctcaaatgcacctgcaattcagtcagaaccaacttcgaggtagtggcagctaatagctcttaagggctatgagccaggcactaagcactggacgcttcttatttgattcagtcctcgcaagagatctacgaagtaggttttcctgatgaggaagcctaggctgaggttggcccaagctggggttgcacagctcagaagcagtggagagcgaggcactcacaggccttctgtctccagaccctcacggtgacccgagtctacactggctcctggccgagagcatttcttgccccttcccttgggcaagtgcccagatggagggccacagatgtccccctccacttcagtcacgggggcccggcgccttttccgcggcactgacctctcgccttctctccctgcaggctgtgcgagggcgtcggctcggtgaatgtctgtaagtagtggggtccgtcccctcctcccgctgggcgggtctgggagcctctgggcaaagggcgcgtgggctcgcagcaaagccactcacccaggtcgcggctgcgcctgacgcgcgcctccgtctctttcccctgcaggcgtcagcagctcccgcggtggcgttgtctgtggcgatctctgcgcctccactactgcccctgttgtctccaccagagtcagtagcgtccccagcaacagcaacgtggtggtgggcactactaacgcctgcgccccctccgcccgggttggcgtctgcggcggcagctgtaagaggtgctaggaggctgccgcctccgccagcgcctgtcgccgtcactctccacccagccagtacctcgcgccaccagaacgcgccgcccgcgccggcctcccaatagccgccgcccgctgcctgcactctaagcgccctccccaccgctccgctccgggagccatccccggtcgcaggagtccggggagggccgggaggcgccatggtctctctctgtagcctttcctggtagtcaatttgttgtcccgaggattcatctttttcttccgcctgccttctgttttttttgctgtatacattggtcttgcctgagctcttccccaaagcttggaggaacgggggaggcccgggaatgtccctgtctgcacgacctgggactctgcccatgtgcttttgcctgtggaatggagacgcggaccctggatagtggttctatgactctgcgagggacaggcccacgcgtgtggggagaacatctcccttccggggctgccctcaagagcttctgaaaaactaatgactctgctgccttctcctttgtctttgtttcactctgtgtttccaataaactcattgtagcgaatcaagcctagtgtctcagagtcttgaaaatgccagggccttcctgtgataggggctcctgccagagcgcctcaggacctgtttatccactatttttcagtagctaaaaatgaccacagtaggtgctgcccatctgtacttgagcagcccaggccttggggaaaacgagagaagactcacggagccagggaatcttatggggt

SEQ ID NO: 8 - DNA, 15294 bp, Homo sapiens
gaaatccacaacagctacctctctgatcctggagaaaccacctccttgcttaggcccaagcaggttcctggcaggctcaggaccaaattccaggggccactcatgggcctagcagcccaaggccgcctccccctcgtctttcttccatctctctttcctctgcctggcgagatgccagccagcacctcagtgtccccatctgggcagtggaaagtttgactctctgggtccttgtttgagtgagtgcgagtgtgtccgttcctttgctgtctgccccaggcgggggagggggggggaggtggtgggggcgagggggcgggggctcagctagtccagccgtctacaagaaaattgctccctttgaagctgccaggggggccgggaagcctgccccctcctgctcgcccgccctctccgccccaccagccccctccctcctttcctccctccccgccctctccccgctgtcccctccccgtcggcccgcctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaagggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatggatgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggagccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcaccgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaagcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcatgtgtgtgcatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtgcgctgctcctgtggcggcctggcctctccgtgcccctcctggcccttgggctccttgccctcagaagaggggccccgtcaccctcagaagaggggccccgtcaccctcaggtctgggctagcccggactagggaggtttcccctcccttctagacacttccatggccccagctgtcctgagacgcggctcca

SEQ ID NO: 9 - DNA, 2706 bp, Homo sapiens
ggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctctctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccatcccccaggaactcagttgttcagtgcccacttcctcagggattgagacctctgatccagacccctgatctcccacccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaag

SEQ ID NO: 10 - DNA, 57096 bp, Homo sapiens
gaggaatccttcagaccaagtgctgcctacttcccaccccaatggtggcctcagcctgggctcacatcacacgccccaaggagccttggaaaaaataaaggctcttggctccttcctgggacagcgtgattcctcatgtctgagcaggcccatgaacttgtatttttcagacgttccctaggacccgtgtccatctggattagggaaccactacattataccacttcgcgggaagactcagggggaagcattttagccactttcctgtgttccacagtactggagggtgttctgagtgggctgtgattaatttccaaaccaaccacacgtctcccctcaactcccactgcttactctttgcttcctagacattcactgcaggctggagacttctggaagccaacagcatcgctgtagaatttacagggtccagttcccggtggaccacaaaacctaaattatgtggctggggaaagctgaaatccaagggaagggtttgaggaggggctgaccttataataaaaccggcttgtatttactaagtgttaactatgcgctaggccctcgttgacgcctcaactctatgtgaaaagcactattatcccccatttacagatgggaaaacagagatttagagcgcgaaaatcatttccccaaggcgcacagactccaaagcccacgctaccaggtacaacctcaaggctgcggcgtctcttcacctgccccctagcccccaaaccgctgctatgtctagggcctgacattccggcgccctctgggacgtgctcagatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagagccgcggcgcccccggatctggggcgggcttggcgtcccgagcggcccccggcgccggagcctcccggctgcgcgctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcggcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgtttgcggaggaattttatggaccttgtagatgggggttcatatagaacacacaccccctatgaggcagccagacacttttttggtggtggtggggggggggtggggtgtgaagcctgtttcttgttctgagcccagaagctatcaacccttttgaaaaacattaccacggtgcctttctcccccagcactcccccacccccaatttccagatgtagcagccgcatctggttccgtttcaccccacacgggtacaccgcagccgcattattaacttccctcttcctcccctccccctcccccaaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgctctctgtgtgtttttaaggactgatttgggccgcatcccccggaaactaaagtggggtgttttaccgtttaaataacggctacaggtttgaaagcggggttggattttcgagttgtgtttggtaatagtctttgaggcaggaaagcgccttgtggtccaaagttgccgggagggtggggagagtcggtgtcttacccgcttctttccagcctctttcaaattgaaaacacttctctggtttccttctttgggcggtagttttggaggctgtaatgaaatcgcactttctctagacgtggtaattaaggtgactgtttcctccgcagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctgagtgtcagctttttaatgaggttcatccagattgagagccacttggactgcgtacttcactgcctgcttttccaaacatgcctgcagaaatgctcattttcgaggtatttttcccaatgggaattcaggccagagtgggcaccacttgaacaatcttagggtgcttcttttccttggcctctggccatggagggtgttagacagttccattaggtggccctttgatagcaagggaagcaaaggctcaggaagaaatggagaagcgtcccccactccctaggggcagaggattagatacatcggtgcatccctcaggctgggctagctttattcctggtggactccagagggcaagaaaattgaattgaacactgggtaggcagattcaagccttagagaccaaggaaaatccatgggttttgcttttagtggtgtgctctttgttttcagtattgacctgaaacaagactcctaaaatgagagatttgctggtatgaacttgggggtttagcagccggcttctacaaaggcttttttcttgccttcgtttctaaagtgtctttcgtcaaaatggctgttagttatagaacatcctagcaaagtttgagcctgttgctgctggaggaaaaggagttagaattgattcaaatgtcttattctgaaagggcctcacatcacttgatagtttaatttcctcctgggaaatttgtgtcttacatttgtcttccccagagctttgtaaaaggcctgaacgcaccagggactagtgggagcccagatgcagagctttagagaagattctggtgtttccagagaggatgaaatgtcagacttgggctaggatatttgtttttcctcctaaggttgcatctactttaaacagaaattctctcctcgccaccatttatctctcccctgcaatgaaagaaaccatgtttagggccctctcccccatttaatagccctcacatggatgaactatcccaagaatttggtggggttccactcatagtacatcctgtcttcaagagcaaggttttctagattatgtgcagcagttcgtgtttcacttgttgctttttttttttttttttttttttgagatagtctcgctctgtcgcccaggctggagtgctgtggcgctatctcaggtcactgcaacctccgccttccggttgaagcgattctcctgccccagcctccctagtagctgggattgcaagcatgcgccaccatgtccggctaattttttgtgtttttaatagagatggtgtttcaccatgttggccaggctgggcttgaactcctgacctcaagcaatccgctggcctcggcctcccaaaatgctgggattacaggtgtgagccattgtgcctgaccacttattgctaattttttatatgtctcttacttccaaggacatttagacactttttttttttaaagagactcaaaaaattagcatttccattggaccaactaaaatttagcaagctgagctgagtaactttctccatatgtttattaagtacttgccccctgccctctcaacatgtgagtagagaatggtcactttggggaagaaataagtcttattctcatctgaagggattaatgttttggtgttacttcctcaattctgaagaaccaagttgtccagaaattttctcagggttctttggactagagtttggctggttaacaaggggtactacctaattgcttttctctgatattctcagcctctttttctggaggagtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataacatgagttatgtatatgttcagattttctagaagccacattggaaattaagttaaaagaaagaaataggtaaaaaaaatttttttttttgagacggagtctcactttgttgccaggctggagtgcagtggcgcaatctcggctcactgcaacctctgcctcccgggttcaagcaattctcctgcctcagcctcctgagtagctgggactacaggcgcgcgccactgcacgcagctaatttttgtacttttagtagagacggggtttcaccatgttggccaggatggtgtcgacctcttgacctcgtgatttgcccacctcagcctcccaaagtgctgggattacaggcgtgagccaccgcgcctggccaatatttgttttttaattaacttgtttgtttagattttatttaatgtaactatatttccaaaatattatcatttgaacatgtaatcaatatagaaattattgatgagatactttacatttttttcataacaagtttttaagatgcggtgtatactttttacttatagcatatccgttagcaccagccacatttcaagtgtgcagtggccactgtgtgggccacaggtctagaatataagacatgaagatggagagtgagaaatgcctttggaaaggttggaagttcctgtccttctgctgccaattaccaaatctcctgagagtgctattaaggagtgactcaaagcactacacaaagagaattataaatatcttaatattatatctgaaatccaaatgcataattctttacatttggttggtactttagagaggagagaatgggcacagtcacccacaccacccatttgagcctcataatcacctgtgatgtggcttcctctaggtgggaaaccgaggcttagaacggttaagtgactatcccagggtggcaagatcataagtggaagggtgtgaattcatactgtctccagcggacaagaataaaaagacccaggctgggtgtggtggctcatgcctgtaatcccagcactttgggaggccactgtaggtggatctcctgagcccaggagttcattaccagcatgggcaacatggtgagaccccatttttattaaatatacagaaaattagcccagcttctcgggaggctgaggtgggaggatcacttgagtctgggggatggaggttgtagtgagttgagatcgtgccactgcactctagcttgggtgacagagcaacactctgtctcagaaagaataaaaagatttggccatgaattcgtcagctagttttccttacataatttttggacaaggagatctgacattcataggtttttctcttagaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaaggcaagtatttcagccccctctgatgagtgggaaactgagatgtgccccctctctgctccccaccgaggacctctgcatgcaggcatgaatcccaggagcctagctgatattggagagacggggcggggggaaccagctgcagggtcttggaggaagctgctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggtctatctttgaccaatggaactgcaaatcaagcctcttttgttaccagagttaccttggatttacccttatctacttggtttggataaattgagtttgcatcagatggagtcaggcttgatcaatcccttatttacttcctcccaccctgttctctaatatccaaaaaccttgaggcactattacatgctagctacatttccttgagtaaagtacttaacctctttgagcctcagtttctccattgcataaaaggaataataaaacttatcccccataagtttatagtgaggaatgaattaattcctcactatagttctaaattaattctacttagggcatccttggtacatagtgggtgttcagtattcatttcattttctcttttctgattcctttcgtaaaagtagaaaaatgaaagagaaatgttgacttctcttttgatttgaaatcattaaaacattttagtaagccttgggagggagctagtggtgtggcatgtgtatcccgctggccaagcacatgtgaacgaagccaagaatccaggggcttttctgccagccagcactgactcacttgcgaggggccctgcctggctcgggggaggcagggctgaagtaccacattagggcatgttccggggaagtagattctctgaataacttggatggctccctggagcatttaggacagaagccacctggaaaatagagatggtcacccccacgtagccttgacagtgcccagaaagtcttgtcacttggtaaatgttaacagctatgatccgttctttaagaccctggggagttttaagttttaccccaccagacctgagaagggtaaagggctgcagattctgttcttttaactggggccagtgtgagccatctttgactcagtgcttgcaatagaccttgattctgcagtgggacctcccaggcccccttgccccccgcaacttctggactcatatccgtcagacatcacttgtcaccttccagcatcagggagaactggatccctcctggctccacactcttaggctctttgtaagtagctggtgagggttttcttctctctgcaagggaggctggtagaactatggatgtgattcgtacaattttagagacaaaaagaaagtacccaggaggtcatttatttcagctgcttcattgcataggtcggggagttgagcatggagtccagcagctactaactagttatctctgtacctggcttccatttactggtccttagcttgttccgtgattcttcattgccccttatttctcaccagagggactggttggccctagatggagtggtctttttaaaattttttttttaaattttttgagacagagtctcactctgtcacctaggctgtagtgcagtgctgcgatctcggctcactgcaacctccgcctcctgagttcaagcaattctcctgtctcagcctcctgagtagctgggattacaggtgtgtaccactatgcccagctaatttttgtatttttagtagagatgggatttcaccatattggccaggttggtcttgaactcctgacctcaaatgatctgcccaccttagcctcccgaagtgctgggattgcaggtgtgagccaccgcacctggcctgggcagagtgaagtcttatgctggggagccatcagcatgctcaaacctcctgcaattgtagcacactttgtaaaactgtttcccacaaaagggcagaactatttgggactttcatgagaccattcactttgtagcacatactactttgaagtttataccttggaaaacctcatgatggtattcccaggcttgcacgtaatctgcactcaaaacatagctgtagaattgaactaaagcatccctctgtccaattaagacctataacctctctttttgagacagaatctcgctctgtcacccaggttggagtgcagtggtgcaatctcagctcactgcatccttcgcctcctggattcaagcgattctcttgccttagcctccgaagtaactgggactacaggtgcgcgccaccacgcctgggtaatttttgtatttttagtagagacggggtttcgccatggccaggctggtctcaaactcctggcctcaagtgatcctcccgcctcagcctcccaaagtgctgggattacagggtgcaccaccacacccagccaggacctatgatctaattcattgttggggtagcttcacaattttcttctggacgccttagtaagtccacactttaagcagccaccacatggcatactttaccttctgtttttcctttcccctcccctacctagaccctcctaacttttggggtttttttcctttcctcagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggtaaggtgctggctgggggcagcctggactcctgggccttgggaacaggatgggctgggagggaggtgatatggttgcaggtgatgtggtcaacagggaaggctccttcccaagtggagcaaagaactcccttcctgtaggagaaactctcaagatacctgggttggttctggtctggttataaacataactgacttcatcagaggttggggtcatgaaggctggtgacatccatttacctgagatgacatgtttgtggggggtaatttatgcttttctctttctgaggaaagaatatctgatgaggaccctagtgtcacactttaacataggtgatgtataaaatgcagctggtggtgcaatggggagagaatgaccttagaatttgcgtgtagaacttgggtcagactacaggggatgttgtaggaggtgagagcttgctaaagacctctgacttccagaaaattgtttcaaggccacatcttcgccaggcatagtgggtcacacatgtaacctcagcactctgggaggctaaggcaagaggatcacttgaggccaggagttcaagatcagcctaggcaatatagcgagaccccatctctacaaaaaaaaaggaaattaactgggtgtgatggtgcacgctgctagtcccagctacttgctactcaggaggctgagacaggaagattgcatgatcctaagagttgaggctgcagtgaattatgattgcactactgcgctccagcctgggtgaaaaaaaggcacatcttctataagggtcagcagtcatggcttcacgcctgcattttcctatccttaactgtgtctcacaggttctgtttgggggcctgccaagcgatttgctttggataggtactgtttgaggggttttgaagtgattgagacccaggaagcataaaggggcatggagacctatggcgtgttggaaattcagagccatcatcggtaacaggaaggacttaccccaccattcttgggatctgtgtgagctgtggaaaggcctcttgggagattataggtacagaataccggtggctttcgcgggactttgaaaactaatgtatgagcatttctgctgccagaggatagtgtggttcgtgactcagtggctggtcacacagagaaggttgacacacagtgggtgaaaggttggaggtgcgcgtgatggggtggctgtgtgcaaaaggctgccactcagctggtcagggactcgtttgaatgatgagtgatgggtgagaatatgtgtcctctggatggagttggggatgaacagggaaagttgtgtgagactttatagaaggtgcagtggctagagcaggcatattcatgttgctgtcagtaacagaaccgaaggcaaggtctgagctggagcacggtggggacccaaagtgggagagactgtgtctgcccacagggagtttatggtcaggagggatgggcaagtacagggataagtaacacaagacagactgtgtttaaaccacccagtgaagttacaaccagaggtggtgggaatgcagaggaagaggggagcagagagcacctgagatgggcttgagttcagaaggggaaaaatgaagggccctccaggttgaacagcatgagtgttcagagacagcatgtatatggtttatggagaacggtttgcctggtgagtaggtagctctgggaaacaacacttggaaaaattggattgagttagcatatggaaggcttaatgccctgctaagaaaactatacttagggccgggcacggtggctcacgcctgtaatcccagcactttgggaggctgaggcgggtggatcacaaggtcaggagttcgagaccatcctgcctaacacggtgaaaccccatctctattaaaaatacaaaaaaattagccgggcgtagtggcaggcgcctgtagtcccagctactccagctccagtctccagctgaggcaggagaatggcgtgaacccgggaggcagagcatgcagtgagctgagatcgcgccactgcactccagcctgggcaacagagtgagactccgtctcaaaaaagaaaaagaaaactatacttaggccaggcgtggattatgctggtaatctcaacattttgggaagccgaggcaggaggattgcttgagccaagaagtttgagaccagcctgggcaacatgatgagaccctgtgtctacaaaaaatagaaaaattagccaggtgtggtggcacatgcttgtagtcccaactattagggaggctgaggtgggaggatcacttgaacctgggaggtagaggttgcagtgagccatgatcacaccgcttcacttcagcctgggtgacagagtgaaactctgtctaaaaaaaaaaaaaaaaaaaaagcaagaaaagaaaactagacttaaatgggtagatgctgggaaacttgaaaagtttttagcaagtagtgacactatcagctttcagaaagttaatttggcagctcagtgtggatggctgggaggaaagagtgaggtgcacctgtgtttgcatcctgctctgccacttgatagctgcattatttacttcaacaaactactcaaacaccatacgtcacagtttgctcatctgtaaaacagggataaataataaagggttaagtggggtaatccagatgaagcacttccatgtaaggtgttaatagttgctattgctgccactgctgctgccagaaggatgaggtcgcaggttattttgagtgtctggctagaggaagtgcaggtactgaccaggatggggactgggagatgatagaggaaggaaaaagtagtaaagacactacagcaatagcatctgtgggtttaagtaggttgggtgtcaactgtgggcaactggagactgagatgagagtgtaaagggagtgagtcagagtgggaggtttgaggggagtttagatttgaatccgccaattgtagacagcgataaaggagtggaagagtagcaaggagctagttgaggtttgagaatgtgaatttataatggagcctaaagtactttcttttttttgcagcccaagaagggagaagtggatctcgggcctggctgcttgtgagccagcccgacgggatgagtataaggaactttagggccagggtgggggtgctagtagaggagggggcttcacggaagctgctggggcagggtggaggctggaacctgggggctgaagatcttgatgaggacaaagtaccggccctgtgaacagaagaaagggagtaagagaggtggatggggctcttaggagccatgtacccaggaagactgacattaaatgaccattttttaaaaatcaacttaattttcaaaggcacattggctcccacctataatcccagtactgtgggaggcagaggcaggaggatcacttgagcccaggagtttaagatcagctgggtttgtttgtttgttggttggttggttttaagagacagagtttcactctgttgcccaggctggaatgcagtggcatgatcttggcttactgcaacctctgcctcccaggttcaagcgattctcctgcctcagcctcctaagtagctggaattacaggtgctcaccactatgcctggctaatttttatatttttagtagagatgggtttcaccaggttggccttgaactcctgacctcaagtgatctgcccacctcggcttcccaaagtgctgggactataggtgtgagccaccacacctggccaaaccaacttaatttaggtataacagtttgggctattgtaataagactgctgtgaaccttcatgtgcaagcctgggtgggcacacattttccttggactgccctggttttgattttggctccacaccttactgactgttggctcttggggaagttcctctttgtgcccttttataaaatatattgataatgaatgtgtgctcataaggtcattgtgaatatcaaataagcatgtctgcagagctcataggacattgcctggtccgtaggccatgagcagtcaatggccgttgtgggtccctttccctgggcctccaggggagacggcacatggcgaggagcatgttgtttcatgggacacagcaacggaaagcccctgcacttggagaacaagccccaggtctctgtttggtggagtaagcccccgtctcagtgtgagtgtggtgctttcacatagcctgtctctcatgagctttgtgacagaacagagaactgctgtgcccaggacattctaaggggagatctggcttcatgctttgtaagctgtaaggaaccttgtaagtgtaaagtatattgcatagtcttgggcctgctgattattaaataataatgctgatattttttaattaattaattaatttatttgagacggagtctcactctgtcgcgaggctggagtgcagtggcgtgatcttggctcactgcaacctccacctcctgggttcaagcgattcttctgcctcagcctcccaagtagctgggattacaggcgcgtgccaccacgcccagctagtttttttgtatatttagtagagacggggtttcaccatgttggccaggatggtctcggtctcctgacctcatgatctgcccacctcggcctcccaaagtgctgggattacaggtgttagccaccatgcctggccaatgctgctgttgtcctaaaaaaaaaatcatagggcgagcacagtggctcacacctgtaatcccagcactataggaggccgatgcaggaggattgcacgagcccgggagttccagaccagcctgggcaacatagcaagaccccatctctaaaaattttaaaaattagctgggtaacgtggcacacatcggcagtcctagctattcaggaggctgagatgggagaattgcttgagagttgcttgagcccaggagttgaggctacagtgagctataatcaagccactgcactccagcctgggtgtcagaaggagaccctgtctttaaaaaaaagaagaaacacattataatctatgtattaagggctttgtccaaaaggtgagagcaaaccacctaaaaccctgttcacactgagttttccccatttaaaaggccttgctgtgattttaagtgtgtgtgtgtgtgtgtgtgtgtgtgtgtgtgtgtgtgtgtgtgtctgtgtgtctgtgtgtctgtcgggagcccctccccactgagcgcagtaccaacgcccctcagtctgcaagtgctcctgagggattggggagggcctggagtttctggctgtccttggaaagttgatttaataagggttccaggaaaaccagcctccctcccctctccctctccttcccctcctttggtttgggatcttacagagcctcagcttgtttcagatcaggctttgagagtggtgagggagttgtttggaaagactgaagccggtttcagatgataagccccaacattctgagcttgcagagggtgcatttgtctgtcttttgcaataagtcaagtcttggtgggcaaagccagtgagtgagtacaacactgcttgcaaggccactgctggtagttggggtgggggtcctgcccccttttcagcagtactgtgggttaaacaccccagtgctcagaaaacctgcagctcagaagtgatttaatgggctgagttttacagctcctcccacccacccagatttgaaggagtctggtggcttgttagaggggggagaggttgcacttaatggaaaaaccacacatttccattctggcctcaagccccctggatgccctgtgtgcaccacaaagcggggctttgtctctgtgttttgcagaaacctgcacctatgggggagaggctgtgcgtggtgccagagccattgcctagcctcagatcatagggcccttgcaggtcctccatccctgggcgtctccagctgcctttggcccaaaggggtgtgcgtttcagcctggctgcagggagagtctcaaataggtactacaggtttggtagtgggacaccctctgttccactatcagacctgtagtctagcatctacactggactgtggtcctgtgtcccaaggctgccttgggacacaggcaagaccctcccctactcccaccccatctccagcatgatttcttatgatgaaaagaacttgtttgcttctcattcaacctggatggtaagaggagtttcttcatcccctgccagaaggcgaatggaattccatggagcaaaaggtgatgtcagatgaccctcttgagaacaagggtggaggatttaggcctctagaaatctgcaaggtgctaagctcataacaggtttccccagaggatcagctctgtcccacttcccctggagaagtggctccagtgcctggaaggggtgtttgcaagtgttcagagctggacagggaggacccagccctcggcctgtgagagaatgtgaggacgctcacgtggccctcttgaccaagctggggcaagcgcagcaaagccactccgaggctgtgttcttggctccggcttctgcattgctacaccattagcttcactgattttccactctggctctgccaggcccgctccctgaagtcagggaggaggaatttctcagggaagaacaaatggctgtccagagatcttgctgccagtgggggaagggagggatcccaaacaaagactctgtcagggtttccatcacctggttcctgtgactacctggagtcgggtcagcaggaactggagagacagcatcagggattctttgggagcctgtggccccagcacggaggggtgtttgctcctggccaggcagaagcagtgagtgatggcttgtgtctgggcggtgatgaatggccctgggagaagtgagtcctggggagtcattatccgggagggcgaggtctggggtcagagagcccgaccagcagctggccctattttcacaatgcctcgttcctccggggccactgggggctccagctcaccctgtagacaccacctttgcctctttcttccttccctgaggcttggaaatgagacaactgtttccctgttgaccggggaagtccagctgctctcattctcctgggctcctgaacggggcggcccaggccttcctcctgggcctggctctttcaccaacttgcaggcaggcaatcccttctccccacccaccatactccccagccccactgcaccctaaataattaagctgaaagctaactgccctacctggatctgaagggcctgggctaaatcccaaactgtttcctcctaggagaagcctgctggagtctgggccacttctgaccttggggtttgctctgacttacagctggtggcagccaagtagcagggccaattgccctaacccctcctccccggtagtgggcctgttgcctcttagcattgccagtgtggcaccaagagacattgaacttctaccctcagagttccctcccttctcctgtttcttggctcacaacagttcttgcctttccacttgccaaacaggtatctactgccttcatgtaaagcatttgtgccctgcaaactaggggctgtggggtgagggctccgtgtagctggtttcaggcactgagaaagatccaccctggcagagcttgaaactccacgccctctcctcgttcacatgctgtggcgtggctgagcctcccgggatgggttgtgtaaaaggtggggtgggggctgtgccatttgtgttcccaggccctggacatggagacacagggagcctgaagtgggtgagagggtcaaggagttccgcaaagagtagacttagtggttacgaggttgggcagagaaagaggtcagaaacagcaacacggaggtttctaggagttaaccaacagtgaacattgaattcagagcttagcccttcctcacttttctctaggatcaaaaactagcttctggctaatggtccattcattgactgattttttttcactcattcatttattcattcatctagtcaagcaagtctcttcctttttccgtaaatacaatgtatactttatacattgttttatcctagtcccttagctggaaatatctgttcctgtccttttcttccttttcactttttataattcctgctcaaatcttagtttaaggtttagcttgggtttagattaaagcttaacttaagggccacctcccttttgaagccttcccctatctccaaattaattaccccattttttctctttttcttttttctgtgttttttttttctcctgagacctagtctcgctctgttgcccaggctagagtgcagtggagtgatcatggctcactgcagcctcgacctcctgggatcaagcgatcctctggcctcagcctcctaaagtgttaggattacaggcatgagccaccatgcccttttgagatgtagtctcgcttagtcatccaggctggagtgcagtggcgcgatctcggctcactgcaacctctgcctcccaggtgctagcgattcttctgcctcaccctcccgagaagctgggattacaggcacccaccaccatgcccagctaatttttgtattttttgtagagacaggttttcgccatgttggccagtctggtcttgagctcctgacttcaagtgatccacccgcctcagcctcccaaagtgctgggattacaggcgtgagccaccacacctggcctctttttaactttcattctaacacttactttactctgcctcacattatgtggagtttttaatagatgtctgtttactccactagagcaaagttctctatagtcagcaagtatatctttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcgaggcggaagttgcagtgagccgagatcgcaccacttcacttcagcctgggcaaaagagcgaaactccgtctcaaaaaaaaaaaaaaaaaaattggtgttttgttagataatctgggttcatctttcaaaattcagaaaatacagacctgtaaagaggaaaaggaagactcctataattccatcattcaaaagcaatcactgttaactgaatttattgttttagacttttttcttgcatttatgtaaacctgacttttcagaattaggatttatactgtatacgatgttttgtgactgatatcagcatttagagccatacagagaatgtttttcattatgcttaagaactacataatgttccattgtgtgggtgtacaaagttgatccagttctctacatttgggcatttaggttattttcaatagtttgcattcaatagaacatattcttacaaataaaatctgtccatgtatccaaggatagttccatttgttttaagttttgattttatcactattacatcactataccaaatatcccccaaaagattataccagtaaatgtcttttaaaatataataataaataccagccgggtgcagttgctcacacctataatcccagcactttgggaggccgaggcaggcagatcacttaaggtcaggagtttgagaccagccttggtaacatggcaaaacccttctctactaaaaatacaaaaattagccggtcatgatggcggccacctgtagtcccagctactcaggaggctgaggcaggagaatagcttgaacccaggaggtggaggttgcagtgagctgagattgcaccactgcactccatcctgggcgacagagcaacgctctgtctcaaaagtaataataataaatatcatctccacactctgcatgcttgacattttcccatttttacaatgattccataggcataggttttatgaccataatcagatgagtaaactgaggtttgaggggttaagtaacctatcttaagtttatatagtgggtgaggggtggaactaggatttaaactcaggtggttctgctatagtatttttttcccattgtattacactatttttctatatcaaattgggtttccccacaaaatctaggtggaccaacttctgaatgtaaacattgctggctcagtcccctttgtctcacaggagtcaggcatcccctccctttgtcaggggtgtgtgtgtgtgtgtgtgtgtgtgtgtgtgtgtgtgtgtgtgtgtgtgtgtgtttgcttgcagtaatatctcctgtggcattctgtagagaggttacacatcagtcacaggtctgtgaactgccttaatgaacaaggttccctagcctagaataatcaatggaacaaaatccccatggacgctgccatttccactgttgccaaagacctacatggagaaggttcccaaggtgtcagatccgacacctgagttttctttataggtcacagttagcctagaatgtgtggtatgggtattgcctggacgcataaactagattgcttctaatatggatgtggtccaacaatctctgatgaatggaagtaaacatatcaaaagcttcagaggctgggacattaacatttttttgaggctactagtgttttttataaataatgaagaagggccaggcgcagtggctcacacctgtaatcccagcactttgggaggccgaggtgggcagatagagtgagctcagaagacccgcttgggcaacatggcataaaccccatctctacaaaaaatacaaaaaattacctgggcgtggtggtgggcgcctgtaatcccagctactcgggaggctaaggtaggaggatcacctaggcctggtgtggtgggtcacacctgtaatcctagcacttttgggggccaaggtgggctgattgcctgagctcaggagttcgagaccagcctgggcaacacggtgaaaccctgtttctactaaaatacaaaaaactagccgggtgtggtggcgggcgcctgtaatcccaagtactcgggaggctgaggcgggagaatcgcttgaaccagggagtcagaggttgcaatgagccgagattgtgccactgcactgcagcctggctacatagcaagacttcctctttaaaaaaaaaaaaaaaaaaaaaaaggtgggagagggctgagtcagtttgccttggaggcatgggggaggagaaggatgtgaacagggaagtgatctaagagcttccctaggaaggaaggacacccttttcctggaatgctctcctgctctgccacagctttcagtcaattatcactgcctttagaatgcttatcagcactccagcccttcagaagtgtccttctcctcctctggtgtcaaactccagagtttacttttggaattaaggtttattttccttaggttttaggaagtagcttttgaaccttagaagagtcagtttcctttactaactactgaatgaagttaggcattcaaaacttgggtagtcatgatttgaagtgtcacttgcggccaggcacagtggctcacctgtaatcccagcattttgggaggttgaggcgggcagatcacctgaagtcaggagttcaagcccagcctggccaacatagtgtctctactaaaaatattaaaaaaaaaaaaaaataaccgggcgtgatggcaggcgcctgtaatcccagctactctggaggctgagacaggagaagcacttgaatccaggaggcggaggttgcagtgagccaagattgcaccattgcactccagcctgggcaacagagtgagactccgttccccaaaaaatgaaatgtcaatttcattgagactgtatgaatgcctgacatgcacttgaaagtgatgtttattttataattttagcccttcttcactaccccaaactcccagtgcatttaaaaaatttattggcctagccattctcatggggtaatatatcatgaccatcaaaagatgacactaaagtgaatcctccatgtatagctgggctttctgccagccttagattctggagaagcaccccaggccagggagaacgggtgaagaggagaagcatttattgaaggtgctggtagccggagccctgagaccaacacagaatcgttttttctgaaggacaactcaaggacagttgagggctcttcacttccctcacatcagagggagctttgtgctcacgatgggcacggaaagggatgccagtaagcgatgcccctctatcatctcacaagacccaggtgaaacaggacattggttagggctgggacagggtcagtcagccttctcattttacagtggaggaagctgaggcttgagaggggaggtgacttgcctgaggtcacacagtaagtgatcagctgtcatctgagtgatttcttcaggtactctctctggctggacccagccagtgacaactacctgtggctcaagctgagtttgggactaaatggttttacaaggacctcaaagtatactctctctcttctagtaggacatggggaatactgactttgctgagagtaagggctcttttcccaggattgttctagatccccagatcactggaaccctgagcatagatactaggctttagcttcctggctaccacagagccacacactctcaggtagaaaaatccctaaactggctgggcatggtggctcatgccagtaatcccagcacttttggaggcccaggcaggtggatcacctgacgtcaggagttcaagaccagcctggccaacatggtaaaaccctgtctctacaaaaaaaaaaaaaaaatttagccacgcgtggtggcaagtgcctatactcccagctgcttggggggctgaggtggggggatcacttgagccagggaggtggaggctgcagtgagctgaaatcatggcactgttctttagcctgggctacagaatgagaccctgtctcaaagaaaaaaaaaaaaaaacccgaaccatgtttttaatttcttaaaactgagagtactaaatgctcaacgttcatgttgtgtgcataaaagtgagactgaaggatgaatgtgtggggtatggatagatgggatgtgaatgaagcagtctctgggtccaagctctcctggaaattcgtggaacagaccagtggtcccagatttttagatttcataggccagtaaaatttccctccagatttttggaaccaacaaaggatcatcaacttttttgccaagtaagaacgtttttaataaactaatgctgcctgctaccattaccacctgattcttttttttttttttttttttttttttgagacagtttcattcttgttgcccaggctggggtgcaatggtgcgatctcagctcactgcaacctccacctcctgagttcacgcagttctcctgcctcagcctcctgagtaggtgggattacaggcattcgccaccacacctggctcattttgtatttttagtagacacggggtttctccatgttggtcaggctggtctcgaactcctgacctcatgtgatccgcccacctcagcttcccaaagtgctgggtttacaggcgtgagccaccgagcccagcgccatctaattcttttgttgtggtaaaatatatgtaacataaaattaaccattttaactatttttatttttttaagttaaattgattatgtaatgtttttgagacagggtcacactttgtcacccaggctggagtgcagtgttgctatctcagctcactgcagcctcgacctcccgggctcaagagatcctcccacctcagcctcccaagtagctgggaccacaggtgcacgctaccatgcctggctaattttgtttttcttttttttttttttttgtagagatgaggtctcactttgttgctcaggctgatctctaacccctggactcaaacaatcctctcacctcagcctcccgaagtattggagttaagagatgtgagccactgtgcccggccaatttttaaatttgtaattgatgcataatggttatgtataatcgtcgggtacggtatgatgttttgatccacgcacacattatgtaacgaccaaatcatggtaattgctgtattgtatccatcactttaaatatttatcatttctttgtggtgcattttcaccaattttaagtgcacagttttgtagcataaaatttattcacgctgtgtagccatcaccaccatccatttcaccttccctgacaccttacctgttcaacgctaactcccccttctcccctcttccagccccttggtaaccactattctacagcttttcattttcaaaggatgttttattgtctttagtctcatcgtgtgaaaccttaagagaatttctttacggtggagaaaaagtaactttatgaagcccattcctttctctactctggagaggctggtgacccagccccaccattgcaggaatgagacgggattgcggggatatggcaggcacttggggtgctgagagtccaggtgaactgtgagctcaagcacccatgtcgggcttgggggaccagaagacacatcctgaaacagctgaagcctctactaattcatcagcaagtttagggagcggcaacttttccctgcccagctgctggcgtttccttccccatacaatttctgctgagtttgggggaggggaggttgttcgagaggccccagctgggagaggtggggggagggcgatacattcttttccttaaggaacctgaccgaactttaaggtcagagctcagtggagagtgggagctgcagggttacctctttgccgttgattcatctctccaccctcccccactcttaatgatctttccattacagaacccagaccaggaagtgcatgacaggtcgcagctgcagacacatggctgggaggcctgggctccgggccagtggtgggagagtctgagctcccctccagcagtgggacccctgcacacacacacacacacacacacacacacacaccactttaacaacttggtggaagatgttctttcttatgcactgtcacaggtgatgacgagttggactttgctttgagtttaggatgtgatttatattataataaaggcaggagaagacactccccctgccccggtccaacctgagtgtttagatccccccaacttacagtccacctaagtggtccttaccagatcctgggagctttctattatcgtgcagatgccccaacttcttttcccaaaataggacccacccaatatggccttagaagcttcccagggtatccggggcagttgctagtcacagtcttaatgtctccgaaatagtatgttttcctctctatgtttctattaaaatgtcagccccaaaacatgtttctgggtggaggtctaggtgcaacagcacagcctttgcaaacacagatagacttgggttcaagtcataatagatgagttgagcctctcatttttcagtcttcattggggatggctctttccatttgcaagttgttcaggaaatgttaattgaccctaaactgtgtcctagggggcagttgtcacacaggagtttctgtcttcaccaccagctgtgtccttggcttccttccctgaatctgccaaggctggattctggtgctaaatgtgaaatggtgacacaaacttctaggaactgtgagcttggacggccctcctccatagccgcagggcatctacctttgctcttcttggatgagtgaatgaacttccctctttccagagcaatgctttcttcctgtttagataggagggagagaagcaaagtgtattgggaataggttgagcgaaagagtgtagtaagagttttctgtacagctctgtccttaatgtatcagtaaacaatagggtgagaacttttgctggggagagaggaaggagggaaatttcttttcagacaactcttgggtgcattcctttgttaatcacttaattacagcccttctcccagtgaggtagtgaactccccattgtgagaggtagggaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggcggctcggcactaaattacagtgacgaggtgggacgcacaaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaatttaaaaaaaaaaaaaaagcccttctccaaatcccctgggtcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcggtgagatgcttctgcactctggccgggtcctgccagccgaaggtaagttttcagttccatttcaaagccaaaatacgtaataaaaaaacctctgcagagggcccccggagccccgctgcgctgttctgtgctccttttaagttgctttcaaagccaccccgagttcctcccccacccacaattgccccctcatttatctctggggagtttataccaagactgtaaacattcctggaccaccagtttcccccatgttgctgaggagtttagcctttctctcctaattttcttaactcagaaatcaaaaagatggaatagggatgatagaaattgctaccctgagacatcatgctcatggaggatgcctggattttgttgggggccagttatccaagccctaagccctttggagtgtagaacgtagagtaggtaatacaaatacctactgtcagcccagcaccccagcaacatgagtaagtgcaagacacaggcatgaacattttcagctctagggaaaggcacattcatgttggggagaggtggagaatgcagtttggccagtctcagaagagtgagttttaaggcctaggaaagtgatggagatgattgcttgttggagagagagaaggagaaaggcatttaggggaagaaaaggaaaatgaaaggagcagtgaggatattggctccactggggaggtggaactggggtagtggccgaaccaggggtgggagaggacgtggttgagaggctccagaccagctggggctgtcatggagtgttgggggtctggagcagtcaggacttgaaagccgggacccttgtgagccctgtgcagtcctgaggatgtggcccaagggggagggcggaccagctcttttgcctcgtgttcttaatcttctcagtgggtcatcaggggtcatcagctgtaagctgtaatcaacggtgaggggctcgagaagagaaggtgtcaggtgactgctggggattgagctgaggacaggagaggcagggtgctgtctcctgtggcccaggcagagcggcacagacctggagtgggccacccctcatcaccccatgtgctgcgacagtgctggctggactgaaccctggaagagtacctggacacagtggaggggccaggacccagcagatgcagcctctagagcttgtccctgttttgtgactttgggagccatttttccatgtttaaatgggaaggaacacaagtcacctggtcacaaggaagcaggccctatgaaatattaagtgcaatgccaaaacagggcattgttactggtcttgagtctgccacaatcacaatgaacacctcccccattttctcacctgccacatttggacagccgagcctgctggactcgcaggggcaggagagtgcattttataattaaaagcactcaactgtaaggtaatgattgatatgagctatgggcttgaggaaatgagggaaggaggggaggataaggccaaagcaaccaacttcagaatctcacgggaggaggtaggatgcagggggtgccattagacagaatcaaagggctgaaccagaagggcttcctcacctggggaagtcaagacactgtgaagattgaggctgccttgcacagcggtaaagctggactctggatgtatgatgtatgtggattctggagaaccaggctacctgtgtttgaatcccagctctgccacttaacaacctagctgggccatcttggactaatcccaaatctttctgtgccccagtttccccctctgaagataataattcctttttttttttttttttgagacggagtctgggtctgtcacccaggctggagtgcagtggtgtgatttcggttcactgcaacctctgcctcctaggttcaagtgattctcctgcctcagcctcctcagtagctgggattacaggcgtgcatcaccacgcctggctaattttttgtatttttagtagaaatagggtttcaccatgttggccaggctggtctcaaactcctgatctcaggtgatccacccacttcggcctcccaaagtgctaggattacaggcattagccactgcactgggcccgaagataataattctaactcttaaatacttcacaagattctaagttaacacatgctgagaactatgctggtatgtagtaagcctccgcatccataggatagaaatcatagtaggatcaacctcataagtttcctatgaggatgaaatgggagggtctgtgttaaaagctttgtgcagcctatgggatatagtgagcgtgctggaaatattggccagtagtagtattgctgtttactcagatgtttatggatccctagataatatatgggaaggcacatggtaaattacaaagtgctatgcaaatgtgttgttattcttcactgggttcctgttaagttgtggggtttggggatggataacttccagaccagagtggctgctgtgggaccgggctggtgaagcggtatttcaaaatacattttcaggtgtgtttgtccatgtggcatgaatgccctgcattcatagtctctgcagagaggtgtgttccctgggatatctttggtggctctgttctatccctcaacttacaaattgaaatcattatttgttactgttttctcccatgaaccttctgttcctggccagctgtacagcctggcctcatctcccactgcccctcagaccagggtacagccatgcctgtaagcacttcattctcttctgttccccccagacatttcacttctcatctaaatcctctcttttcccttccccgtcattttgtccaacctctgctctcactgctgatacttttctttatgtttcatgacgtcagagcctgtgctagacctgcctgtacttggtcctgacattctccatttgtctcatgttgcagtataaaatcttaatccatattaaggtgctgtgcaaatctgagcacccctgttagggcaagacatatgccttctgggcctttgtttcacccatttctccttgcacagtgacaagggctcccagagtcacctaatggtagctatgttgatgaaagttccctgactcctccttggatttttgagaactggggtctcatcttgtcataagaatagcaaggtttgtatgggtttgggtctctgatggttcccatgactggtggaagacacagatttagaatcaagaattgggaggccgaggtgggtggatcacttaagttcaggagttcaagaccagcctggccaacatggcaaaactccatctctactaaaaatacaaaattagccgggcgtggtggcgcttgtctatagtcccagctactcgggactgaggcacgagaatcacttgaacctgggaggcggaagttgcagtgagccaagatcccagaactgccttctaaatgactgtgggagatttttgtccagtcctgctagaagcaaaatgctgtacctgttggcttgttggaagtacaagcctgcagtatttggggggaaagtaggaagggaagagggattcagtagggcctcattatcattaatcgtgttcctgaacttgaaagcaccatgggaaaatcccctcccacccctgcctctgtcctttctagctgcttccttgaggattatcaaaaagtgtgggtctccggtgggctcctaattccttcttaggggatagagacaccttagagaagcagggtaggtttgatgtatgaatccttgtcactcgcactaaaaggagcactggttgcagcctgcacaaattcccaaggtccacccgccagctgctttgacccaggaacctgcgtggtaatgagatcagcagcctgagttctcgaacgatgttcaaggcaaaccctaaccctgaccttcccactcctgttgatgagaacggtgactccattctattggcatcaaagcataaggccccttttttttcacaatgcactttttttgttgttgttgagacagtgtctctgttgcccaggctggagtgcagtggcaagattatagctcctgcagccttgagttcctgggctcaagggatcctccctcctctgcctcccaagtgcctggggactacaggcatgcaccactatgcctggctaatttttttatttttcgcagagacagggtctcactatgttgccagggctggttttgaactcctggcctcaagcagtcctcccaccttggcctcccaaagggctgggattacaggcatgagccactgcacccagtccgcaatgcactgttaacacatggcacctagagcctgtaatagtgaacagccagtctttttcagcctcaggctaggtcaccagggaatccagataccagatgccctccagcctccattccccacctcatctctcaggaaacagatgcacaaagcaagtgttttggtgctgcttccctcacagcatccccatgtgcattttgaggacaacctttgtatctgattccaattaatcaggttctccaggagttggaatgttggtttcaagtgactgaacaataaagtggctttcttcatctttcttggccagtccaataaaagtgtcaggtagcttttctcttgctaatggacacctaacgacaccctggcctgttggtcttgaccagagaaaggccagctcagggcagctggagctgaagaggcaaggacctttctaatgaggacataagtgagggacactggaaagaccaaaagagaatggaaagtactgacatggtagttgcagggtgctagtgagcagtcatgcccccaaatcagccaccttacatagaactccccaagttcagggccactggatggggttgtgacgcagtcaagcagggcccagaaagcatacaagcagttggtttcatctcctgtaagaaagtggcatcatccctgctttgtaaacggagaacctgacacacaccaagagcactcctagccgtggaaaaaagccgctagaacccgaggttagtctgatttttggttcctctgaaaattagcttttgctggatgctagattcagttctggacttactgagtagtctctgggtttttgacattgttaggcactgtgggaaaattataacaggtacgtctgcgctgagttgcttgctaattcctaggagagacttggacattttggacaattaagaagcaatacaggccaggcacggtggctcacgtctgtaatcccagcactttgggaggctgaggcgggtggctcatctgaggtcaggagttcgagaccagcctgaccagcatggtgaaaccccatctctactaaaaatacaaaattagccaggcgtggtggcacatgcctgtaataatcccagctactcgggaggctgaggcaggagaattgcttgaactggggaggcaaaggttgcagtgatccgagatcacgccattgcactccagcctgggcaacaagagtgaaattctgtctcaaaaaaacaaacaaacaaaaagaagcaatacagctctttgagaaagatgcagtcataagtggtgcagagttgcagtctgcccattcctgctcctcactcatcgctgttccgaacaagtcagccaggaagccgcactgcaccaaggcttttaaagataccagaaaacacctgtgaagctggaggtgaccattcaccaaattcgaatccctctaatgatccgcagcgtaaaatccctggagaaggtgtgtgctgacttgattcagaggaggaaaggaaaagaatgtctaagtgaagggaccagtttgaatgcctgccaagactttgagaatcactataagaaaatctccttgtggtgaaggttcagagacatgggatcgtttccagatgagaatccacaagctacccactgacttgcacagtccttctgagattgttaagcagttgacttccatcagtgttgagccaggaattgaggtggaagtcaccattgcagatgctcaaagtcaactattttaataaactgattagcggttgttataaaaaaaaaaaaaaaaagcagcagcaatatgggttgagcgcagcggctcacacctgtaatcccaacactttgggaggtcaaggtgggtgggttgcttgagtccaggagttcaagaccagcctgggcaacatttgaaattttaacttattttttaaaaaagaaagaaacattatacccaatatctgtcaattgatgactgcaatgtggtatgtctacacaattgaatattattaggtcattaaaaggaacaaagtgctgattctatgctataacatggaggaagtttgaacacatgctaagtgaaagaagccagtcacaaaagatcacatattgtatgattccattgatatgaaatatctagaatagccaaatccatagacagaaagcagattagtggttgcttagactggggataggggatggaggagtgactactatgggtcaggcattttttgaggggcgagggatggtaaaaatgttctaaagtgagattgtggtgaatgattgcacaactctgaatatacaaaaaccattaaatggatgaatattacagcatgtgaattacctgtctgctgtttaaataaaatagaaacaatacaaaatggaatgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttaaggtctggagttcaaggacagcctggctaacatggtgaaaccccatctctactaaaatgcaaaaataagccagccattgtggcatatgcctgtagtcccagctgctccagaggctgaagtgggaaaatggcttgaacctgggaggcagaagttgcagcaagccaagattgtgccactgcactccagactgggcaacaaagcaactctgtcttaaaaaaaaaaaagggtctttgtcatcccgtccagtggcatgatcatagctcaccgtagcctccaactcctgggctcaagcaatcctgtctcagcccactgagtagctgggactacaggcatgtgccaccaagtctggctagtttttaaatttttttgtagagacgaggtctcactatgttgcctaggctggtcttgaactcctgggctcaaatgagcctcctgcctcagcctccccaagtgctgggattgcaggcataagccactgcacccagcccctggacgttttggatggtggactttgagtagtttggggtaggaggactctggagtggcgctgacagtcctcaggaaggagtaagctttgccatgccagggaggatgcagccgtgctgaaagcatcccaactggggaggggggggggcgcggtggggagggacagcccctggtagagagaatggggctgggtggagagagtggaagccaattgcagggagtcttgaaggtgaggcagggatgtggattttactctgtacacagggtagattttgatcaggaaaataatgtcaagcacatgacagcttggaagcaggagtctgagctgcagccccagggaggccatttaaaagattatcccggctgggcgccatggctcatgccagcactttgggaggccgaggcaggcagatcacgaggtcaggagctttagaccagcctgaccaacattccccttctctactaaaaatacaaaaattagctgggcatggtggcgcatgcctgtaatcccagcaactcaggaggctgaggcaggagaatcacttgaacccgggaggcagaggttgcagtgagccgagatcgcagcacttcactccagcctgggcgaaagagcaaaactccatctcaaaaaaaaaaaaaaaaaaaatttatcccgagatggttccggtaaagggataggacagagcatacctgagccacgtttggaagggaaccggggtctaaacttgcatcaggaggaaagcgagctggttcttgaggcttttacagatcacgtatagtggagttttgtttgcacgttctggttgggacgggcaggaagttacggatccaagctggtatcagctagagcgggtctcaccagggccagtgttcctttgctgcattctcttggggggaaataaatgcctgggggttctctttgctacatttttgtctttgggagctgcttttttctctgggatcggctgcaataggccttgtgatgccagagggtaagaattcaagtttactcttgaccaatgggttgcacagatcacaagctgcaaaatatttaatcaccgaggtcatttgagggaaatgagatttgatcaatagaagtgtctgctctgttccttaagagttgagtctaaactgcttttctccttaccttcgtttggcaaaaccacagaccattaaaaatggaaagaataactttttctaaggcccacaaaagcttatttttaatcagttgtgtggtctactcacctttgtggtgttccccttgaccggactcacaaaaataaacgtgtgcaagcctagtggtttctgagcccttttaaagcagtacccctgtttctgacaactcttatttaagataaagcccatgggtcaatgcaggactgggtctgcaaccttggcccccccaagagaaaccactgtcagtccctgtcagttgctgatcatgatgcgcgggacacccattttcatttttaaggtttctagcggaagcctgttgagcacttgaggaagaccgtgtttcaaataagggggagtgaaagagaaaagggagagtagaaaggaaggcagtgaagagccagagtgactgcacgtgtggtatttattgagcaagcatttcttgagcaactcctgggcgccaggcatcgtagtaggtgctggggatttaaaggtaccgatgacacatcaccgcactcaggttcagaaagaggactgcccttcagtgtgacaggtgccaggagggggagggcacctaacccagactgggagtcagcaccgccctggaggagaagtcaccagctaggctgagacagaagagtgagtagtgagagctggacagaaaaaaatcaggggccctgtggccactggggcagccgtgagccacagcaggggctgagggagaacatgctgtttcagagccttatgcatcggggagcggcagtcgctccactgagtctcttagggtgaacaaatggtgagaaaagtcctctccaaggctgtgggcgggatgtgggtggtaggtgagaggtggaagatgccaggagtacatttgaacatcctaaaaggaaatagaaagttcatttcccctcgtgagtgcagaggggtgtgctcaggagatgggtaacagcccaggatggtgaactcaggtgtgtccgggccacgggccttcttgaacgcgtgcgggaagaggcactggtcaggggagggacaggtgctcttggtggtatcagatcttgtgaggtgcagacaccccggtgggtccagtgctcccacccagggacagagaaggatggggcacggggagggagagtggatggtggggggcctgagggtgtgcccagtcagagggctgaggagaaaggacctttgtgtgcgacagctcctgctgccagagcaagtgtgggttttatggcagctgtggcctcccgtcctaatatagtcaacagctccaaatcccctgccctgacacctgttagcgagaggttccctgagctgacctctccttgggctgcccccccagcatgtgcatctgacgcgtcgagggccagacccccaccctctccgaatcacacgcatcctggtcagcccccagttgacaaattgccttctctcgacttgggcaggggctgctggggttttgaggggcggggtttgttcagctgttgctagggaagggtgaggctgagctatcccaaaggaaatggggtgttcctctggcaagtggcaatcttggcaaagaactgagcatctggggagggggcaactccggacacaaagaagtcctggggagggccgacctttccccttaggatgggggaaatgaaatgcgcttaatgctgctacagctgcttcctaactttgcctctttcttcctttgacttttggaggagtggggtggaaaagagatgggggttcccaggcagccagctgttttccccactgacccatgctccaattcccactgccctggctcagtagcctccagtaagtgatgcccaggatggtgcggctccgtgtggccagcgtaattccctttgtctctcccctcctcccctctccctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggcttggctctcagagaggtgactaggtggggtgggccccagggccggagatctggggcttccaggacacacctcggaggtgattgccagggctcttgggatgttaagaccctgtgatttttttccaccacagcttgcccagatctccaggaggctaagtggtgctcggccagcttccactccatcactcccttgccatttggacttggtactcggcttagtgattagaggccctgaacaggtggtggtatccctgctctgctggagaggaacccaggtgcaccgcaagggagctgtgcgagggcagccagggagccctggagctctgtgaacttgggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtacgtgtgtgtgcatgcgaaagttagagtaatgggaacaggggaggccgagttaggaagtcctgattacatgcttttcatttttttaagtaatactttccacctatacaggttattcattaaaatttttaaatacaaaaaaatgcaaataaagtttaaacatttcttcagtcttctttctgtaatatggtttttacatagttgatcacatcatgtatgtaatttccttgccttgtcatttgttaacatgagtcttttcctgatatatttcaagcatgaatatttgaaacataatttttcatgactgtataagattccattattttaaaatcccataatttggctgggcatggtggctcacgcctaaaatcctatcactttgggaggccgaggtgggcggattgcctgagctcaggagttcgagaccagcctgggcaacatggcgaaacctcctctgtactaaaaatacaaaaaattagccatgtgtggtggcaggctcctgtaatcccagctactggggaggctgaagcaggagattgcttgaacccaggagacagaggttgcagtgagctgagatcacgtcatttcactctagcctgggtgacagagtgagactctgtctccaaaaaacaacagaaaaagtcctataatttaatgaactattttgtgatattaggtattttctggtttttcaccataataaataatgttgcagtgaatctctgtcagcatttttttaagcgtgcttccttaggacagattgttacaagtgaaattactaacttaaagggtgtaagcattttttttttttttttagacggagtctcactctgtcacccaggctggagtgcagtggtgccatcttggctcactgcaagctccacctcccaggttcatgccattctcctgcctcagcctcccgagtacctgggatgtgcagccaccattcccagctaatttttgtatttttagtagagacggggtttccccatgttggccaggctggtcttgaactcatgacctcaagtgatctgtccgcctgggcctcccaaagagctgggattacaggcttgagccaccgcacccagccagaaatattttaaattaattcaccatgcactcactacatgcaagacaccatgctttaaatgctgcaagatagcgttcctgcccataaaaattttgcagtctgataggaggcaaatgtccatgagcagctaccgtaaaaagtagactgtgatcagtgctttggtaggcagagaggaaagggtgagcacagttctgaccagagactggactggaggagatggtttttgaaatgagctgtcaaggacagtgggggctggattcttagtgtaataggagaggtgcacagttgggaacattcttggtgtatttgggagtgtttgcagaaggcacatctgtccggatcacgaatgatcttgaacgtcacagtggagacttctggagtctttacaccccatctgccagcttgcagagtgtgaacgggctggtaggggggcaatccacgccttgtcctagccaaccctgcagcctggggccctgtgccaccaggctctgatatggagggcaggtgccacggggtgccgacattgtcatggggcctgcattttcctctggaccctcaatgtatccctttggcatttcccctcaggtccgttatgccacctggagcatcataatggactctgtggtgccctctgacaagggcaactacacctgcattgtggagaatgagtacggcagcatcaaccacacataccagctggatgtcgtgggtaagagggcagaggcagcaggaggaatgagtttagtgggaagagccaggcttggagaacacagccggggtgtccaggtttcttaggggcagagtcaggatagcgattggcacttcttggctttgtcaccttgagcaggtcacttctcccttttgagcctcacttttcttatctgtaaaatagagttaagatcagacagtaacacggtcaaagctggttgtcactgtgaaattgaaggtgctgttcagagtctgtcctgaaggaggcgttgttggagaggtgttaaatgtagcgtaataggagctgtcgcttaatgctagcaagatgccaggctccttaaatacctgccctgtaatgctcatggcacacctgcaaggtgggcagtattagtctagccctgcacaggagcacaggcgcataggctcagagaggtcagacaccttgctaatgcagaactgcacacctgtgccaacttcagggcatcacaggagactctgggaagaacattgagcctcttggagctattaccgcaaccttttccttctaggagttctgaaactcactccctagagatcattgggtacagaatctctcagccagtgttcttcttgattatgatgatatggtctaagaaggagattgtggccaggagcagtggcttatgagctccaggtggcatgatgggattactcacgcctgtgatcccatcactttaggaggccaaggctggaggattgcttgaggccaggagtgtgagaccagcctgggcaacacagtgagaccctgtctctataaaaaaatttaaaaattagcctagtgcagtgtcatgtacttgtagtaccagctgagttaactgaggctactgaggtgggaagatcacttgagcccaggaattcgaagctgcagtgagctatgatgacacccttgtgctccagcatgggtgacagagtgagaccctgcctttaaaaaaaaaaaaggtaaaaaggagattctgatccaagaggttggggtaagatctgagattccgcgtttctaacaagctcctaggggatgctggtagcactgctcgtggaccacactttgaatagcaggagtcaaagtgactctggttttttaaggaggagcaggttgtgctgaggtctgggggtgcaactgaattagaaggttctccattaaagcatgagcgacttactgtgactgtaaatatgatgactgccttggggaggaggatcctgatggcttagggcctgaagagagggtgtccctttccccagctctgttttgagaggcttgggctcagcagaagtgctgggaggtttacaacccatcactgggaaagccaagtggggcgcaggtgagcccacccctctttagccatggcaaggtccccatgacaagtgcctcctctcccatcttccacagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcattttcttcctttttcctctcactcccagacattcattgtccctgaatgctccattaatccagggaaggtaattgcctaaatctccagtggatctcgcaacaggaaggaaccagaagctgggaaagttgtttacctctttgtcccagagttagacctcatcctcccctagcttagctgtctcagagatatactggccctcccttctcttctctttgctgctggtgctaaaactgctctgtaggtcattggccactgtctccactcacaacccctgctccagtcctggagggagtgggttaaacacaaatagaacattccatttgaagcagtgattctttttttttttttttttttttaatcaaatgctttggacttttgaagtccacttgttctgtacttgtaaaagggaaagaaggccgggcgcagtggctcacgcctgtaatcccagcactttagatcacttgaggtcaggagtttgagaccagcccggccaacatggtgaaaccccatctctactaaaaatacaaaaattagctgtgcatagtggttggcacctgtagtcccagctactcaggaggctgaggcaagctaactgcttgaacccagaaggcagaggttgcagtgagctgagatcacgccactgcactccagcctgggtgacagagtgagtgagactctgcgttaaaaaaaaaaaaaaaaaaaaaaactaaaagggaaaggtaataaatctcacttaacatctcccttcgctccctgggcctgcctgaaagttacacgggagcaacgtgcgtggccacatctcagctttgcccaactgactggtgtgtcgttggtttgttccagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaaggtaatggggagatggatgggaccctgtgctggggatttgatgtaggccccaagctgctggggcaggcggggaagccagtactggactgtccttgccaccctactgtatttctagtgcccagagccatggaaaaatacccggcctgggaggctggtttggtttggtattgtgttggtgtctgtgggttccctctctgccttctgtgtgttccttggctttgtgtggatccatgtgaggactcacggggacacggttttgctgtgttacaaatggtacttcagactgaagttgtgagtgagtggtgattaagagaaggggccataggccaggcacagtggctcacgcctgtcatcccagcactttgggaggctgaggtgggaggatcgcttgaagccaggagtttgagaccagcctgggcaacatagcaagaccccatctctacaaattaaataaattagccaagtatggtggcgtgtgcctgtagtcccagctagtctgaaggctgaggcaggaggattgcctgagcttaggtcgaggctgcagtgagctatgtttatgccactgcaccccagcctgggttgacagaatggtaccccatctcttaaaaaagagagagaaggggttaggcattcccttgcatactcgcatctgctggctgtgtatgcacatgtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagtgctcagcccaggggtggggcttgctgcttgcaaagagcagcccaccctcctgtactgccatcctattgcctttgaagaaggaggtcagcctggacaggtgaactgagttgccttcagaaaggcctgtctcaggcagccgcagcaggcttcacgatgtccatgtatcctgtttgcctgctgccgtctctcctctcccaagaggggaggtctgcgtgttgagccagggaggaaggagcctgcagcctgctcagggtggtggctggtgactgcggggccagggcttgctgctgtctctcggaatgtcctgcatgtgggtctggctgttcctgctggcactgccctcttctctctcccctcctttcccactctgccctgcttgcccgtcagggtctccggatgcccctgctggaggcagagaagcgttctgtttttatcatcgtccctgtcttggtcctgtccgtgctccccatgtgctcccaatcagttgtcttcgttcctcaacatcagggaaagaaaaaacagcaacacttctccctgtcatcagctctgctgtctccttgtcaggccttgggacgttctctgggctcagtctagggtcgtgcctcatgcctcatgcctctctgggaaggttcccaggggcgccgcctccatggttggctggtgggttttaaaggggaaggttgggaggaggcctgtggaaggaggagggccgtccacacccgtggggcaaagcgtgttccatgaaaccagtgctgtgcgtgctgggatgaaagcctcccagcctctcgtgctgaagggaaaggtggaccgaactggcttagctgctgtggcaatggggtggggggtgagtcctaatcagaaggtgggagaagagaataacaaaatggaactccgccccctgccgccacatttccttaagttttaggagttggggcctatgagtagaatttgaaagaactaccaaaaaagcttatttttggaaattaagtcagctttgcctgtggtttggctaggaataaatatttacctgtgtgcccctacagagatgacacagacccaaagtgggacattgagcaaggcacaggctggttcccctcctgtcctctgtcctcattctgtgagtgccaccatcaccaggtactgtggcctgcagaaataaacgaggcaccaaccctgccctcagggaccccgtgtcttcttagggacagaggactcagaaacatctgtgtccccgcatgttaagtgcatgcacacagtgctgaggctttgcagagaagggccatggctccctgaggagaccaagaaaggcacatagaagtgacttctcagctggcccttgcaggatccctgggtgcctgtacctctccagtccagctgagcaaggaggctcaggaattaatgaagatggggcttgtgtagcacgatggttctaggccatcccttttccatggctcaagtccattgaaggcagcctccaaaatcagggggttgcctgatcctcctagtgccacaatcccagtcctagctagaacttgccatggttcttctccctaaaagttcccaggggacaggagacaggtgttgcttttctaatggagcgggacctcgcatggacggggccctccaagcctgctaacaccctgttcgcactgactcagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagtggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctaccaggtccctcccataacacgtgggaattcaagatgagatttgggtggggacacagccaaaccatctcagccataccatacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccctccttgctctagggtgaccccactcttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacaggtaataatactttgactcccaactttttgaaggcattccttgcttgctattctagtggtggaaggtgtgtatactaacaccttctgggcggtgaaggttcatgaaatgcctgcagaaacattcattccactttctgctcgcagttgggtgaaatacagagaggtggagatggggtgcctctcaaggtttgaacttcaccagccccaacttatgccactctctgtttcccccgaaagactggtcttaggcaaacccctgggagagggctgctttgggcaggtggtgttggcagaggctatcgggctggacaaggacaaacccaaccgtgtgaccaaagtggctgtgaagatgttgaagtgtaagtgatgcttctgtccttgcaaagaaaatcttgtcccattccaagcaaacagcaggcctcgggcccagcagaacagcttctctggtgcctttgctgcccacacctgctccgctgcctgcttggggttacctgggagtggagggggtgttctgcaccttgagattgttctatgacgtcactctgttccttggcgtcaacctgggctgtggtcaggtgtttatcctggatccatcgcttgcaggctttcctcaccacatccctgcccactcactaccacctattgcaacaacggctcccatgagagggaagagaaaacaagtttggatgaagtggggaggagagaatcaagtcccagggaaaagcagcccctcgacacataccccactcccttagcctttatcctgccctcctcccttcccaagtaaatgagtctcaacgtgttctttaaagcggacgcaacagagaaagacttgtcagacctgatctcagaaatggagatgatgaagatgatcgggaagcataagaatatcatcaacctgctgggggcctgcacgcaggatggtgggtgccggccagactggctttccctgcccagcggggagaagatctgagctggggtatcagtcccaaggcctctctcagccacagctagggaagggggttaagagaggctgctttggcagaggtttaaaatgtgttatctcgggatctgggctccgctcattggtgttcattcaggaatacagatacctagattcacacacgtggtgtgttaacagaggcagctgagtaattatggtctaagagcgctcaggctgggtgcagtggctcatgcctgtaatcccagcaatttgggaggccgaggcaggaagatcacttgagatcaggagttcgagaccagtctggtcaaaatggtgaaaccccatctctactaaaaaatacaaaagttagccaggcatggtcacgcatgcctataatcccagctactcaggaggctgacgcataagacttgcttgaacccgggaggtggaggttgcagtgagccaagatcacgccattgtactccagcttgggagatactcccgctgtctcaaaaataaaataaataaataggccaggcacagtggctcacgcctgtaatcccagcaccttgggagggtgaggcgggtggatcacttgaggtcaggagttggagaccagcctggccaacaggtgaaaccccatctctactaaaaatacaaaaagtagccgggcgtggtggcgcatgcctgtaattccagctactcgggaggctgtggcaggagaatcgtttgaacacgggaggcggaggttgcggttagccgagatcgcgccattgcactccagcttgggcaacgagcaaaactccatctcaaaaaaaaaaaaaaaaaaaaaaaaaattagccaggcattgttcatgcctgtaatcccagctgcttgggaggctgaggcaggagaatcacttgaatccagaaggcagaggttgcagtgagccgaaattgcgccactgcactccagcctgggcaacagagtgagactccatctcaaaataaacagacaaactggggctcttaccccaatgttgctcgggaattttctggactatgctgggagtaattatttctctgattttttttgggtagtagaatggatttcccaggtcccctaagaggaggcaggagatgggaggttggccggggtgtgctgctgggggtggggtttctttgaggtgaagccaaacctgctcacctgctgctggccccatggcctcttctcctgtgcctgcaggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaaggtgtggaacctgaaggctcccctgggtaatgccagggtgggaacagagcccccctagtcttccagcctgtgacttatcatcttgtggtggcgttgtggatgcactgagcactggccctgtgtgccctgtgtgttgtcttaggctctctgggaactgcagagtcaggagcaccagtgtagccaggtggccttggggtcagactgatgcagggtccgatctgtgcactgccactttctgcgtagcctcaggcagctacttagcatcttaaaattcttcaaatacaaaataataataatatcagctgggtgcagtggccaaggcgggaggattgcttgagctcaggagtgtgagaccaggttgggcaatatattgaaaccccgtctttaaaaaaaaaaaaaaaattaaaaaattagctgggtgtggtagtgcgtgccgatagtcccagctactcgggaggctgaggtgggaggctagcttgagcccaagagtttgaggctgcactgagccatgatcacaccactgcaccccagccggggcgacagagcaaggccctgtctcaaaagaaaataaagtataacaatacctgttgtagaattgttatgaagataaaatgaaactgtctgtgagtgttgagtgcagtgtttggtgtgtaagggctggcctggtttgagcccagccccatgtggacttgctgtgctgggaggcaggacctaggagcatgcatcgctgcagacgcagcagaggcataaggggccagtctttggggaaggaagggaggagcgcttgctgtgatgagaagcctggagctggcagagaatgttagaagagggaaagcaaaggttcggggggcagagcagtgtggcagaagttctatgagacaagtcggctagttgcatgggtggcggccgcccagagccttccagctccctcacctccccgcctcccgctctcccttcctccttcctcagtgcatacaccgagacctggcagccaggaatgtcctggtgacagaggacaatgtgatgaagatagcagactttggcctcgcacgggacattcaccacatcgactactataaaaagacaaccaacgtgagtgccgacaaggccgccctgtgctggtggtttcatctgagaagcaaggagtggggtgggctgagaacccaccccccagtcccttcccacctgtgccctcatggccctgcctggggccactccaacctcccctgtgctgctttcagggccgactgcctgtgaagtggatggcacccgaggcattatttgaccggatctacacccaccagagtgatgtgtgagtttgtaatagcaattgccagggaggtgtgggatagagagcttctagcactgtagagtcctgctttctccctggactgaggagtcctctttctgccccagagagaaaaacaaaacattgtctgtggccattccctctgctccagatgttgaaaggctgatctgttctccatgctgtctcctggcactgccctgggtagaggatttgtgctgggggaggggaggcggagaagctctaacaccctgtggctctccgcccatttgcaggtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtaagcccgaggagatgtcggaggccctgagccaggccttggggcaagagtgggcttgaggggcagggggctagactagagagtatccatctccaggagacgtccctgaccttacagtcctgccgcaggtacatgatgatgcgggactgctggcatgcagtgccctcacagagacccaccttcaagcagctggtggaagacctggaccgcatcgtggccttgacctccaaccaggtaaggctgcccgtgccagagccagagctcaggccgtccccactgcgtgcacgcacctccctgagcagggaggaggggcccggcccatcgctgcttcctctcgcccatcacaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaaga

SEQ ID NO: 11 - DNA, 53638 bp, Homo sapiens
ttagtagacaaggtgagttcccctgtgctccgtggcaaagagtgcggtgggtgacattgacccatggttaggtaatctggtaaggaaagaccccgttgtaacacatctgagcaacgagaccaaaggaagggcttgctgccacgaggcgaagtctgcttttttgaacagagagcccagcagagttgggcggcaatcgtgcccagcactgaggccgaggagaaagagagcaggagcattacattactgcaccaagagtaggaaaatatgatgcatgtttgggaccaggcaaccgaaatcccttctcagcagcgcctcccaaagccgggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcctgcgtcgctcgccattggatctcgaggaacccgcctccacctcaggtgaggcgggcttgcgggagcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtaagcccattccctcggcccgccgccttctcccccggcgaccccgcccgcctgcccgccctgggctcctgggccggcctcggcgttaatgggattggggggggcagcctttttgtttctgctgctgctcccctcccctctcttcccccaacctcgccggccgggctcccccgctgtccacgtcgccatcttgtcgtggggggtgggagacgcctcgaaagtgctttcaggggccggggtctgagccctgcttgccctccccgccggccgtgggggcctcgcgccgcccacctacccgcctcaaaaacccagcctgctctgtggccccatccggaggggactttacccagcctgaaaaccccgggaagagaaatgagctgcagctcggtagccgcggtttgcacccggagcttccgctccttcccgcccccatcctctccagttccattgaaaactcggccctggggcggaccctgcacgctggtcctggctttccagtggacttggggccttgagttcccgactgagggactcgcgtggtcggatgcgatcttgtcctgtagttgtccagccgtcgcgggtgtctttgcctttgtgcattagggatttgccgcgatggccttaagatgcgaactttttagtttgcacgtgcaggttttgtttcgttttaatcgccttgaaaaacttgcctagactgagagtcagagtaatgggaatttagggaaatggcaacattttaaagagaacttcagaattggatacttgagttcatatcacctgtcacgagaacgcagatattataaatgaatatatgcctcattcattcttcaaataatgaaaatgtaggggctggttaaatttaggcagttttaatgatactgaaaaaagtatatgatgagtgaatgaaatgcggcactaaaatgttgcaaaaattttcgaactctgtctcattttcctgaaattgaagtatattaaaggaaaaccgtcaacatatatctaaagtaagtaatcactcggttagaacttaatgcaagttttataaatcaccttgaagtttgagtctaaggggtacattagagattaagaattgtgagttggaccagtggtgttaagagcggactcccccatcccccaacacacacacaattttgcccactttggcattttaacttttaaggaaatcacttaaggaattgaagatttagagtaagagttttggttagtagactggctttgctgttaaatccttccactcttctggcagagagattaatttccctaatcagtatcagcagaagataaacttgtttatattcctgctgttttgtagatcccttctcctggtccttcttcaatagaatattaaattcttagtttgtatacagcagagaaggtcacttataaaattcaaaaagtgagcaaacaggtctagattaattccaagagttaccaggaattaattgcagtttattttgcggaggtgattacagtgcttttgatgaaatgataaagctgctatattgtaaacctaaggcagattacctctgtgtagtgccagttttctatccttattatatattgaatcatacttaatacaatgcattaaattatgtaccactttttttatatacagtatcgaactcattgttttgccattcatccgttcagaatatcagaagcagttttgaaacgaattaataaattagctactgttcatcagccccaattctaaataagctcttagattttcctcagcccatctgttactttcaaaattttctcatttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatgggtatggttatgatactgtagatttaacgcaggacatttcatgttgttcctagttataggggctgaacttatttaatagcacgtgcattttgatttttagatttttaagggaatgtcaagagagtaatgattctgtttcaggcttcaggccagactccttcagagttttccaaaacaaataattactgaatcattaaagtaaaatttctgagaatagatattccttaatttccttcattaactttggccattaaaagtcaagaagctctctcatttattagcaaacttttctccttatgattctattttgattgtccttttgtttgaggaagcagcatatggtggttaagagcataggatctagaggcagatacctctgagttaagggtcccagcccttcacttgtgagcttgagcaagttactgaatgcctctgagcctctttcctccttttgaaatgatgataagaatagcagccatctgagcagttattgtaaaggttaaatgagataatgcttgtgaagcacttagcccattgcaggagtcttgatgacactgtgtacttgaaaatagatgttacctgttaaaattcttgtttaaacttccacaactcttaaaactcttttttgctagtccttccagctgtttcctttagtttcttttctgtgtcttcatgcatcttttctatctcctgaaagtgaaaagactaacattggatccagagcttgaaaagcgtttttttcctgttacaatgggcaaaagagtacatccttgggttatattggcacctagtatcagttatttttcttgagcatctgatctgctctctactctagtggaggcctcctgcttcacaattgctcacccctgtgttttctccccaaatagaatactgagtttactctggactctagagtcaaacatacacagtattctagtcttactgttcatttaagcaagatatgtgcaagacactgcattcttagtactggcagtaagttaaaacatttttcgtcttgatgccaaagtttagacaattttataaaaattaacctttgtaaaagataatgagttgataaaatattctcagtaaagcagctacgtggtagaaaaactgtcctttgcttatgagtttctccagagttaagaccattgggttccatctgaaggcaagacttcaagcttgtcttactggtctgttttgtggctcaatttgtatgaagtctatgcactcttccacacgtgtgtatttactgaactatcgagttattttagactgagaaagtattggagttcattcctacggtccactgcagagcaccttgtgcagtttggagaatgtcaacttttctacctgttaacttccattgtctttacttttaacgccattgtctgtgactctaatggtgtcacggctcagggtttagattttgtggttacattctattcttgtatgtcaagagtggtgtatagaaagctgagggggattatttagtctcttgactgattttttttttttttctgaagaactcagtttattatgtttggtggtgaaataaaaattgatgtgcatggatgttaaagatttgggttaaattgtgtgttcatagatgccttctcttagtatataattttttaaatttagatacttaaaatactgtatccctttatctaagattaacataagtctgtttcttaaccaggataaaaaaatctaaatttaaatgtgatgttggatgagtttccaatcaagaaattgattttttaaactttgtgactagttatccagtgggtggattttacccagtgtgtgtatgtgttttctgcttaactctggaaggttagaaagagaatttgaaactaagacaagccaagcttcttgttgctcagtatttttggtaaaaatatggtcagattgtttaaattaactataggctttggaattttaaaaataattatatctcttggtctcttgacacatcaagaattaactgttttgtatatgcgttgagtattaatgttcatgttttctgcagtagaaatttataaacccttatttatttgccagacatgatccctttagagaaatctagtatctaaaacctgaatttttaaaacaaaatttaaaatttttgtttcataaaaacaaaaatgtgattacctcatggcttttttcttatagcttttgattgttttttaaaatcgtagttcaaaaacattaacctaaaatttaccatcttaaccatttctaagtactgttcagtagtgttaagtatattcacattgtgccactaacttccagaactttttcatcttgcaaagctgaaatcttacccattaaacaactcccaatttccccctctcctcagcctctggcaaccaccattttactttctgtttctgcaaatttaactactctagatgcctcatataaatagaattatagggttttaatatttttgtgatgggcttatttcactttgtgtaatgtcctcaaggttcatccatgttgtagcatgtgtcagaatttccttcctttttgagtctgagcaatattccattatatgttccatattttgtttctccattcatccagcaacggacacttgggttgcttccacatcttggttattgtgctgctctgaacatgagtctgcaaatctctctttgaagctttcactttttttggatacatatccagaagagggatgctggatcatatggtaaccctttttaattttcaaggaaccaccatattgttttctatagcagttgcaccagtttacattcccaccaacagtgcacaagggttcctatttctccacatccttctaaacacttgttttctttctttccttccttctcttctctttctttcttagccatctaatgtggcaaagtggtagccatctaatatgttgaagtgattgtttttaagggcttgtttgtggataattaaccagctgaaagctaactacagtttgccagtggaagctttaactgaaaggagagtaagtacctctaaaaggagaattcaatttttctagtgacttagatttgttatgccagtactttttcacagaaacactttttgggtaaaatagtgtacacctgttctattgttgataaagcccaatttaattaggaaatttgttctctaagatttaaaacaataattgaaataatgtatttttattaaaaactgttcccaagatgttagcttttagctgttctggtgatctcaactgttatttatgagtgtttctttattttaaaatttcaccttaaccggttacagttttaaccataaagattatttcaacatatgattttgaaaatttattatcttgtaaatgggaaaatgtagtgatggaacatagtttactgtatgtagttcttcacttgtttgaaaagtcacaatatatttaggcaaattaatttaaaagtgtctagtatttaatattgcaattttcactcattaaggacaggtcccccgtgtttcccccttttttttttccaagtagtttgggaggatttgtttttccagctgaaaaatactatggttaaaaataaggtttaaaggcgaaagttgaagtctttgagggttgggatacgtttctgttcttaagagtcttgtaaattcagatgctaagcaaatttctttaaaatgatttctaccctccccctttccattataaaactggatatgtttcagtggaccaaatcccaagtaggctgaatttgaaatttgtgggctgggcgcggtggctcatgcttgtaatcccagtactttgggatgccgaggtgggtggatcacctgaggtcaggagttcgagaccagcctggccaacatggtgaaaccccatctctactaaaaataccaaaattagccaggcgtggtggcgggtgcctgtaatcccagctacttaggaggctgaggcaggagaattgcttgaacctgggaggcggaggttgcggtgagccaagatcgccccattgcactccagcctgggtgacagagcaagactgtgtttcaaaaaaattaaaaaagaaatctgtggtgtgaatactggtacgtggtgtacacagtgagctcttaataagtatttgaattaacaaatgagacaatgattgaataattggatgaacaaagagaatgcaggtttttaaaaggtttctttagaaatattgtcggcccggcacggtggctcctgcctgtaatcccaccattttgggaggccggggcaggtgaatcacctgaggtcaggagttcaagacaagcctgaccaacttggagaaaccccgtctctactaaaaatacaaaaaaaaaaaaaaaaaaatagcaggatgtggtggcacatgcctgtaatcccagctactcggaggctgaggcaggagaatcgcttgaacctgggaagcagaggttgcagtgagccaagatcgcgccactgcactccagcctgatgacagtgtgagatgctgtctccaaaaaaaaaaaaaaaaaattaaaaagaatgttttaattctttagttccctgtctgagattcactgattggtaagaagaaagttaaagaatctcctttgactttttttgatatagatatttaaattctattactttatagtaaggttggggtttattttctttgctttataatagaagagcattgattattctctttgctttataatagaataccatttaaataggagttccctgagtgtgtttacaatcatttgatctggctaaactattttaatgttaatgaaattttaaaattttggaggaaaaaatttaaaaactacacaggtgcacaaagaaataaaaatcacctgctttttcactatgtagagaccattgtctactatttctcaattctgtgttacatctgtatgttaataactgtaggattagggactgagtactgtttttaacctgcttttaaaaaatttacatctacattttttcccatctaaatagtgaggaagagtatcagaattttgtaggcttgtggtgatggttaaattagataatattaatgttgggtacttaacataatatatggctcttaatactctccagatttcagatatagtctgttttaccattactgcctttttatcaaacctattctcaaaaaagtgagaaaagtgctgagattacaggcgtgagccaccatgcccggcctcatggttctttcttaataataaattagaagaagtagaattacagggtcaaaaagtatccattttaaagctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatataaaaaaaaaaaaagtaaaaaaaactccctctctcttctagtgtctatatatcagtttcctagaagaaaacgttttgccctacttggccatgtgaatggagttccctgattacatgagtcaaatatgtcttattgtagcatatttgatggtcttcttgtagaatattatcttactatacacagaactcttgaccagtaattaatgggccatgagtttttgttgcaagtcatttgaattcatattctatagttttctaccaagtgtagtcattctgcaagctgttcttgtcatgacttttgggaagttgagtatttcttctatgggttagggttttcatctcaagaaaaagatgatccttttctctactaaatatgtgttaagatcacacatttttctagatcgtttagctctactgtgtgatcttacacaaattgctttattgggatgataagaataattgccttataggattgttatgagaatgaaatgatacatcaactcatatgaaacactcagaacagctcttggcacaaagtaagggcttaattaagtagaaactatccatatattcataatattatagtattggttaagttgttttcaacattgtttagaatcgctcaagccttctttgtgataatctgacgaaggctattcaccaccagtgagtaaataatagtggcagaatagttactgatgcttttcctttacttggttttttttccataaacatctggcctttgcagactaaatactggtttatgtatagacatgttattctaaaataattttccatagtggtaatactaaaggaagaaaaatgttctcaaagctatttatttgggatgttaaaggagggggaaattaagaaagcctacatttccatgtcctttgtgtccagaatctcattaaatgtcttttaacttgttagcagaggaaagttggatattgcctgcctttgtagctaacatagttaaaatatttaaatggttatagtgtcaaaccagtagtcaaagccttcactgtgaatggatgaagggatattttcttgaataatttaagttgacttatttcagtggttcaaaaaatttcttcaacgcttaaccatgactcaggcacctaactattatactatgtcctgtaacagattgttgtgcattcatttattcaacaggtatttgtgcagctaatttattgagtacagcattgaatcgttgatggcttaggccacagttgaacattccattttttatgttcattcattcattcatagcatattccatttttaaattttcagttcattgcactttaaagtttgaggttcttgcgaagtacagacttttgggtttaagttttgttatttaatgtcaaccaccacaggcgcattggccagtctgcttttagaattttcagacatacatacacaaaacattctcacaagacaatctacttattttcttttttattcctgtgtttcttaacacaggattaatgttcagatctcttttggagcaaaataatcctctgaatttttgagatgtacccagtgacctcagtctgagtatgtatactgcattaaaaaatgtaaccttgttccttttagtggtcatttggtaacagtttgatcataaacaaatgcagcctcaaacacagaaggcttgaggcaagtatacagaactatggagagatcatttagatgatgtagaatatgccttttctttttttacaatgccaccaaaatgaaaacacggttttaaaaattctcatagagtgtaacttcaacactgctttaactctattaaacaaagcactgccatgttgtaattcctatttattactctctggagttgtataaattaccaaatccgccttttgtttgatatccttttcaaatatctgagggtagctatcatgtttcttccttctattcttaaaaaatagtcccaaatttcttgaatcttttaatttaaaaattatatattgagcatctgatttgtggaaaggcataggccatattaaaaatggggcttcatattaaaatggggaaaagggtggagattctcaggtggaatctgagatctgccacacactaatagtgttacctaaccctttttaaagacaaagaaacaggatcagaaggtcactttggaaaatttatttggtaatattggataggatggattagtatagttggaaaacagagactcttgctttaggagagctgctcctttgtcatttccagaatcttaatcatggtcaaggtttagagctaaatatttaatagaagaagtctttagggtatgctttctattgtacacccttatttcaatacatgtgttttttcctgttatgtaagtactttattattatttatgcatcttctattaaagttaagcaaataattatttcaaggacacattcttctacatacacacaaagtttagggtcactgaccttcttaggttctagtcttagatctgttaccatctaagagcatataaataagggaaacagaaagaaaaggatttacaagctgagaaggaagcaatgcagagaaagaagagtgatagagtaggtaatttggggaaagtcagtgatacacagctcttaaccatgaacagtgattcttcactcttgaatgtttgtgacattcatgaaggtattaaaagctgacttttaaaaaattgtttcagagaactggaaaaaaattcagttgccacattcttccttaggtcatctttgaactctactcatgcacttacgtgtttaaggcaaagttttactaaacgcacacttgttcttgctggcttattgacttttactgctagcttcttattcttagcaattatacctcacattacatagtattgtgaaactcactatattcagtgttttgcctgacaaacatggtatgttataggatgtgtattcagttatagctaaaaataaattattctcgtttttcaaaatttgctggcctacctgttaagcttttgctttaagacctgctaatgtttctcaaacttctgtggttaaatcacctgagtgtctagttgctctatggattcccagggacccattcgccagagattctgatttggtaattttgggatggaactcagggatctgtaaattttacaagcactcagaaatgaaacatagactttaaacagctaagagtgctcatcaggattatgttgatattattttttaaacagatgtgccaagcctttaatttgaatttccagggttgggatttggccttctatatttgggggaaaaaagttctattgatgattgtggatatataccacaggtcaaccattgaatagtctagtcagtgtagttagtgtattttataattactaagttctaagtatgtggtgtattaatgtcttaggaggtggatatatttcctgtatttgtaaagcatttgggtaggttttttaaagagaaaagtatgtaacaaactagttttgagcgttgctcttttacttctttgggcatttttgaagaacacgttaagtatcttcttagagcagaggggctcagagtggtccccagattatcatcattggtaacacctagttggtgcattactaacttgttagaaatgcacattctcaggcgccattcagacttcataaatcagaaactctggaagtaaggctcagcattctgtgttttttttttctttattatactttaagttttagggtacatgtgcacaacgtgcaggttagttacatatgtatacatgtgccatgttggtgtgctgcacccagtaactcgtcatttaacattaggtatatctcctaatgctatccctccccgctccccccaccccacaacaggccccggcgtgtgatgttccccttcctgtgtccatgtgttctcattgttcagttcctacctatgagtgagaacacgcggtgtttggttttttgtccttgcgatagtttgctgagaatgatggtttccggcttcatccatgtccctacaaaggacatgaactcatccttttttatggctgaatagtattccatggtgtatatgtgccacattttcttaatccagtctatcattattggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccactaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtcttttggcagcataaatgtcgtcttttgagaagtgtctgttcatatcgtttgcccactttttgatggggttgtttttttcttgtaaatttgtttgagttcattgtagattctggatactagccctttgtcagatgagtagattgcaaaaattttctcccattctgtaggttgcctgttcactctgatggtagtttcttttgctgtgcagaagctctttagtttaattagatcctatttgtcaattttggcttctgttgccatggcttttggtgttttaaacatgaagtccttgcccatgcctatgtcctgaatggtattgcctaggttttattctacggtttttatggttttaggtctaacatttaagtctttaatccatcttgaattaattttagcataaggtgtaaggaagggatccagtttcagctttctgcatatggctagccagttttcccagcaccatttattaaatagggaatcctttccccatttcttgtttttgtcaggtttgtcaaagatcagatggttgtagataagcggcattatttctgagggctctgttctgttccattggtctatatctctgttttggtaccagtaccatgctgttttggttactgcatccttgtagtatagtttgaagtcaggtagtgtgatgcctccagctttgttcttttggcttaggattgacttggcaagcattctgtgttttgagaattcttccaggggactgtgatgaaaactgacgtttgagaaccttcatcttagagtaaaaactttacatacacatttttgttgttttatttatctagcacaatacttcttttttttgaaatggagttttgctcttgttgcccaggctggagtgcaatggtgtaatctcagctcaccacaacctccatctcccaggttcagttgattctcctgcctcagcctcccgagtagctggggttacaggcacgtggcaacatgcctagctaattttgtatttttagtagagacggggtttctccatgttggtcaggctggtctcgaactcccgacctcaggtgatccgcccacctcagcctcccaaagtgctgggattacaggcgtgagccactgcacctggcacaataccttatatataatcagggctcaaagatttgttgagaggctcaacaccaattctggaccaggaaagattttatttatatcactagtcaggaataatctaaaaacaaaaagcacattcttcttacaagtaatatttcaatacacattaatgtaaacacatggaaaagtattagctacttaataaattaacatgtaaatgaaaaatttacacattatggctatttcagatgtgatatagatttcattttcagaaggaaccctccaatgtaaaacagtgattcttttccccgtttattttactgcattagaaaatcacatttaaagtaagcattttggtgaggtttggaaggtgaataaatccatcttttctttaattatggatatttaagagagatgttgttgtgccgtttagataataatgatctaaaccaagaaatttagttgctttcaaaaataaaataagtgtatgcattctgaacatttttctttagaaacaaaccatttcatctgtttttttgaatttcaaattaattatacagaattttcaaaatttgaaaattaggttagcatgagaaactgaagatactgaattatattgcctgttcagtctatacttttctttaggatatacagtaggaaagaaatatgatagttcaagttagattactacttctttcagagttttttgacaaatgcaggtacagtgatagtgtcagttcatggtgaatttttgttaaaataaattacaaaaaatttgtgatcctggtatcttgaaactagttaatatttgtaaactttgctaacactgtatatcactgtattctggttttatctgtgcatctatgagttatatgtgtgtatagctacatatgtttatatttatacacatacattacacacaggagtggaatcatactcaattttttttgtatagcctgctctgttcatataatactatattgtagcatctagtataagcaaagattaatttttgtagactttgcttttatcctgaaattttgtggtagctggtttaatggaaagacaatttctgtgacgtgttttgtcagttagggattgaccctggtaaaatattgctggataacaacaagcaatgtaaaaatacatttgttccataagataacctccgtgaaggtagagacttggtctgttttgtttattgcaccgtgtcctgttctgggaagagtgttagactcatagaagatgatcaagaaatattttttgaatacatcaataacattctctaacatgtgggtatcctaaaggtttatttttaaagtttattgattagaattcagaagatattttcccagataaaataatagattgctagctgtcttgaaaatgtaatttatatttaatttgaaatgtcaggtttttgctattttttccattaagtagagatagggtttttaaaaattacatgtgatgttttaagtattctggttttgcaacaattactagatagaaaatgtaacaacagatcctattaataatacttccaataatacatataaaatacttgtctaaaagtaaccctccttaaaaaaacaaagctggccaggcgcggtggctcacgcctgtaatcccagcactttgggaggctgaggcaggcggatcaagaggtcaggagttcaagaccagcctggccaacatagtgaaaccccatctctagtaaaaatacaaaaaattagccgggtgtggtggcaggcgcctgtaaccccagctactcaggaaaatcgcttgaacctgggaggcggaggttgcagtgagcggagatcgcaccactgtacttcagccttgggcaacagtgcgagactctgtctcaaaaaaaaaaaaaaaaaaaggcaataggattaggtatcaacttaatgaaaacttcgtgacagcactttcttgaaaaagactgtggaaaccaaagttagtaaactcctgtttctgcctgggttcggaaaacataaagatgataaagatgtttaagtattcctttttttttttttttttttttttgagacagtgtcttgctctgtctggagtgcagtggcacaatcacagctcactgcagccttgaactcctgggctcaaataatcctcctgcctcagcctcctgagtatctggaactacaggagtgcaccattacactcggctagtaatttgattggttaagaacattaactataactcacacattttcctgaccacatttgcttaggacaaaacagtaaaagacatgagtgtagatgaaagcgataagggaactaatcttaaacactgaacctcttttcagcaaattggctttctagtttctcagctctctctttacacctctaaatctctttcctggcaagatcatttatttgccttggtttatggtgatactcttcattgttatactggtgggtgattgttttaattgatagctgtttttttctacttcaggaagatgacactgctggctctgctggctctgatgtttaccttgtggctaatgcctgtgtttgcctgtgttcacatttattccacgattcatttgttaacatttactaagctgcttttctgtgccaggaacttggctagataaataaatggttgtttttgtacacagaattagctgtcataatcagttactgtagcatttattcttgcaaaaatatatatttatacttcaactagtgatcgaatctcaacttattaattcatacattcagccagcacataattgaatacttcttatgtgtcagaaactgttctaggtgcttgggatgttcattgaacaaaatagacaaaagtctccgcctctatggaacttactttccagtgaaggtgtggattggtgggatagaaaataaaataatcaagtaagatatgtacttaggctttcataaaaatacagcagggcaagaggaccaagatggaggcagtgatcagggaatctcaatgagggtgagactgcgacaaagacttgaaaaaggtggagaagcaagccttgtgggtatttagggtagcagtagtccaggcaaggggaacaactagtgcaaaggctctaggaggcaatgtgtttgaagtgttttaagaacagtaaggaggctagtatggttagaacagaatgagcaaagggggcaaagtggtagaaggtgagatcaaagaggtaatgaggccattgtggaggcccatatggactattggaagggctttggcttttactctaaatgaggcaaaaaccattttaagcagagaggagtgatatgacttgatttcttgttaaaaggattattctagttgctgttacagaaaaagattacaggggtgcaaagaaacagggagacaaaagaatataagattttcactgtaacttatatctagtatgcttgcttatacttgaaaatgcatatccagataattgtagtaaattcaaatattatgtttatttaatagtactaacattgatatgctggttaattatgattaggagcactaataaagcacaaatcagggattcccaaaaagaatgttgaaagggcagtcagcttttcctgtgccagaaatcaaagtcatagcagatttggggcaaatatgtcaaagtcaaacttacgcacatcactactgagaagacaaagatgaatgtgtgacagtttcctgcccccaagaatctttaagcattgtgaaggaagattaatatagccaaataactagagtgatcagttctaccagagaggaccagttttggaagccagaggaaaaaaaaaaaaaacagaaacaaaatgatgtttgaattaaatctttaaaagtttctcttataaatttaccaagccacatattgggaatggtaccccaggcagaaggagtagagtaagcaagccagaaaggaaatactatggtgcttttgagtaactgcagtgtggctgaagaatgtggaaaatgatgaggataaagaggtggacagggaactaggtaagggagggcttccttttaaataattagaccttgtcctgtgtacatttaatgggattttaatcaggccataatgccaaatttctttacttcggaaggatctttatggtgatggtttcagaaagaaattaaagcagagtaacagtggttagcaataatgatcagctagtggttcccaaacttacgtatcatatgcatcttggaagtttttaaaaactcagattttgggatcctgacttagatctactgaatcagaatttacagattcaaattcccagtgaggcctaggaatttgaaatgttgaatgtccttcacgatgcagctagacaagcatttgggaataaagcattaggtgactatttcagtagactaaggagtgggaggccatttaagctcaaaggctattctacttctcactatatttctagtacctagcacagtgcatggtacttgatagatgcatcctttctcccatacctcgccctacacatctcttcatgtgtatccttattaatatcctctattataaactggtaaacatgtttccctgagttctgtgagctgctccagcaaagatgggtttgtgagaatcccaacttttgaagcctgtcagtcagaagttcctgaggccagacttgcaactcctgttgagggggcagtcttggggactgagccctcaacctgacactgtctccaggtagatagtgttagaattgaattgaaggacacccagttggtgtccgctgcagaactgattgctcacctggtggtggagagaacccctcctctcccgatagggttgcagaagttgtcttctgtgttgttgattgctgtggtgtgggagcagaggggggaaaaaagctgttggagagttttttccaaaacaataggagattatttagatttataaaaatagaatcaaagtagattaactgagcacattgtgaaatatagagtagagctgtgtgtaaggagtatatcttaatgtcaagctgacaccaaattgaatgtttgctggaacgttcaaaaatctaagcttcccaaatctgtgaaaacactcaggttagtaaacagtcttatgcaaacagcaagacaatgctcaaagccatttaaggaaaaagaacagtaactgaattctcttatggaaatgtgagatgttgttttagtaagtactgatggtgttatactttttgtttattcgtttgctggtatttcagttcctaaaattccttcaaatatgctgcaaaatacaaaccaagaacttggtggattttccatttgttttcctgtgggaaatgatggaattaaaaaccttgaggattagaccttgagagttaccttccagtgtttatgccaccattatacaaaattctggaggacaaaacccttcccacttaaaaaccagttagtttcagaaaatcacctcatgttaggagactgcatcattatagtatgtgtgttagctttaggtatagatctaaaatatttttaatattttaaaaacttaagcctttcttcattaatttggcctaatacaagttagaataactttaaaaatgagtacaaacaacaaggaagggccaggcgcagtggctcaacgcctgtaatccgaacactttgggaggccaaggtgggcagatcacctgaggtcaggagttccagaccagcctggccaacataatgaaaccccatctctactaagaatacaaaaattagctgggcgtggtggcacacgcctgtaatcccagctactcgggaggctgaggcaggagaattgcttgaacccaggaggcagaggttgcagtgagccgagatcgcgccattgcactccagtctgggcaacaagggtgaaatgccgtctcaggaaaaaaaaaaacagtttctgtgactgctagacaaatgttgagcaagtaaaacaccaacaatgttgaacttagatattgaaatagctgctctgtacaaataaagtctactgggagtatagactgaattaccatcttttgactctttcgccataatgattggcattaccggaagggattaccttgctttgaagagctgctggacagtagagcagagagcatctattaccattgtaggtgcctttcagttaggattttggatttataagcaaactccaagaaagagcctggttctgagtttctctgaatagcttaggtcaagtcctaaattctgaagccaactcctataattccttctttatgtctttggcatgtgaagtaggcaaatttcgaactttataataatagcctagacttacaaatacttgccttggtaatcaggatgagtttttgagagacaacatagtctagtgttaatcgcgtggacaccagactgcttgagtgaaatacaggttctaccatttattaacggagtaatgttgggtaagctatttagccagggtccttatctgtaacatggtgataataataaagattaaataataggtgaaaaatgtttagaataccactgtgttattagtaagcaccatgcataggtgtttggatttaaaaatactggcaaaggccaggttgggtggctcacacctataatcctcgcactttgggaggccaaggcagaaggatcgctttagcccaggagttcaggaccagtcgaggcaacatagattccgtctctgcaaaaaatttaacagaattagttgggcatggtagcgtgtgcctgtagctacttgggaggctgaggtagggagggggaggattgcttgagcccacgatttcgaggctgcagtgagcttatgatcatgccactgtactccagcttgggtgacagagcaagactctgtctctaaaataaaatgaaaataaaactgcaggcaaaaatgccaactgaagagtgaacatgaacttttctttgcatttttcttgggcctgagactttaagaagtgcagggcagttaaaatgatgagatataattctcacctatcagctcagcagaaattaataagattaaaaagatgcgtaatatataatattgcagagtgcatgggggaattgatatacacattcatgaactggcagagacaaaaatgggcacagaaccatttggaaagctattgtgtattttaaaaaatttcagtagcacattttttatatcatgaaatttcacttcagaatgtcagtcctgtagaaatactgacgcaagtgcaaaaacaacaaaaaccaacttgtaccttcaaggccagaaagagttatttcaccaaataacataattgaggtacattaactttattagaagtaaatctgataatctgctcacattttaaatagttatggtttaacttcagttcttgaagtcacatatttttacaattaggaatgctaacaggctttttgtgcaatacgaaaagatgactttaaatgcctacaattattttgtgtccttttatttttttttaatttttactgacctactacaaagcactaaatattttatgttcttaatctgaagaacaatagacattctctataaaacaactcttgcttattcatgaactttgtacacaagaagcttaataagacgggctcaaaattatttttctaaatatatttcctatacaaaataatttcaagatataattgttacttttgtgtctaatactgtatgttaaataataaaatggtaagcatgtaaaaactacaataccacaaagattgagctattttgccagtagtatactccaactttagttctagaacagttgtagaaatgggtaaacaaactgttttaactgtactcttaactgaaatatagtaccttatgcagtagcagaacatatcagcagaagaacttcacttgacctgtacttaaaaacaaaacagatgcaatttataaaatttagagaaatatagtgaccttatttgcatgtggaaaatgtacttctttctgatctacatatcttctgttgtgcaatgtaagcagtaaaacaaatagtacaggattcatctctgtgggacctagaccccctggtctaacaaataattcttggtcagtactgtaattctgtggtataaaactgataaaattagccttcctgtgactagacaagaagccgggcagtttaaatgctgaaactcacaagaacttcagaagctttagctttaagctttaagcttacttagaaatgttataagacctccagtagtcacatatgaagaatatcatgaagatttttccattaaatctttattatagatcccttgattggtttctgtctagactcattgtgtgataaaggacataataatttttatcaccttcatctaatataggtttgtcaactctatattagttgttttcttgaaggctggttttcttccaaaattcagtcttattttcagtctacactagcttttaaatatactgtcctttagatgctttatctaacctcaaatttctaatggatttgtcttagacacttattgccactccttagatagtcattgctatctttgaagttctggacgatacgtgtattacagaggaactggagacattccatcaccatagttagcttgattggataccctttaaaagcatatactcgcgcctgtaatcccagcactttgggaggccgaggcgggtggatcacttgaggtctggagtttgagacaagcctggccaacatggtgaaacctgtctgtactaaaaatacaaaaattagcctggcatggtaccacatgcctgtaatcccagctactcaggaggctgaggcaggagaattgcttgaacctgggaagtggaggttgcagtgaaccaagatcttgccattgcactccagcctgggtgacaagagcagaactccattaaaaaaaaaaaaaagcatatatagcacatattataaggttttcaattttttcaccaagtgtttcatttgggtagtcatttattggtagtttacatcagttgagtggttcagaaaaaatacagtaagttgcttataaaattctgaacactttggccaggcacaatggctcaagcctgtaatttgagccctttgtgaggctgaggcaggagaattgcttgagcttaggcgttcaagaccagcctaggtaacaaagaacgcctggaatgattgtggcatttgaactaatattcaggtttaacaagagataattgaccatcactctattttagaggctttatttgaaccagatagaaatctatttcccacagctatcactgcctgtcacctacaacttaagggggttggggaggaagtgagagattttctgttagggccaatagggacctgctagatacccccccatcctgggaatggtgtatggaactccagtgtatgctggagttattatcatcatacttgtttttttattttactcttctgcttatacagatcaagtcttacgttttatttttaagtttaaattgaaaacatttacagagaacaatgcagtgaaatgaaaaaattacagactgctggcatttgcattttcatgtagcctcagtgactaatttttttttattgtacagcattgagaaaatcctagttcatataactagttatagttcatatagattcatataactagttttaagtgataatagtttcttcctttttttcctccaccatctaaccagatgaagataatagtttttaatagctcaccgtaaatttcaaggtactcaagttaaattgatctagatgcttgagttgaaatttttctatcaaagttcaataacatgcttacattccttattaaagtataaaagtcctataaacacacaaacttgagtaagtactaaaactagtatcagtattgtcacaatacaacatgttatattgtaacaagagcatttgctgagaactgtgcttgttactccagaatgttgcttctatggttgtacctttcaactttgcagatcatttggaaggaggagagatttggggtggagacaattcggtacttcattcacaggatgtaaggaggattaagtaaaataatgctggctaaaagtccttatttagcatactgcccaatgctcactaaatcataatagctgtttttaacatttggtgaagaatctatttaacaggagtgagttgaggggcataggagatcatgtgagtgtttaaagtagaagcagcattccccattaagaagagaaatactgtggaagagcaaagactttaaaacacctgggttcaaatcctatttgctacataatggctacttttaacctattgaacgccagttccctcatttgtaaaatagggacaatatttaacctatttacaggttgtgagagaactaggcacctagtacagggtaatgttggcacatggtaacctttaataaactgttgctattcaacaagctattagatgtcactaggcagttaagcaaaggaagacagcttttgcttggtgtgacaatgaaaatctttctgatttccttcttggaagagttccctgaagatatgtcattgtattgacacctttatttttgctaacctatccctctaaattctggatattgtgtgtgccacagctttttttcttccatattcctgcatttatttggcacctgttgtgccagtaatagataaggggctgctaagggaggaggcaacctgcactggcttatagctgctaatgtcagttcctatagcttatcgtcagtgttattcatgtggtaaaagggtgagaaagtactggagtctaaagaaacaagtagaaatcagtttgtagctattaccgttctacctgctaacaactcctgttttcaagttattatgtacaactttaggtagtttctctagccttaatcgtggtttctctgtattgagactacttttgaattctatgaagtacagccttagatgtacaggctactttaaatttttgcctaaaataaaaacattctctccaattacatatgctggggaggaaacacctgcttccgacaggtttaaagcttggttttggactttttgtgagagttccttatgtgtgcagtaatccaaaatttgtatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaaggtggtcgcaatgttttgattttgtatacctctttatattgtgatatgtacacgtttaaaaatttttctgtaattctcactatttttatcaagcttcatttttttctcatcagttattctttgaaataatcattctttatgcacataatttgttttgctttattctcttaaacatactctcaattcttttctaatataacatcctttttattacctgcttttaaagctttagtcaggaataagatactggcttttcccctcccccctttttctcctgttccatctacctttcttcctttaaaaaacatgactcaggccgggcgcggtggctcacgcctgtaatcccagaactttgggatgctgaggcgggtggatcatgaggtcaggagttcaagaccagcctggccaagatggtgaaaccccatatataccaaaaatataaaaaattagatgggcacgctggtaggtgcctgtaatctcagctactagggaggctgaggcaggagaattgcttaaactcagagggcggagcttgcagtaagccgagatcaagccactgcactccagcctgggcggcagagtgagactccatctcaaaaataataaaataaataaataaataaaaaacattactcttctttcttcttctatggtttgctttgctgcattactttaatcatgaaaagcagctggcacatctaattatagtttttctagcttctggcctgcacttttctgtgttgaaatggctgtatatattaaataaagtgtctgcgagaaaactttgtaaaaacatctaaatattatatcatttaagtacaactttttaactaattattttcctcttcttgtgccctttttaggtgatttggatattgaagatgacatgaaagcacagatgaattgcttttatttgaaagccttggatggttttgttatggttctcacagatgatggtgacatgatttacatttctgataatgtgaacaaatacatgggattaactcaggtaaaatgcacacatattaagagctcttctatatgtttttatgattttatgatctagccctaatttttaaaaatgtgtttacagtttgaactaactggacacagtgtgtttgattttactcatccatgtgaccatgaggaaatgagagaaatgcttacacacagaaatggtaagaaaagtctgttgtttgatttaatgtgacaggtggttttacataataagatactattgctaattattaaactttgctattgtacttacccaaggcaaaatgttatttcatgtttaataaaatgtctattctttgttaaaactattattttagtttttaggaatttcattttgaaagcccacctaattgcataaataattgtgtgggtgtgagaaataaaatggaaaagtaaaatcatgaccaagagagttacaaataactttttttttttttttttaagatggggtctcgctcttttgcccatgctggagtgcagtggcacaatcagctgactgcagccttgaccgctgggactcaagcgatcctcccacctcagtctcccaagttagctgggaccacagacgcgtgctaccatgcccagctaaatttttaaaaattatttgtagagacaaagtctcactatgctgctcaggctggtcttgaactactgggcttaagccatcctctcacctcggcctctcaaagtgttgggattacaggcatgagccaccacgcccaggctaccttttttttccttttctttttaaattgtgataggggttcttgctgtattgcccaggctggtcttaaactcctggactcaagtgatcctcctggctcagcctcccaaagtgctaggattataggcatgcgccaccacacctggtggagttaaaaattaaaatacaccattaaggcaaggagaaattataatacaaatggcagataataggactttagacagtcattaaagttgaggtgccagtttgagtctaaggcccaataaaaaaagttcaccagaattttaagacaaacaactgcttatttgacttctttggatgttctcaataattcgagaccgtgtagttagattataaagtattacattgtggatgcccacatattaacaaaaatagagagtaagacctctaattcttaggaattaattgttaaaaataatcaagtgttccaagattttttggaaactacctcttgaattaaaaaattaaagtctttctacatttttatcttgttaaacagtgtatactgatcataattatttaaaaaatcatgtgttctaagatttttggaaagtacctcttgaattacaaaaacaagaaagtctttccacatttgtgccttcttaagcagtgtatactgatcataattgaacttttcttcatgatggaaagttaccacaaggaaaatttcttatgttctgctgttctttgttgctctccaatttaagtgcatacgtttgtttgcttctatattataaaacctcaaatttactttttgtataatttttgaggttttctttttcatctcatttattataataatagctaacctccattgagagaatgctgtgtgccaggacactgttcttcctattttatatgcttttaactcctttattcctcacaacaaccctgtgaagttaactgttagacaatttctattttactaggaaactgaggtacagagttactaagtaactttcccaacattatttggttagtaaatggcagagcttgggctgaacttcagtagactggcttcagagtccacgctcattagtcctttggagcgcttttcatattcttgaattctcacattctgtcttttttcactctgtcagcaggacctgactcctgtttttaaatttcatattgtgtttttactgttaatttggaaaacaaatgcatactttttagaattctgtataaaggaggagtaaatatgctgtgaacaaggacctaagtgggttgtcaatgagtttaatatatgagttctaatgtgcagagttgaggtttatattgactgctcagtgcttccctggggctagactataaatggatggatattaggaagtcttgttctgatttggtaatgatgttaatgcattattctaaatcagatagtcttaatatagtttaaatgtatgtttcgaaccaaatgttcttttttaaagcacacaaacattttgaaatcattactaatgtggttaatgaattattgatgttccattgggaaactaaaatgcagatttttctcttttagaaatcagggactattgcaaagcatcacattttagtgatacactgagagccagtggtgtgtttatacaaatagtcctattttccaaataaattctagaaaaatgctttagaatttataaattatacaaaatatgacttatttttagagagtttaaaatttaggtttttttaatggtttgtttttgtttgtttgttttttgttttttttttcctcattaggaaaacactagtacttttcagttaccttgatttttaaattaatctgcaggtccccattcaaaggccttgggttcctttcaaaggtcagtataattcaagcttagtttatgaaggactgaacatacccaaaggattttgcatgtggatctttactgccactaccacaaccatcaacacctacacacacacgacacacacacattctctctctctctctctctctctctctctctccccctccctcccgcactccttcccttccccctcctttgctctcatggcatcttttaaaaatatactcttaaatccttccagggagggcaaattcacttcttaatctaagtaaacccaaatggcatgcatcagcaccaggactgcccatctttcctagttccattattcatagagtataggctggaattcatcttgttcctcaagagtccagcatttctagttaaccatgcctacatttaaacttactctcatttcttttctactttacagtgttttttcaatatactagcattacagtttccagatttgatttctctcctgtcttatttccatcagttttcaagtctattaagattctacctcttcatttgtcttttgccaccattcttttccctcatactctactggctcagccctctcattacagtcacctaattctaacatatatattgctgctaagttaattttccttaagttactgattgtgcttttttaaagccccttgttgaatatttaggcaggactccatgtggacatccacagccctccgtggtacagccctaaccttcccttctagctttgccttactactcttctacgtgtactctacattgtggacaaactactatatgctgtttttcaaacatgtcctatttttcctacctctgtgcttttcattctcttacttctccttggaatacccttctaacccatctctacttactgacattctaatgtctctttttctaagcaagacttcttgatttcccttgactagaaattatcttctaagctctccctatccttctttaaagcatttttataagtctcaagtaccaactctacattgtgtttttgttgaccttactatatctactacatttttaacttcttcaggaaaggtggcgtatcttactcatctttgtattgcctacaatatctagtccaggttctgaataataaatatttttatatgtgttctgaagcacactgaccaatgaagataagaaatcaagaggctagttccttattttttttaatttttttttttgagacagtgtctcactttgtcacccaggctggagtgcagtggcacaatctcagttcactacaacctctgcctcccgggttcaagtgattctcacgcctcaacctcccaagtagctgggattataggcatgtgccaccacacctagctgatatttatatttttagtagagatggggttttgccatgatggccagcatggtctcaaacttctgtcctcaagtgatcttcctgcctcagcctcccaaagtgctgggattacaggcatgaggcataagccactgcgcccagcaagatgctcttttctcagtcacctaaatataatctcatttttagttatagaaggtttgaaattggagtgaatagactttacttaattctgactttatttctgtagctttttttttttgagatggattctcgctctatatcccaggttggagtgcagtggcacagtctcagctcactgcaacctctgcctcccacgttcgagtgattcccctgcctcagtctcccaagtagctgggattacaggcacccactatcacacccagctaatttttgtatttttagtagagacagggtttcaccatgttggccaggccggtttcgaactcctgacctcaagtgatcctcttgcctcagcctcccaaagtgctgggattacaggcatgagccaccgtgccctgcctatttctgtaacttttgataagtcatttgatctgttgttgttgttttctcatagtaacaaagtagaagtaattttctgcctgctttactagataaattaaggggaaaaaaataagatacgtaaaaatgttatttgttattaaaaagaaagttgttattttaaaggttctataaagacatagagtgcttattagaaattgagctaacacattcaggaaaggataggaagagtttgctgaagttctttctttagggattcttgtgtaccgatagcacagttaaagagcaaactcataccatttttatatttctgtgtatttgactaagcttactggcttcaatgattaactgttatcccaaatatggattatctttcagccaactcagggaatcacagctactgagtagtgtgtgtcagatctcttgggtgtgctggagtgagtaaaaggggaatgaattactgtgttcatgctgagacttaattgaacgggtattcagttgatctaggtgatgggcactttgttacttttattgtaacaaatttgtatatttagttgctttaaaactttatttcatgctttcattaggccttgtgaaaaagggtaaagaacaaaacacacagcgaagcttttttctcagaatgaagtgtaccctaactagccgaggaagaactatgaacataaagtctgcaacatggaaggtaagtgaaaattatttgtgattgattatacactttatttatacatagacattgtagtattaagataactttagaattgtgagggaaggtttacagttccatggtgtttggttatgtaacatttatatcttcaactcatttgcatgtgatctccaaaatgcagaaccgtgtagtaatttgccaatttgaggcacaaacttaaattacgtgaattgtggcactggtgttccaggcttaatcagttggctttgccagccacacaatatttgaatcctgatagggcttaattttctattaatcatggttttatatctttgttcaatgttgaaacatagtcatcagtgcaagaaataactatcaaacagccatgatgatgagatgaatgaaaaagcagcctagactttatacgaggggaattttttaaagagtaatgtataggccctgggcaggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatgcatggtggctcacacctgtaatcccagcactttggaaggctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcccatttcaaaaaaaaaaaaaaaaattactcaatgttaaactatactttccactaaattgaacagaatgatacatcctataatattagattaactttgtaaattaattcagccacatttattgaacatttactctgtactatgaacacttactttactaggtgctatccagaagttaagatgagtctttttttccccaataggggctctacttacttagagaatttcaaagatatgcagtgtgtattttgagcaaagatagattaccttaggttggggactagaaagccaagtgtttgtacatctcttcatcctacatattttccctgagaagcttcaaccttgcccatggtttctattactatttcccacatttcttcctgtaactaattctatttaattgccaacttaatatttctatctggatattcttctgtattgtaaactaagtattactgtaacaactgtactactactgcccccaaacaacatcatcatcaaaaactgcctttcttcctataatgcttattgtggtttaatacaccaccatacacacatgactccagcaaaactttggaagtcatctgtaacttttcttttacattcattggctacatacagttggtgtctaaatcttacagatttactatctacatatatctcttgatccatttcctcctttccatccttgcactcctgccattgaattcattagctcattattactcttgacttgagttgttggcatagctgcctttttgccaacagatttgtacccttataatctttcatctaagttgccagaaagtgggtgtcctaatgtgaaaatcagatcatgtcattctgttgttgaaaatgcctcaaatgcttccctccatctttgcacacaaaaatattttgtttataaaaatactagatgagggaagtaaatttttcatttatcaaaagaagatgtgtattttagaagactgaaaaaaaatagacctacacaatacaatctaaacttagcatggcaaacaaagatatttatgctctggccctaactctgtctttggaatcagatgttagattcactcatggcttgcagctctgatacttacaatgtggccttggccttggtacttaactgttgtaaaattcacattccttatctataaaataagaatcatggctgggtggggtggctcatgcctataatcctagcactgtgggaggccgaggtgggtggatcacctgaggtcaggagtttgaaaccagcctggccaacatggtaaaaccccatctctactaaaaatacaaaaattagctgggtatgggggcacatgtccgtaatcccagctacttgggaggctgaggtaggagaattgcttgaatccaggaggcggaggttgcagtgaaccaagcttgcaccactgcactccggcctgggagacggagtgagactccatctcaaaaaacaaaaacaaaacaaaaaaaagacctcagaaggatgttgtcaggattaaaggagtccattgagtgcctagtacagatagtgaatgcttcactactggtgtcaactttaagaaaatgaatatagaaaagctaagaattattttaaggtgtttactactagcatgtaaatgtatgatgggacagagatttccatcctattttgaggaattattttttatttttttgaaaacttaaggtaacaaagtagagaggaggccagggagaaaggaaggtagtggagcaaaaatgagaaagggagtgacattcccctctagttatagcagaaaattagcaaaatgatcatgacaggaggtaacagtaaagacagccagctcatatatcaaccaagacagttttgagtttgaccagcagactgttattttctggtttagagctctttccaggaacttcttgcatctataacccctgagaaccaagctatggaaaaaattttgctcaattttaagaaaatctaacatatcaagctcctcaactccaaaatattccacaaatagctgctatttactatactgagtaataatcatttaaaattattcaacactttatttgagcatctactatgttcatggcactaaagtagaaatgaagatgaacagttcctgcctcaaaataaatgagtagtatactgctttagatcatgggtttcctagtccattaaaaacactttttggtcatattttctggacaccccgacccttttggtatagaatataacctatgtaattctctaaagttaaattaacctcacttttcttgctctaatatgtgtaaaactgaccttctaggaaagcatatacagtttatatttttgacttcttggtatcttttagtgatagacatacctcagattgagaagcactgattgacattagattaaatcagagcttcctatgacaatataaacaataccttcattaatctgatccccctacctacttcttcagcatcatctcatatctgtctccactaatcatattatagaatctttgttacctgcaccatgttaagcatttttaaaaatcttttgtttataccatacctttttcctgaaagcggttttgcctttcctttgtctctagtcataagtctcctataagaggctgttcctcattctaccattcctttgcatggataggattccatggaatagattctcatcactgcatttatcacattatttcctaagtagtacagtacatctactggaagattagccacgtattgagttttgtctttgcattttcatgcctagaataatgccgggcacacataggcatattaagatttgaatagtgaaaaagtttttaattccatggggattttatttaaacagaaaaatataagaccaattagaattatttttaaagcataatttcaagaaatatgactgattttgtttaaaaacatgttttcctttataatgctgccacctggtgttgctgtgtttagagatgtccctttgtaaagaattgagggtttgagttgagtttggtttggtttttggcaaatcagcttttcctttgtatatttattttgtaataaactatggaagatcttgcctttaagtgtgagaacacaagcaatgttacttttatacctttatagaatatcttgcctatgtccttcctgtagttaggtagggttttttttttgacacacagcatgttatataaggtttgcttgcacctcggtaggaaagtcctctgaaatctaaaggctgagaatctaaaagcttaactcatgttttgctcctagaaagacttgagaagagagtatttctgttcagcatggtactaagaagacagctttctcttcctcatgtcatggttgccatttcatactgcttacagagaataagatctagtctctgtcttaaataaaggtctactctctgccagcgagctagatagggtaattggattgttttccaatctattttcatttgaaatattgttttatctgaaattactcccataatttcatgtaatgccaaaaactaaactaagtacaagagcatcttcaaaaaccaacataattcctttagttcccatttagtgtagatgctctttggttgatgatattagaattgtgtaatggctattgatctctcaaagtgaggtgttgcctaggggcttaaaagttactacataaagaatttggctttatgaagaaatgttacagattttatctatattttaaaataagtgtaagtgactacctttataacttttaccatgtagtttagtagtatttcttatctgtttattaataccctgccttgttaccaaaagtatgtataatgagatgtaataagaataggtaacaagtaggctgggcacgttggctcatgcctgtaatcccagtactttgggaggccaaggcgggtgaattacctgagttcaggagttcaagacgagcctgaccaacatggagaaaccccatccctactaaaaatacaaaattagctgggcatggtggcacatgcctgtaatcccagctacttgggaggctgaggcaggggaatcgcttgaacctaggaggtggaggttgcggtgagccaagatcacacctcattgtgctctccagcctgagcaacacgagggaaactcttgtctcaaaaaaaaagaccaggtaacaagtttgggtgaacaggattaaagagttaaataacaggaggaatctagaggacttaaagaaatgtgtggtgttggatttaataactgtagttgccaaaggtgaggtgtaaatttattctaagcaaaggaggatgctcatttttgaaaattcacttgtccataagattaatgcctatcagttaacttgggaggagaaaaatttttctttatcagtgtctcccttttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtacagtttggctacccatctaattctctggttaaaagttctagactaaatgtgttaacaggcctattcagtagagatcttgaccattttgtgttttgtatgtgttgcaacaaatatcagtaaaaatagaatcatttaatcatagaaaaaacttcctggcattttaaatacaaagacttttgaaaatccaaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacctcaagcattatcttgtgtgacaaacaatccagttatactcttttggttatttttattttattttattttatttttttcttttgagacaggatctcactctcgcccaggctggagtgcagtggagcaatctcagctcactgcaacccccgcctaccgggttcaagagattctcctgcctcatcctcccaagtagctgggattataagcatgtaccaccatgcctggctaatttttgtatttttagtatagacagggttttgccatgttggccaggctggtctcgaactcctgacctcaggttatccacctgccttggcacccggcctcttttagtttctttaaaatgtacaattaaattattttttactatagtcacccaaaacaagtacctttgacataagatttgattctgaattttactcaaatgaatgttaagatccccaagataagttaaactttggactatctcacctgtttaatctgtacctatgcatgacttcccactgtgcttgaggatacctgaatatcactgagtttgtgtgactgatcagccttgaactcaagagtaaatccaagtctgcagtcaggacaccccaatcctcaaaataataccatcattagcatttatttagtactttctcccaaatcagtatttaatttaaattgccaaaagacttacaatgtggtatcaatttatatttaaatatgctacatatagctttttaaagcatctttggttctctggaaaccatagtcagaatttaaggaagttattgtggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttctatactctgacctaggtttccagtccagctattccacagtgatgctgctaaacactgtcagtagttgtctatccccataccttcactcctatttttaaaaagaccatgaaaaaaataccagatccattgattggtttggtctaattatacagatatcggcatatactatctcaagacagctgtgttctttttgtaggaagaatcctggcctagatttgtatcatagctctaccactcattagctccctgaccttggggaagtctcttcatttttctgaatttcatctatgtagataatccttcagaaggttataatgaaaattaaatgaaattctatgagattagggaggggggagggatagcattaggagatatacttaatgtgaatgatgagttaatggatgtagcacaccaacatggcacatgtatacatatgtaacaaacctgcacgttgtgcacatgcaccctagaacttaaagtataatttaaaaaagaaaagaaattctatgagattaataagctatatgatgtaatacatggctcttgtatattcatgaactcttcacttagctctttggcttgtgaatattatgtacatcaaaatttaatttttcatttgatctattttactagactcctgccccatctagtctacctgtccacattattaccacattctagtccatcttgcccattactaccaggctaagctttctagtgtggatatgtcatcatcttattttccttagaattttagcgatctttttatcatttccaagataaacacttgcctaggtgtacagcatccttgtttaccatcatactcacgcattagagatttagccttccctttaaaatctagggtcactcctcttaggaagactttgggcagtttttatttttgctacttctgacaccatcctttaatgttttaatattagtgccacagagttcttttgtgactttaccattatgtaagaatcttccacttggaatgtctttctcttcctcacaccccagtctgcctagcaaatgccacttgatcccaagtatcagcttgttagcttctcagtgaagcaagccttctctattttagcagttatcacagtgtattttaattgtttacatatctactttcacaatgggttataaatttcttaaggtcaagggttggctattttaatctttgcattatcagttcatttcagatagtgaacatttaatacgttaattaaaggaataatttacatttaagccaaacgtgaagataaactattgctcatcatccctcttcagccgtatcctgtaggtggtatcaccttatattcttaccaccaaagaaaatatggcccctctcttagaaagatcttaatcatttatctgtgtatctttaggactatccttagatcatgcctcacatattgatgccaaagagttcttttgtgccaatttcataatgtgtgtcagcacaacaattctgaagatttgttggtgtctttcatgtacttgactacaaattgccttgccattactactcttctcaaaggatatctgaaattctttttttcttttttttttttgagatggagtctcactgtcacccaggctggagtgcagtggcgtgatcttggctcactccatttcccgagctcaagtgattctcatgcctcagcctcccaagtagctgggactacaggtgtgcaccaccacaccgggctaattttttgtatttttagtagagacagggttttgccatgttggccaggctcttgaactcccaggctcaagcgatccacccgcctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtgagcataatacccaacagttgttcaacccttgcccctctcccctagtagtcctcagtgtctattgatgccatctttatgtccacaagtaacccagtgtttagctcccacttacaagtgagaacatgcagcatttggttttctgttcctgggttatctcacttaggataatggtctctggatgcatccatgttgctgcaaaggacattatttcattcttttttatggttgcatactgtggattttattgggtctttattttgtattagcattttaaaaccctaaatgtgacacagtacgcatgagtgatcatgcatctcaagaaatcttgaaatgttcctgtccataaagcagaattttttaagagaccatttcacagtctcccttcccctcactgtatcaagtgctcatttgtgaattaccaatttctcttgttttgacagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacggtgagtagttatttttgttaatcccctaaattgtgtctgttgctacaagccccatttcaactaaacattactttacggtttttgttggtaatcatttggacattacaagctaatatatgtttatagttttcttaaatgtatttgcttaaatatttttgcccccgtaatttcttaccattcttgcttttttatactgttggaaattgtgcttcaaagtgtccttaaggtatttcttcttcccacataaatttttcctggctactctatttctgtatcctgctgtcagattttctccacagtttagcagagttatatggaagtaggcattgttgcattaaaggataaaaaagtagtcatactataacatcaagcattgaagatgaaaactgcaattttaaagtagagaacattttaatgtataaaaaggttggtattgccttttgtcttttatgccatagagattaagacgcggtatcaatagtggattgtaaaggtaactcagacttatggttatactatactattgtatgtaaactttctgatgaaggaaaatttggtgacattttgttgtttgatgaattagacaaaccttttgtgaaaaagaacataaattttttatatgtgaaaatccttgtggccgggcgcagtggctcacgcctgtaatcccagcactttgggaggccgaggcgggtggatcacttgaggttaggagttcgagaccagcctggccaccatggtgaaaccccgtctctaccaaaaatacaaaagttagctgggcgtggtggtgtgcgcctgtaatcccagctacttgggaggctgaggcaggggaattgcttgaacctgggaggcagaggttgcagtgagccaagattgcgccattgcactccagcctgggcaacagagcaagactctgtcttgggtaaaaaaaaaaaaaaatccttctatactttagattgactcatattttttccccacagacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgaggtaggtgtcatgatataatcagaaagggacaactttcagattttaacattcaagaatgtatttataagtttgattcaaacacttatttgaaccacaaattacatttgtgtgtgtgtttgaattttagcactttaaaattattgcaagagctactgcctaacctagacctgagcacatgttttaggctcaaagatagtcaggaacatgggaagaaactagcttaatataaaccaaaaggtgaaacgtacattgtttctctattatttatatcagtaggacaaaaacatcttgaatttggacatttaaagagaatagtactaagtgtgctcaaggtagctacagcctatacctgttaccccttttagtttgttttattgtgttttgttttgttttgagaaagagtctcactatcacccaggctggagtgcagtggtgcaatcacagcctcaacctcccaggctcaaatgattctcccacctcagcctcccaagtagctgggactacaggcctgcatcaccatgcctggctaattttttaacctttttttgtgtgtgtgtgtggagttggggttctcactatgttgctcaggctggttttaaactcctgggctcaagcgatcctcctgccttggcctcccaaagtactaggattacaggcgtgagctaccatgcctggcccattacccctttgagttggagaactgtctggtagcaatagacttacgagggtttaaatgggaaaggaccttataaattctttgcccaatttagtctaatttccatcactattttgaaattttgggtaagtataatatgaaaataacaagtgttacataaaataaatacttagtaactggtcttttttattctggatctgtcttgatattaattgtcctatgaacacaaaaataatctttaaaggctaggctggccaagacttagagatatcacacagggctctatttctaaatctagaatgattccattttagggcttcctacatctaaaaatatgctcaggagtagggcaacttagatctgaacattataacttgataaatgaggcataaataagctttaataagtggtaaataattctacattaggtatttgttgaataaaactgacaagctaagagtaggggatttgacatctcacagccttgtgttgaatgaatatatatcctatgctctggttgcttaatttacccagaaaaaaaaatgtttgattcatcttggtttttatctaacaaaagtaaatctaacaaaaacgttagaatgaggaaagcaaaatttcttgtttagaatacacagctatagttttttgttaaacttcttgcccagaactcttaaaatagtaataatgtacattcgttcaggtatatgcaggtaaaataacttaggtttctactcccacccccgacagtaacagtgagatttttaggtagctcagtcaccacaggagtgtgccttctcagttcaaaggtaaattccagtgaatgtagcatctagttaattggtcaattaggtaccattgtgggatgtgaattaccaaataggttttattctttagaataaggtgtttcttttcatctcaattttgtaaatgatgttatattacatagtcagaaatatatatattggcaaaattagttaccagtataagcttcaaaatgtcactattttcacaaatttttttttttttttttttttttgacatggagtctcactctgtcgccaggctggagtgcagtggcatgatcttggctcactgcaacctctgcctcccaggttcaagtgattctcctgcctcagcctcctgagtagctgggattacaggcgtttgccaccatgcctagctaatttttgtatttttagtagagacgaggtttcaccatgttggccaggatggtctcgatctcttgacctcattatccctccaccttggcttcccaaagtgctgggattacaggcgtgagccactgagcccggcctagttaaataaaatttgataaacacgatggacttggttgtgtgttttctggtttttctgagatctagtttgaaaattctgacaactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggtatatgaacttatttgttttatattaaatttcattaatttttagtctgaagtgactttgagtttcacttgttttttatttataaggtgtggccattgtaaaaactcatgtatttgctgttttaaaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaaggtatttatatgtaacattcaagttatagttcttttattatttttgagataaatgtatgtgatagtacatgatttttaaacttatagcaaactttctgatatatatgccctaacgcaaattcttgagaactcaaaaaactttctaaattaacctcatatattttttctttttctttcttttttttttttttgagacagagtctcgctttgtcgcccaggctggagtgcaatggcatggcaccatctcagctcacggcaacctctgcctcctgggtgcaagagattctcctgcctcagcctcccgagtagctgggattacaggcatgcaccaccacgcccggctgatttttttggtatttttcatagagacagggtttctccacgttggtcaggctggtctcaaactcccgacttcaggtgatccgcctgcctcagcctccgaaagagctgggattacaggtgtgagccaccatgcccgctcctattttttctaaaataattataaattctaaaattacctatctaaatggaggagggtcttctgacacctttaaaataaaatccagctcagtactgtaaatgtgtttacagaacttgtttaaagttcttacagttgtttaaatcagactagttaactaccctcactacttagatgcttccatttcttagagctcttttttaagcttatctgaagaaaagcccttccaatttaagggttatttccaattgcacattccaaattgagccttccatcttcagcattcaatatagatatttacaggcccctcttttaaaattttattatagttaacttgtattaaagttgcttttatttttcattacgtatttgtagaacattagctatatatatattgcaggctacataggttttcaaactgtacaacaggaatctaagcatgaattgttacttctatggagctagttcaaacaaacatatggacatgacccaatttttaagttatactttctgtatataatttgtaaggggatttcacatattttaagtttgaggctatagctagaagaaattaagttttatctaataagtgtgtggaaaagggaaatgattccttctctactatgtctagactaagccagatatcaatagcaataggaaagaaccactgtcgtagccagaacacatagcttttttccctgcctaacattcccaccttgacctagagtgctgggagaggtcttttccctaagcttggaaaagacattggggctttagatgaactcagaagtactttacattactttatttactgtgtcacttactcacttttgactctgagctccacgagggcaatcacagtgtcttgggcattttagtgatactaatacttagctcatgacctaatgtgtagtacttcctcaataaatggttgttgaggcagggcgcagtggctcatcactgtaatctcagcactttgggaggctgaagcgggtggatcacctgaggccaagagtttcagaccagcctggccaacatggtgaaacccggtctactaaaaatgcaaaaattagctgggcgtggtggcacgtgcctgtaatcccagctactttgggaggttgaggcaggagaattgcttgaaccctggaggtggaggctgcagtgagccgagatcgtgccattgcactccagcctgggcgagaagagtgaaactcggtttcaaaaaaaaaaaaaaaaaaaaaagttgttggactgacagatgcatgaatacagtagtaaaaatgacaatcacttataagttacagtttactatcagctacagaggatgggatatccagttttctgaacaactgttctcttgtacttgtcaaagccaaagtgtaacaacacatcaagtcactttagcaatttatttttgagacggagttttgctcttgttgcccaggctggagtgcaatggcgtgatctcggatcttggctcaccgcaactgccgcctcgctggttcaagcaaatctcgtgcctcagcctcccgagtagctgggattacaggcatgcaccaccacacccagctaattttgtatttttagtagagacagtgtttctccaggttgatcaggctggtctcaaactcccgacctcaggtgatccacctgcctcagcctcccaaagtgctgggatgacagttgtgagccactgtgcccagctagcaactgtttttaaacattagttccaatgtagtgtacactgaaaacttttatgaaaggaatttcaaaaattaagataaaccattaaaaacgtaattactaagtactactactactacaatgatatttacataatagactgagttacatttcataaagacaatatatctgtataagaatttttaaacttccctgtctatataatagaagttttagagaaattttttaaaaaccaaagaaaactgcaaaataagatcacttacctatttggcattctcaactgtctggaacagcaaggagccattatgattatgcatttggtttgtggggtgtcttgaaaagtcaaaataatgtaacaaagctgatgtactttactcattagaacaattcttcacaatttaatattaattttagatatacatagttcatgtttgataaccagatcaatactgagtgaaaaatagcatagtgggaagagcaggggaggggaggtagggatctggagacctagagtgtacttccatattgcaactagtgagcagtaggactttgagaaagttacccaataggcctcagggttctaatttataaaatgggtatgatatgcctgccttatctgtcttgggaacttaagtaaggttaaaatgaactaatgaacttgaaatgttttataaactgaaaatgctatacgaatgtgagattgatcttgtatttcaatagtcccaacaatatcactgcattgttatattaggtggaataaaaggacaatatttaactgttttgactctacaatagtgtcaatttagttgtgttcagctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatcccagctacttgagaggctgaggtgggaggatcacttgattccagaggcagggcttggttgcagtaagcagagatcacgtctctgcactccagcctggctgacagagtaagaccgtgtttcaccaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaatttttttcttttcagaactacagttcctgaggaagaactaaatccaaagatactagctttgcagaatgctcagagaaagcgaaaaatggaacatgatggttcactttttcaagcagtaggaattgtaagtatgagtagtaggttttgcttttctagctaatgtgctatttcgtgtgtgtgtgtgtgtgtgtgtgtgtgtgtgtgtttccacgtttcttccaaatagtaaagttatattttcagaagttatacattgggtttttttactctgtatgcactggtttttaaaaatacaaatgtttaatacatacattcttggtataaaaattccaaacaattccagtgtattttgagttaaaaagtgaagttctccccttactccaccctgaatatcaccaccaatctcattctcttccctttaagttactttgccttattaaaagaactgctattggccaggcacagtgcctcacgcctgtaatcccagcactttgggaggccaagatgaggatcacttgaggtcaggagttcgagaccagcctggccaacttggtgaaaccctgtctctactaaaaatacaaaaattagccaggcgtgttggtgcacaactataatcccagccactctggaggctgaggcaggagaatagcttgaacccgggaggtggaggttgcgatgagctgagatcaggccactgcactccagcctgggtaagagagtgagagtccatctcatatttaaaaaagaactgctatgttttggggtaagtcaatggtggtataatacattctgatattttcaaactaaattaactggaaagtatttatagacagaatggtcataatggatgacaaataacttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggctgggcgcggtggctcacacctgtaatcccagcactttgggaggccgaggcagccagatcatctgaggtcaggagttggagaccagcctggccaccatggtgaaaccccgtctctactaaaaatacaaaaattagctgggcgtggtggcgggcgcctgtaatcccagctacttgggaggctgaggcatgagaattgcttgaacccggaaggcagaggttgcagtgagccaagatggcaccactgcactccagcctgggcgacaagggtgagactctgcctcaaaaaaaaaaaaaaaaaaaagtacagttgtatttcatgtgatggtcttaatacagagattaacatttcaaggtggagcttttcatttttagtaattttctttgatttctctatgtccatgtgctgtcaatattgatagaagctgaaatttgtgaacttttatgacttcttttttttttttttttttttttgagacagggtctcgctctgttgcccaggcctggagtgcagtggcatgatcatagctcactgcagtctcaaactcctgtgctcaagctcaagcaatcatcctacctcagcctcctgagtagctcgcactacagacatgcctcaccacacccggttgctttttgtagagatggggtctcactatgttgcctaggctggtttcaaactcctggcctcaagtgatcctcctgcctcagcctgtgctaggattacaggcatcagctttgatgcccaccatatttatgcctttttccaaattgttatttctttgtgcctttattgtatcctgtaaacatttctgacacagcaacagtatcactggattatacttactttttaacatagttgtggttttgccaggtaaactaaaaacccttccagaattttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcattacctaaagcagtctatttatattttctacatctaattttagaagcctggctacaatactgcacaaacttggttagttcaattttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatcaccttaatgtatgttgagtccctaaatgtcatgttaaataataacaaccataatatccca

SEQ ID NO: 12 - DNA, 5779 bp, Homo sapiens
actcccaatacacacacacaggcacacacacacacaggcacacacacacacaggcacacataaacacacacacacacacacacacacacacacacacacacacacacacacgcataacaaatcaggtcccagactagatgcaggagttgaaactgctttaaaaacactctaagaacttaactacaaacccacactccccatgcttctggggcttaagatctttgagctcattcttcagcatctctcctcgggaaagtggggtgggctgctccatgaggtggaggtgaagacccctgagtctgccccgtggagggggaggccccctaagcctagagtcccgctgcagggctctgtgccaggagcccccgtgagccatggcctcgaaagggcagcggtgatttttttcacataaatatatcgcacttaaatgagtttagacagcatgacatcagagagtaattaaattggtttgggttggaattccgtttccaattcctgagttcaggtttgtaaaagatttttctgagcacctgcaggcctgtgagtgtgtgtgtgtgtgtgtgtgtgtgtgtgtgtgtgtgtgtgtgtgaagtattttcactggaaaggattcaaaactagggggaaaaaaaaactggagcacacaggcagcattacgccattcttccttcttggaaaaatccctcagccttatacaagcctccttcaagccctcagtcagttgtgcaggagaaagggggcggttggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaaggtgagggggcggggtggcaggggcacggctcagagggaggggcatctgcatgaatggaggggctttcaaagccctggcactgccctggtgggagacactgtgtgcatctggcccggggtgggtgtctggggacactgacacatatctcacacatagcagatcctaggctgcccacacatcagggctggagggcacctaggaagcaccaggtccaacgcctgcaaggtgcagagtgggcactaaagcctagagaagagacaagacctgccagttcgtggcagagttggagaccagattccgagacttgattgctcagttgtgcatctgtacctgctgggctggccgaactttccaagctccacaggtttgtaggcggtctcagacggcagagaaagaaatgaatcttgaggtccccatgcttctgcaactttgccctcaggcaaggggatagaggaggcaagagaggtgcacacagtaaatggggcatcttggagtcatggaatgatgttcagatacatggggagggagcagacccagggcctaactcgcagtatgaccttgggaaagctccttctcacttggggtctccgttttcccatctgtacacctatatggggttggacagggtggtttctgagagcccttccaacatgaaaactttagatgctgtcctgaacatgcctcattctcctcattaactccagagactacctgctcccctctgtctctctcggcccacctaatgttactgttgcagcttttcctctccacttgctgtgtgatctaagcaagtccctccccctctcagggcctcagtttcttcctagtgtgaagagggaggtgggctgttggtcgctcaagttgcctgcagctcatttgctctggtcctaggctggcagggtgggggaggggtcagagggtgggagaggctcctcattagagctggcctggagggggctgccagggggcgggggaggcacagaggcagcaggtctggctgaggtgggggaggtggtctggctgcctgcccagccagggaaagctgtgaccccttgggggctcataaaataagtccgtgtgccccccagcactaagggagcttggagagggggagacggggagtttaaaggcctaattagtcaccttctagagcaatatatgaaagctccccaatggcaaattgcaatttaggaaggagggcatgctgattcggagatactactgagcttctcacatacacatacatagccttatgtttatacacacatgctgaatcacacatgtacatgcatgctgactcacacacacacgtgctgaatcacacacgtacacacatgccgaatcacacacatatgcatgtgcacacacaccttcttacatacacacacaagatcaatcatgcatatacagacatatatgtgctcttcaaatagtcacacaagcccaatcatttatacatataatgcgtcattaacgtatacactctttcatattcacatatgaacccaatcacacacatgcatacaactgtaacacacacacatgctcaggagagtaagacacataggcaacaaaatccttgcactggaaagccaggaaaattgggctgtaggtcagtgtggaccagctttgtcattaacttgctgtgtgaccttagtcaagtcactccccatctctgtgcctcatctgcataacaagagcaccaaggtctcctttaagggatggtggaagcagctgagaatttgagcaagtcatctaacttctctgaaccttgggattctcctctggaaaagcgtgtattttttttttttttttttttttttttttttagccagggtctttctctgttgcccaggccggagtgcaatagcgaattcacggctcactgaagccttgacctccctggggtcaatcaatcctcccacctcagcctcctgagtagctgggactacatgtgcacgccaccatgcctggttaatttttgtattttttgtagagacagagtgtcaccatgttgtgcaggctggtttcgaactccggagctcaagcaatccacccacctcagcctcccaaagtgctgggattgcaggtgtgagccactgtgcccagtcaacaggagtaattttaatgctcactccacctatctcacaaatgagacatcacgttagctcatggctgggagagagataggtagaaggcagttacaaagctgataaatctctgataacacgtatatcatgacacaaacaccagaatcacgcaaatcatccccagccacatcttcaggtgaacacccctacttggtcggctatgtaggaaatgctctcattttcaaaaaggctctcagtggtttggctcttggcttctgtcagaatggggcagaggtgaaagaaagctctctggacggggagagagctggggccttcccccgcagcctcgaagtgactggctcccttggtgaggttgcagggaatgacttctgggtgttctctctagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggcctccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcctaaaactgtggcaaatttcttgtttactccaggggacccagtgaccccttgaagaattactgacccagggcagggaggtgggttgcttcatgtataaactcagttttcagagccctatccccacccccactcctggaaactgaagcacaatgggacagagagtgcagctaagcagggccagtgctcacctctaaccgcatt

SEQ ID NO: 13 - DNA, 27489 bp, Homo sapiens
agccgcacaggcgcaagcggggctctggccaaggatggggaaggggtgcgggaggcggctgccgagggtctgggatctcaggaggccgaacggccgggggctggcggccggaacacctaagggctcagtgtggctgcaaagttgagatcgcaccccctaactgcacgccccgcgcggctcagaacgcgccccctgcccggccctgactccctacgccgaaagtcgcggagctaaaaataacagtcctgcgcgccccccgcagaccgcgaccccgacccctcccccgccccctccccccactgggcgtggggcgaagccacagctcccatttccccaaaagaaaaaaaaagaaagaaagaaagaaagaaagaaagaaaaggcggcgcgggaggggggcggggggcgggccgggggcggggggcccggccatatggatgtgatttcttcgctccgaggcagacgggccgctccgcagcgctcggcgcccgcccgccgcccgcccggcctccggctctccctccctccctcctgtccctccctccctccctcctttgcgctgctcgctcgctcgctcgctcgctcgccctcagcgcatgggccccgcgccgggccccggggcctcgggccgccgggacgccggggtcccataggccggggcgtgggcggggcggccagcctgacgcagctctgcaccccctaccaccaccagggccggcggcggcggctgccccgagggacgcggccctaggcggtggcgatggggaccgcccggatcgcacccggcctggcgctcctgctctgctgccccgtgctcagctccgcgtacgcgctggtgagtcccccgccgccaacactccgggacaggctgcgggcttaccctagggtccgcgggataggtctaaggcacgcagtcttgagttcccccagtagttcgaactttgggtgagagtcccctctgatccaggatcctgggtgcctgctgtctctgggatgtctggactgtgggttccagctgcctgaagcctccctatttctgaagcctcgtttggggtcccaaatctggcaatttgtggttgagttttcaccatcctctgcttctgtgagcaccatggctgtttctccctggaagatgacagtgtgacccaacagaaggctgggctttggccctgctgcgtactcccacagactttgctttggggacctctgttttctgcaagttttgttgcagtcccggacacagggaatgtaggtctgaggtcagaatcatccaggcagggggtaggatttaggggccccctccagccctcacacacacacatgcacacgtctggcttcacccagggtagaagctgtttccccaaggaggtgggtgtggtgtggcatggagaagggatggagttccctgaaggagactgacctcacagtgcacccctgtaggagaagcacagcatatcctgtggggaagtgaggagacccctggaaagactgtcactccctgagagtgacctaaaagcagaatggtagggaaggctagagggagaggagagacagagacaaagccgggtggggaggagagatccccccagctggaggggtggacagactaagaacagcaaaaaaaatagggagacaggcaaaggcagaaagctggagacacagagtgggcagcacctcctcctcctgggccagggtctggggcccacttgctgggaagggggctgtcccagcccctcagtcctattccacagcaaccccatcccctgggacgagcccgttcctggggaggctgtctgcctgtgcgcctaacttcaaagcctcttctccctgctccccagtgggggtatctgcctgctagagagcagggcagtcaggcagcctcctcctcctgaccagcagcagctccctacacggggcagagctccaggcagttccaatgagcctgggattcctccacctttgcatgatgcctgtgtaagcctgggctgtccttctccgtgcctcagttgccccatctgtaaaagagagggcctggaagaaacatctgcctgagaatcccatcatcagaggctctcccttcctctgaggtcctcagcacttcccacttacctgtgcctacaccctcacaattctggccccagcaaaggctccccaccaaagacagccccatacaaggccttgtggatggggaaactgaggttcagaggagctcaacaccctctgcagagacactccaagtactgacgaatgccaggggatagaactaccaccaaccccacccccggagtttggtgtgtgacggcctgaggggtagacagggtgatgggtgtgggtgtcctgagagtaagtctatgtgtcagagcagggttctgtgggactctgggcatggtgttcatctgggtctgtgtgattgtgagtgtctgagtccctgtgtgagttcacgtgtctgaagttgtggtgcatgacttggaggcgcagttgtgtgtgtttgtgtgtgcctttgtgagcgcctgtgcacccgggcctgttgttttcttatgtgtatttcataaatgcttctgtagggctttctacttgccattgttctaagcaattcacgtacattagctagtctaatcctcccaaccaccctcagaggaaggttattgtccccatttttaactggcccgaatcacacaaccacaatgaccattatttatctcatgccaagccctgtgcctctatgtgtgtgtggagtatgggtacccagagccccactgctctccagggaagctgagatatatgcagagaatcttcctggctttgccctggcccatgtctgagagtagaaggacagatgccagtgttcagtctgcccaggaccttgttggggcatgtgagttcactggacactccctggcttcggggccagaagattgggactgaagggcgggggcagcctactcacccatccaatatcctatgggccccctggactcatctggggccagcaagaagctggcagcctgccagctccctctcctgagcccagagggctactgcccccctttagatctgcacctatgcccctcaagcccaccaaccttatctcatggccggtcaccaaacctgtatgctacctgcccagctggtcccaagaccaggctcacatctccagtgacctcacatttggggggccaaagagcattccatctggaggacactggttgtggccagactcagctggtccatcttctgctgtacaggaaacagttacctgggagcctggagtctggggcggggtggagtttggaggaagtgatagacccacagattgtgagtaggaggcaaaggggcactcttgtccttgaggatgcgtcctcctaaggacccccccagcatgtacacatgtggaggagaaactgcaacaagagaagctggagctcagcatggggcaggccttgagtgtgaagatgtgaccactgggtaggactcacaagagactgtggtgtggactcacaggctgggagtgtgtgggaccttttccagcctgctccaggggcagcttggccatgttgcttgcttgctttttttcttgagacagagtctcactctgtcgcccaggctggagtgcagtagtgcgatctcggctcactgcaagctctgcctcccgggttcacgccgttctcctgcctcagcctcctcagtagctgggattacaggcgcccgccaccatgcccagctaattttttgtatttttagtagagatggagtttcaccgtgttagccaggatggtctcgatctcctgacctcgtgatccgcccgcctcggcctcccaaagtgctgggattacaggcgtgagccaccacgcccggccggttgcttgcttttaaagacaggaagaagccaacatgtacagaacagtggctgtccccagattctgagctagaaactgtcacagattgttttcttatttcatccattcacccagtgatttctacgctaaagggccctgagagtcacacagtgagtctgtggcacagcaggatttgaacccagatctttagacctttgcactgaattccttcctcaaaagcagcacgagatttgctgctggcaggagatcctcatgtctcactctgggttttctctttcttttttcttttttaaaaattaaatcatggccgagtgcagtggctcacacctgtaatcctaacactttgggaggccgggcagatcacctgaggccaggagttcgagaccagcctggccaacatggtgaaacccccatctctactaagaatacaaaaattagccacgcgtggtggtacgtgcctgtaatcccagcttattggaaggctgaggcaggagaatcgcttgaacccaggaggcagaggttgcagtgaaccgagatcacgctgctgcactccaccctgggcgacagaggctctgtaaaaaagaaaaaaaaaattaaatccttctgttattttgttaatttttaacttcacaactgatatatgaatatgttcttataaaagagtcaaacaagtctgtaatcccagatacttgagaggctgaggagggagaattgcttgagcccagaagttcaaggctgcaatgagctacgatcatgccacttcactccagcctgggtgacagagtgagcccctgtctctgaaaaaaaaaaaaaaaaaaaaagagagagagtcaatcaataaaaattaaacagaagccctccttgatcactcccaagccccagttcccttctagggaaaaccatttttagcagtttgggtagaggggcgttctccttcctctttctgtgtgtttccaaatggtacctctttgtgtacatatcaagtagataattttgtcattttctatttgtctggttgtttttaaataaatggcatcggtttctagatagggctctgccacatacatattttgacgtaaatgtgtgtcttagagatcttcatttcagtaaatatgaatctatatttttaaatgctgcatagtattccaaaacctgggactcattaagtagtccataggaatgtacatttagatcatttctgcataatttgtgtgtgtgtctatatgtgcgtgattccagatggtggcagggaagctccttgaaatgccctctagtgtccccatgtgactatttcctagtaggatatttctagattttgtcattgctgggcctgagaatatacatattttttattttaatagcatggccaaattgccctctaaaaagcttgtgctgctttgtacttatacaacaccaagaccaaccaggagggcctctctgcccacacccactgtctcataggatgttaagaggattctttgtgtttcacctttgcttggataggtgaaaatggtgtctcttgtcattttaatttgctgattaccagtgacttctgggctttacagtgagagcttgctcggggccattaaccatcattctatgggttatttgtctttttcgtattgatttgttgaagctttttatatcacctgctcttaaacacattcacctcagctcttgaaacggcttatggacagagcagcaggagggtgccgagccctccgaggaactggggttttcttcggaatgttttaatgaggcgtcaagtagcctccctcagattcctgttgtgggccttctggggacactccctggtccagccaccacatcaggaaggcagctatttcagaaggagagtcctcaggaaaaagaaaaggtggggcgagggttttgcagacctctgaaattgtctgcaaaatacggtgtgattgggagaagggcgcaaacttttgctcaggtttgcagaaacatcagagaccttcaaacccttaaaagccccaactctggggccagtcttatgcccgaggtgagacctagtgggatcccattctgctgagcaggcgatggcttagattaggccatactgttcttctgggccttgattcctcaacccaagtagggcctgcttatgaagatccaccaggtcgtagcagccaactccgctatcccaggctgcatcccactgcctgccccgaaggcggccacgctggctggccaggatgagaggcgtcacagtgcctcttcccccccagcccctcccagccccaaacacaggcagcctgttcaggaaagcctggcgaaggggaggaaaagtcagcacttgtcagcggtggcggggcaggacgaggagcctgctcaggccagccggacagagagagggcagcaggggtgggggagcagtcccagccagctggcacgggagacatccaggggtgccagcatgggtcccagtagtagaacctggaggagggctgtaggaaggccaggaggtcatgaaggggtctcctgttagccagggttttctccttctggctgtgctggaggcatcaacggcctggttcccaacaccagagcccaactgtcctctacccagttacagctggggacaagccgccatcactggcatcaccggcacctttatgtctacacacctctgctcctaaatcggcttcggggaggctgccttaggggatctgcaaagggagacttgcttaatgtagcagctaaaatccaggattatggaaagatgataccgtggctggtgccagggtacccgtgtggctgggcacttcctcctctctttcccttcttccaaggctgctgcttcagtgtcaagcagatcttagctccatccctggccctcctctttctgtgactcttggcctcagtgtccctgtctgtaaaatggggatgtggtagaaggtgcaggaggcatgggttttaaagctccttgctgaccatggggaggatgtgctacagtggagggtattgaagccaagcaccatgatggctgggttgggggagtcaagtcagccctaatcaggaccataggaggagtgttggggggatatgggacagctggtgcagggctgggtggcctgtaagtggtgggtatggactaagtgacccctggccacagcccagccccagtccctcagtcctcacccctgagacccaagatctgcagatccgctggatctaaggggacgcaagcctgagtcctctgcaccctggcgctgagccaagaagacaggaactcctcaagggagagagggttggaggggcggggagaagggagtagcagacagggggcatgccaggctgagaagagatacagctgtcagcatttccccttcatccccaggagataaggcctcctcagtcagggcagaggcagaggagggggtcctttttcctcctaagctcaagcttggggcctctggcagtaaccttgaatcctaatgtaagtccagagtggatccagaaatgcaaggagccattgggatactcttccatcccaaaagcttgccaggaacaccttatctagcaggtcctcctgtagtccctgcccccagtccaccctggggccccatctcccatctgcccctcactgtcacctgctggactcagccatctacccagataatctcccccagccaccttgggtccctggcctggctgggagcacccatgtcaccaggcagcaggggtgcacatggcggggatgtgacttgctgctgctgctgctgctcacagtatcaacaatagcaaccagcttttcctgagcttcacccctgcacaggcttgttgtgaagtacttcatttaatcttcacagcagcttttttttttttttttttttttttgagatggagtttcgctcttgttgcccaggctagagtgcaatggcgcgatctcggctcactggaacctccgctcccaggtttgagcgattctgctgcctcggcctcccgagtagctgggattacaggcgcaccaccacacccagctaattttgtatttttcagtagagacaaggtttctccatgttggtcaggctggtctcgaactcctgacctcaggtgatccacctggtttggcctcccaaagtgctgggattactggtgttagccaccgtgccgggccaacaacagccctattattaccctgattttacaggaaaactgaggcacacgggttaagcaactttctcagacacgaagctagtcaagggtggaggtgggattcacattgtggggctggtggcagaatctccttgaagaggagggcacagctggagggaggagtgaacaggagtgggggcattccaggcacggagctgtgagctaacgtttggaggggtagcgcacttggtgtggggttgtcctcctcttcttgggaaagtgcttccttaactttaacatgagttattcttgttgcaatggctgtgctaacagataaataggtcctaaagttcagggaggccagaggtggggccaccacccctatggatgaatgaaggagtgtgggagtcatgcgtgctggaagcacatatctttccctctcctgaacatcccaactccagaaaaaggggtgtgcctcctcctggccatggagaaggtgaagccaacagctggaggtagaggctgagccaattccttgagccagtgaggggtgtgttggtcagctttcggtggtcaggctgcccaatggccactcagttttcaacccatgactgcctgcctgcagtctaggccatcaggggtgacccccagtcatatcagtaggctggtctgtctgttgggaggcccagggagtcagcaagtctctaaggatgtgtgggagcctccgtcagtcactccagagctctccatcagctggagaaaatacagcacaatgggtttgtcttgagaggggtggaggtggcagaagaagaaggatagtggggagggggtaagacaacaagatggcaaaggcagtgtagatggtagttgttgggcaggtggcagtattgctgatggtgctaatgttgccttggtgatgctggaggtggtggcagtggtgctggtgctggtgatgtaccagttgtgatggtgcagatggtggtgatggtggttatatggatggttacagtagtgctcatggtggtaacggtgatgccagtggtggtggtggtagtactgggagggactggtgatgctggtgttggtgttagtgacagtaatgatggttattgatggaggtactagcagcaacgatggaaatggtagttaatgggtgctgtaaatggagtgaggtggacagggatcagccccctcaccagcatggatcccccatgtcagaggcacagggagagcttcaggttagtcttggaggcccctggatcctggcaagtccaacttgtcctcccttaagccatcccatcattctgtgtctacctctgccccagccagctcagccatagctggggaagcaaagagactaggatagaggagcttaggccagccgccagcacgtgaggatctgctccagcccttcctggggtccatagtaccagcggagatctcagggtccacctcagcccccagagacaccagaagcacgggccacccacagacgcaaaggctaaggagctgccgcctcactcacagacgcacacacgccgccctatgcccagaaatacatgtgcacgtgcatgctcacaaacacgtccggctcgcgtcccatactgacaggctggacagtctccatgtgagaacgcgcacggacgggcacacacaagtgcacgcgccggccactcgagaatgcgctgccactcgcgcgcgcacgcacagggacgcgcacgcggctccgctaagtggaaccagcagaacccaaggccggccgagccaattggagactccttggccctggaagccctcgctgctgccgccaagagacgcggtcaattaacttctccctgcagccaggctctctgacccggcctgcccgcccctctcgccggtgcccgccccatgcccgacccgccttcttcctcccctgcctcctctgggtcctcccgcccttcacagccatgctcggactgcagggccccggccccgccttggcgcgtctgaaggatgcagctctgccgcggagctgaggagacgtagccttctggggtagggatggagggggtcgtctcaggggacatacccctgcccaggggtctgaggaaacacgaccctgaattaagagggatggggctgagggcttcacagccccgccctggggaggtttcagagaccgccttaacctctgcgggtcacattcacgggaatggctgggctaggcacaccaggctgctcccaagtcagaggacagaggctgagacccctcagcagccacctgctctgggtgagcctccacccgcatgatatttcatttcctttcttataatgaggccagtgagtcccggtgggtggcagccagggcccagggtgtgcaggttggagggaagggaaaggacattccaggcagagaacagcaggagtgagggcctgagtgtcatcagaactccgagtctggatggagggagctcccagataagcagtggaatgagagggactcccacccccagccagcaccagagtgcccagcccaacccaggccgcatgccaacagttcctccatcctctctttctctctcttgggattgtaaggaggggaggcattgaggcactcaccgttcactggggacagcattgactggggagctgggccaagatggaaactggtgactcccaagaccccccagggtgccaggacttgaaggactccaggctgggtttgtctccccacagttcaccactccttatccaccccctgcccccgactcatgtccccagcaggcagccaggatcctgtgtggatccatcctgggacattccattccagtcccatgtacccctggggaaaggactggacagagaatatcagtgactgcagcctacagggttactggcgggcaggcaggagagagcccctgctttttcccttcgatcaggcaggccctacccctcagagccacagcttcccatctgtaaggtgtgagctccatagagcagattccccacatgcaggggaaatcccaccttccctctagagtcagggccttttgaaagggggtagtccctctgggaaattgggatgtctctgggacctgctgctgcgccggaaagtcctgcctgtggtctgaccttcggcttggcaggtggatgcagatgacgtcatgactaaagaggaacagatcttcctgctgcaccgtgctcaggcccagtgcgaaaaacggctcaaggaggtcctgcagaggccaggtgggggtcaaaggaagagggtctggggatgaggtcaggtgagggaggggccagtcaagggcgggacccaggatacagagccaggtgaaggctctctgtgggggcggacttaggtaaagggggccaggccaaagtgagaaccaaagtggggtgcgtggtgcaagagtggagtcagcaggctcgggcatccatggcttgtcctaagtctcgagctcaggtccctgtgttgcccacaaccagcactcagactgatagctgtcgggttaatctcatcaactgaagaggcccagaccccaactgactgaaggagaggagccgcttcctcccctgacaagcccttagggttctgcaggggttgaggctggtgatcgcccagaacacaagcacacaatgacaaacacactctgtggcacacagattttgctcacactcacagagactcacatggtctctgcagtcacagccccaccgatgccagccccaacagtggctcccagtcacatcgagatctggggggtcagatgggccccctcattctgggtcctgaacccagcccctcttcttaattgtgaaagcctggaggagcctctctttgcccctcatcatccaccatggagcctctcgcttcctactgtaccccaccctgctacccacatccccacactgaggcccgagggtggaggcaggaaaatgagcacagtcattctcatcccagtccaggctgcttggactcagcttcccatcattgccacagacccgacatgtaaggaccaggggggcctagcttgggcggtggctgaaggaatacaagtcagaaaatgaggaagactttgtggctaggaagaaagacctctccagcctgggcaacatagtgagaccccatctctaaaaaaaaaatttaaaaattagcgaggtatggtggtgcacacctgtagtcccagctataggggaggctaaggtgggaggatcacttgagcacaggaatttgaggctgcagtaatttgtgatcatgtcactgcactccaggctgggcgatagagggagaccttgtctcaaaaaaaaaaacaaaaaaaacaaacaaacaaaaaaaaaaaacgtccagcatctctccaatgagaagagaggccaggctccatctcagattaggcatctcaacggccactgtggaagctgtgaaccacatacttgaggatccagggcaggggatggggtggtcttctctgtccactcttgactgtaccaccttgctcttgtcttctcaccaccagcttctttacctgcacagcactcaggccagacttaattttcgctatgtaacctgtccattgacatcacccactctgtctgctttcaccgtgcgccccctggtggggccttcactgctgcgtggccttggcccccacccactcctgactcctgggtgggaggataccacctctgctctgtcttgcccagtttagtgctcaccccactagctgatcctgcactcccattccaaccctgggggacaatctccacctcctcttattacttcacctggcaagcactttacactttgttaaacacctcctcacccatcgtctcagatctcccaacagcctaggtgtcaccagggcaggagacaacccccccattgtacaaagggggagtctgaggccaaagagtaccctgggtctcctgttgtagcacagctgacagccatcattaccaccctggtttctccagccagcataatggaatcagacaagggatggacatctgcgtccacatcagggaagcccaggaaagataaggcatctgggaagctctaccctgagtctgaggaggacaaggaggcacccactggcagcaggtaccgaggtacgtctctgcttccatgcatccagctggcatgggcttggatccacccacccccattgcactgtccctctgatgtgagctcatgcttcttggctcttatagaaagtaaaaggctgcagccacatccccaggcaaggggctgggagaagacagagtgtagtgggaaggaaggggagctagatggctcaggcctcagaaagagatgaacagagaactctccagcaccacaccaagagtggacccagggctacggtcccacccatggagagaaagagagatgacagagaaccctgggggacagagaggcagggagagatacacaaagacagacagatagtgacagagaaagacggggagaggcatggagacagagatcaacagaggcagggagagacagtcacagagatagaggggaccaggaggcacacactgaagtctgggctcagtgtgtcagaggaggtacatggggacacatagtggatagggccacagaaatagagaaggagaggagggcagtggcagagggtggggccagaggcagtgggacaaggaggggagaagagaagggagggaagcagatgaggaaaggcagacagagcccaggctttggccacagggccggtttcagccggccgggtgggcagcagattccagatgggccacatctgggaggctgtggtcaccctgtggctccctggggaccagagggaattgtgggcctggctgggtggggctgggaatatggcgcccaggacagagagcctttcaccaagccagggcgggtccagccatcaaggcagccttccagggtggctggagagtcctgtggttggagccctacagagggagagaagggggctgcaagctgggagtggaatgtggaagatacagaggctggggaccctccaaggtcacttagcctccctgcagtgaggctggggctccaaagtgggatgtcaccctactttgaatcccaccattagcacttagatttggggaatcgatctcccccagcagtggccgtgggagtctcacagcaggtactcagggcaggcattgagtggtggtagaagcatgggccaatgtggttaatcccaacttcccaatgaggaaatggaaatagaaagacttgggacacctgcgtgaggtcagcagctccttggagtccagctggcactagaaaccagacctcctgcctcctgtccatgatcccaggggaaggggcacacagggagcctcccagctgagggagagttagtctgggtacttgcccttcttcagagacacctggaaggtggttccaagagcagagagaaaggcgagaggcctggcctggggctgagcacttgaagaggacagggccctgtgttgtatgacctcagcaagttgcctacctctcttggcctctgtcagcccatctggaaaatggggccagtgccagtacctgtatcgcagaggccatagtaaattctatgaggtgggtacagcccacagaaatacattttctccagagtgctccaaagcctgaattttcctgcttggggcacacctgtccctgcaggaaccaacaaccactgatgggccgggtgcagtggctcatgcctgtaatcccagcactttgggaggccgaggcaggcagatcacctgaggtcaggagtttgagaccagcctgaccaacatggagaaaccccatctctactaaaaatacaaaattagccaggcatggtggcgcatgcctgtaatcccagctactcgggaggctgaggcaggagaatcgcttgaacctgggaggcggaggttgcagtgagctgagatcacgccattgccctccagcctgagcaacaaaagcgaaactccgtctcaaaaaaacaaaacaaaacaaaaacaaaaacaaacaaaccacagatgtattcatccttctgggtcactaatcatggccttgactctcccttggtatcccctaccctgtctgtctctgggcacagggcgcccctgtctgccggaatgggaccacatcctgtgctggccgctgggggcaccaggtgaggtggtggctgtgccctgtccggactacatttatgacttcaatcacaaaggtgaggcctgctggaaggggtggggattacaaggaggctgagacttggagctaggggttcagtgcctcgagacctccctgccggccctgacctcccatggacctgcaggccatgcctaccgacgctgtgaccgcaatggcagctgggagctggtgcctgggcacaacaggacgtgggccaactacagcgagtgtgtcaaatttctcaccaatgagactcgtgaacgggtgcgagcctttctcctccccaacctgaccaggataaattcactcccaccccacgggtgacccctgacccagccctgacccctgaccttgactcctccagcaaccttaccctggcctcttgctcttaccctgatgctctccctgggtcccagggctctgactgtgtctccccccgccccgcacaggaggtgtttgaccgcctgggcatgatttacaccgtgggctactccgtgtccctggcgtccctcaccgtagctgtgctcatcctggcctactttaggtgggcggggcggggcgagaggcggcgggacatggtggagggggggcggtggccgaggtctgatgcgaccccctccctgcacccatcacccccggcgggtgtccctacctacggcgcacaacccagcttcctgtccacccaccgcgcgtccccgtgcccccacccacggtcatgtcgcgcgccccgcaggcggctgcactgcacgcgcaactacatccacatgcacctgttcctgtccttcatgctgcgcgccgtgagcatcttcgtcaaggacgctgtgctctactctggcgccacgcttgatgaggctgagcgcctcaccgaggaggagctgcgcgccatcgcccaggcgcccccgccgcctgccaccgccgctgccggctacgtgagtacccctctgcccgcccgctcccggtgccgccactggcctcgtggggccccgccccgccccgctccagcccggccctcgccctgcccgcctcctgccagcgccactggcttcagccactcaaacccgtcttatagggtccctcgcaaccctcagctctgccgccgaccctgctgccaagggctccgagtgtcccacacgccccgcgctgccatcaaggctcctacctcaacccagtaccctctagccactctacctcttcactttgcctcctgcccctgacaccgcatccccctgagagagccccccaaacgaagcctgccccttcctggcctgtttggccggcaccacttgtcctctcctgccgccccagccccccagcccagccctgacttcccggaggcaggccctgccctctgactaacaccagctggtctcttaggcgggctgcagggtggctgtgaccttcttcctttacttcctggccaccaactactactggattctggtggaggggctgtacctgcacagcctcatcttcatggccttcttctcagagaagaagtacctgtggggcttcacagtcttcggctggggtacgcgggcacagcgggtagcgaggtgccggcaggggtgggaccgtgggtgacagggagagggcagcccctggggggaggcgcccacacagcacatcccgccccaagtggaacagcaggagagaggcctgccgcccttctgtgatcctgaccctattccaggctcaggaaacagcagggcttggccagggatcaggttcacctgaggttagattcacctgaattgaggctcggcccaggagagggaaaggaggaaccatcaggccaagattcagctcaggatcagagtaggatactgggtcagaggtcagcctggggctggaattgggatccgggaccctccctctaccctgagccccatggactaggccagcatctattaccccaccagtccccttgctgggatggggcgcggggctgcccacaccattgccagcctcagcaggcctgcggggtccatggcccagagccgtgggcccagcacctcagcatcacctgagcttcacagcacctctgcagaatgggttgctggagctgcgcactcctcccagccccccacaggctctgggatccagttaccgataattgtccattattgttggcagctgcagagcttggctgggctccgggacaactggccagactgcagaggggtgggccgggtggctggagccctctctgcactcagcacccagaggcccacaggtcaacagccaccgcctccctgcccctcgacatacatcctgaccctgacctcaccatgacaagccccagagttggggagacctgggcccagtcccaggaacagatgcaggctctggggctaggaggtgtcctagtggactggcgacatgcagattgggagtgcatagaatcctggggcacaggaatgtcacagctctttttcttaccgtaaagccaggtcataccctatccctccaagggtgtaccaggcctagagtcaagttggtggtatgtggtcggggaggacctggggctcccttcccagaggcacagctcacccaaatataccatgtgccccttgagctggcgcaggccaggacatactgacacaccgaggtctccctgtggcctctgcttgggacaaaacctctcaccccatccagtctcatccacgagggctaggacctttcaaaccaggttgtggggggtgctgtgctggggcaaaaaaaaatgcggaaaataggctgtctccccatgggagctgcaagtccaaagcagtgccctctgcagagggagtggacagggcatggatcagttagtgataccttattattatattatgccttgtaccccatatatgtgcatatgacatggagccaagatgagggcagaggctgagctgggttttgagggctggagccccaaggggaagctgttagggcaccacatggcagagtgtggctctgtcaccaagtggaccaagtgcccagtgtcaggggttcagggcaatggtggggtaagctgggggtcatcgaggatgaggggggaatgaccttgtggacagcagccacagtcctgcacactgtccccctctgtgcccacaggtctgcccgctgtcttcgtggctgtgtgggtcagtgtcagagctaccctggccaacaccgggtaggtccaggtggagaaggggcccaggcaagaagcacccctgggtcccttttcttccaggaagcatgtgagagggcctcctgtaccctggcctcaaacggcccagcctcaggagttctcagtccagcctcaagccaggagcaccctcagggtcacaggaggctacttccaaagaggcctgtgagggaggcctcaggcctggccacacccagcacccctgccctgtgtcctcaacagctaatgtcagaccagaccaaatctgggtctctgtgggcagtcttaggatgggaacaggagggatgggagctaatgcctcaacctcccccaggtgctgggacttgagctccgggaacaaaaagtggatcatccaggtgcccatcctggcctccattgtggtgagcaggggtgggctgctggccacaggggtgggtgggatgtgcgcctgcgtcccctggaaccagcccctgacagggacctaggaggcttccctggaccccagtgtcagagctacagaggccggaggaccagctgatccacactccagcccagaaaggaaaaccaagggctcaaggagccacccagagatgcagtgacagagcagagcctatggccgtggctgccaggccttgccccgccccactagggtgcagcctccagacgcagccccctcactcccacagctcaacttcatcctcttcatcaatatcgtccgggtgctcgccaccaagctgcgggagaccaacgccggccggtgtgacacacggcagcagtaccggtgagcccaccatgcctgccatgccctggctcctcaggggtccctgagtcctggtaccatgtaccccaggaaagacagtggccccatgaatgatcctggggcaagggaaaggacccagcgtctgactccctggctgtcctcacccacctggcctgcccagcagtgatgggaggccctagggcaccccaaagccagcctgcccacttgtaccaggccctgcactagagctggagtctgtgagtgtgcaacgaacttgaacctctcctcaaagagttggttgcagggggtctgaggaacaggtaggcggtgagtggccccgggaaggctgcagctcagctgaaacctgaggagcggactgtgggatagtgaggttcgaccgtggaggggagtgcttgccagctgagggctccacaggtgcgaagggcccagggacagggggactgtcatttgaagtccgctccgggacaccgctgagaaccaacgggccctattagcacttagccaggacagcagccatgcaggtgaactgggttgtcctcccatggtgactggagccctgggcccctttgagcttccggagcctggggctcgcagggtggggggtggcacaatgcttgttgaaggggaagtggcttggccctgacctacctgccccgctggcccaggaagctgctcaaatccacgctggtgctcatgcccctctttggcgtccactacattgtcttcatggccacaccatacaccgaggtctcagggacgctctggcaagtccagatgcactatgagatgctcttcaactccttccaggtgcgcagtgctggcccgggcctggctgagggtgggaggggttccgggggcaggcctgattcgagacacccctcttcacagggattttttgtcgcaatcatatactgtttctgcaatggcgaggtaagcaggagacagtgttggcatagggcagggtggggcagataccccagaggcttcctcaaggctcatttctccattcttccaccctgttatttctttgttcctccaagaacacccctgaggacattctgaaagcagagaagtctttccagatgatgcaggttcaggatgtgctaggatgtggggactcttcagtcactggcatagccaagtgtcttcccagccccatggttcaattatctgtgacccagattggaggactcagccacctttggggcaatttgagccttgtagattctgggtgtgtcggctgcctgtagccaaacaccctgttgtgaggatgggatttcacttggccttggagtttcccaggagtcccctattcccattttcattccgtgctgggtgtccaggggccgggatggggcatcgctggggttgggagacacacctgactgccgcacccttactgccccaaggtacaagctgagatcaagaaatcttggagccgctggacactggcactggacttcaagcgaaaggcacgcagcgggagcagcagctatagctacggccccatggtgtcccacacaagtgtgaccaatgtcggcccccgtgtgggactcggcctgcccctcagcccccgcctactgcccactgccaccaccaacggccaccctcagctgcctggccatgccaagccagggaccccagccctggagaccctcgagaccacaccacctgccatggctgctcccaaggacgatgggttcctcaacggctcctgctcaggcctggacgaggaggcctctgggcctgagcggccacctgccctgctacaggaagagtgggagacagtcatgtgaccaggcgctgggggctggacctgctgacatagtggatggacagatggaccaaaagatgggtggttgaatgatttcccactcagggctggggccaagaggaaaaacagggaaaaaaagaaaaaaaaaagaaaaaggaaaaggaagcggtgtgtggcttcctgtggcccaaactggggactcactccgagagggtggggctgggagccagggaaagctgtggcgggagggccatgagtcatggaggaatcctcaggtctcacttcagaatggggagggatctggggcctgtggtatccagcagaaagggcccagagtggctcaagtctgcaggggtcacacagcagccaagtggacccatgtggaaatccagcctcagcctccgttgctgccagctgtggagctgctctccacacttgtacctagaccccatgggggacccaggctcctctgggccaactcttctgactgctgcccccatcactgccacccagggctgctggcagatccctcgggtccctggccacacccccaagcctacggccctgccacagaatggacctttcctggctgtccagtggccactcagggagccctccacgcaggagccttagcatccacccgtgacctgacatgcctctgtgactgaggttgcagtaggagcaccaggccagcaggtgaagggtgggctgggtccctgctctggctcaggacttgtggggagccaggagtctgagcccagagggctggctgggcaggggcctgcaaggtgggacacatccattcactatgcatctgggacagtcactaagtgtcctcacctgacacccacctaccaccttactcacccccccggaccgtgccctctcccaccttgggccattcgtgggccccagagtggcacagagcccctcagcccgacaccctgaggactgaccctacagcatgcccaccccgggctctggcctgaacgagcttcttgctcttgctccagcctaaagacagccccgcacgagccctgccctgccttcccatctcccgctcagcccgtcttactcttctccacggactcggcatccaggagtgcacctcatctccagcagcccacacacaccccatagggcataggggaggggtcaggaggcccaagacaaaaaactcaggtgggcgttaggaggtgtgggtgcctgctgagcagccccacacccagccctgcctgcccttccagatgacggacaggaccaaaggctgtccaagggcctggtgcacccgtggagctccatgcaatggttgagggaggcataggccagtcttgaagggctgcagagccaggctgggagccactggaagttcaagagggagagcaacaaggtctgaatgtttaaaaagtccccacagcaatgtggagacgagaggaggctgcacaggggttggagaagaggtggcctggcaggaggcgggtggcctcgcagggagatggtgacagggagggcagcaagagttagctgggggaaggagacctcagcagggcagaccctcatcctcctccccagggatgtccgatgccactctctagggtctgaactgaggtttctgaagtaataagccaatgaggcccactcacctagaagcattcagactgggcaccccgcaacagggctgtggcttccccctcagactgggtgcccccccaggtggaggtgggcctctcctctcagattggattccctctaggacagggtttggtctcttcctacaaccagggagccccaatccccacccacaccccaggacagggctgtgtctccccactcagtctgagtaccccaaggtcagggctgagcctctgtctcaggcagggtgccccccagggcagaggtgcgcctctcctctgccctactgggtcaccccaagacagggctgtcacccccattagacttgtctccatcttccctttagatggaactcccctccagatagggctgtccttcccctttgaactaatgcccccaggacatactgggtacccccatctcaggtttggtgtccccaggccagggccgggcatcccacaccagctggatgcctctaagaggaggactgccctgccctgaggatatctgcacccagggcagtgccaggcctccccctttagactaggcaccatttttcccctcagtctggatgtccaagacagaactggacctctcacctcagtccaagtcccctaggctaggaccagttctcttcccttagactaggagcccccaggccagggctggcctccactcagagaggcctcagagccccacctgggccatccaggtattggcagtggaagtggagccctcagcaggcctggcaggcaggcaggaccctgtttgccttgagcaggggctggatccaggtggtcacttctcccttcaaggccccacagcaaagccaagccacagggaacacgtaaacattagcagagctgggcggggtggtcagcagggtggagggcacctagagaccccaaatcctcagcccacttggctatgggatccggcaccttgcaggctgccccagactccaaggcaggccagtacagtggccagtttctgctcccacctgtcttgagcacgtggacggccccatccctcgctggcctgtctccctcagcccaggctgcgagaagaatcgctgaaggcccttggaaggaatggacctcccgggggtgctcgtccagccctggaacacaggcctagcctcaaggggaagctgagtggatgcaaagctcccagctcagaatagggtcgagctctgccacccaccacctgccagtccctgtcgagagcaaggactgagctgggccccaagtgcctggagtgggcaggctctgaggggccacaatcttcagccctcaccctgggaggtggccagagggggtgtggacagacaggaaagggggctgagttctctggaggttcaagagggacatgaccctgcccctccctccctgggatctgggaggacacagccctgctctgggggtctgaggggacatggacccatcctggggatctgagagtgcattgtctctgcgtggattcctggaagagctgtctggctgcagggacccgttgcggggggctggggtgagggggtacaactctctgtccctggttcctcctcagccaactccaggagaatgatcccagcccaaggctgccatggccaactgaaacaaaccttgcctgagggactggtcccactggctgggagggacagaggaggaagttactccagagctaggcaggggcctgagccctggctggctccaggtgtgtgctgtgtggctctgggcaagccaccttccctctctgagcctcaacttctcttcacaggtcaagcccctgctcaggcttcatgacctgagtggactcaggatcctacctcgctcctcaacaaggatagggacaggacccctatccttccctcaggcaggcgtgacagcctaaggacctcccccttagcctcaaatatgtctatttgtgtatgtctgtgtgtgtatttatatgtgtgtgtctgtgtgtatgtctatttgcatgtgtatttgttgtctatgtgtatttgtgtgtgtctatttgtatgtgtctgtgtacttgtgtgtatgaccggctccttccctcttcagtgccacgggcatgcaggcaatggaggccaggtgagggtggattcttcttgctccagcgtttttaacaggcagggcaggagcagccttggcatggcccggacactggcgcttgcccggaggccacagtcagacaacctgtccacaacaaactcatatccatacatcagcaagacagtggggcgtgttgggtgtcattctccatgtgcgagcgtttgtatgcgcgtgctgcttgtgtatttctttgtgtttgtgtacacgagtgtccatgtgcctatctatgtgtgtctgtgcttgtgtacctgtgtgtgtgtgtgtgtgtgtgtggccatgtgtgtttctatgtgtgtgtgtctggatatgcctgtatgtccatttgtatgtgtctgtgtcttctggcatgtctatgcgtgtgtggttgtaggtttgtgtaccagtgtgtctatgtgtgtatttgtgtgtgtgtgtgcatttgtatgtctatttgtgtatttctgtatgtgtgtctatttgtgtgtgtgtatctgtgtctatttgtatatctgtctgttatgtgtatgtgtgtgtgtgtatgtgtctatgtttctgtgctggtgtacgtatgtctatctgtgtgtatttatatgtattgtgtatgtctgtgtatgtgtatttgtgtatttgtgtaaatatgtgtgtctgtatatgtctatttgtgtatgtctgtgtgtgtatttatgtgtgtgtatgtctatttgcatgtgtatttgttgtctatgtgtatttgtgtgtgtctatttgtatgtgtctatttgtgtgtatgtctctgtgtgtgtctatttgtgtgtgtctgtgtatttgtgtatgtctctctgtgtgtgtctatttgtgtatgtctctacgtgtgtatgtgtgtctatttgtatgtgtctgtgtgtttatgtgtgtatgtctctgtgtgtgtgtgtctatttgtgtgtgtgtggactcgtggtctaagaacgccgcctgtgggtggaatttggctcatagacatgtttggtttggcacctacagtattttcaacatcctgagccaacatttaaaaatcaggatatttcacataaaaattcagctttccaacttctcttaaaaattcagaagccctggcagccctgggcctgcgttcccctgaggccacgctcctcccgaactgtgcagggctgccctcctccgtgcaccctccatagcctcgcccacttgtctcgcccagcagtgtcttgaggatggctgagtttgtgaacccagtgtgtggtcacaactacgtgtgagcctggctgtcagggaatacgtgcatgagtggggtgtgtgtgcatgtgtgtgaatgtgtgtgtgcatgtgcaaagcaactctgtgtatgaggcaaacctgagtgtgtgcggtgcgtgtgaatgcctgcatgtgcgcgtgcgtgtgtgaagagtctgcgtgggggaacacgtgtgtaaaggcatggatgtgcacgtgtgtgtgcaggggagtggccatatttgtggctgtgtggagtgtgtgggccacagcggactggcatgctctgcccaggggcctcttccggtctttgagggggaattggattcccggcttctggctgggccgccttgcgggatttatttctgtctcagtgcccactggagtcctgagtaatgggaacatttaaagaaaaccagtaaatagatacagaaggggcaggctggctgggaaactcagcccagacacccctgcccagcccacagctgccagagcccctgggggcaggcctgagcccagggagaaaggagctccagcatgcgacagcaccccctcactctgtggggtgcccactgctacccatgcatgcccccaccacctggatggatggtccctgggtcaacactgggcatcttgagagcttccttggctccgagcagcagatgttcaggagattcaggggatgccagctcaggcctggcccaggggccaagaggacctgaccctccaggggtgccctttcccagccaggctacaggcattctgcccacacacaccctctgcacatgcagacgcacccacagttcaaggaggggagaggctgtgctgacctggcagggctgggcgggcactcgataccccacccggacctcacacacccggcagtgccttggaacctcatctgccaggacacggcccctgctgttctgggtctcaggctgactggaccccactctctggatcgtctctgatgagcagtcacttacaaatgacataaaccccacaggaaaggataggcgtgcgtcatgcggtggggtgacctgctttacagaagacccgctgctggcaggagctgtttggaccaacgcgccctgtcagggaccccatcggggatctcctgctgccccccagtggccatgggaggacatggggaaataaaagtcaacagctgcatggagttgctcatccgcgtctgagtggactctgagggccccacgtggttcccagccagacagttatggggaagcaaggcctttcaactggtctgagggaaggggcttggatcccagcacagatctggagaccacctggaaggtcagctcctcgaaggcagaaccatcgtcagtcacagctgcatccccggatacagtgcccagcatgacatgggtcctcgggaagcatgctacactaatggcccactccccaggctcctgggggtgggcagcgctgtagcaagccctgggcccagctcagagccccatggagaggccgcctgaaggtgagcgggcatctcacatgttgaagcctccaaggcagtgaggggcttgggcttgaggctggacagtagttttcccttgtgacttcaggggttgtgcctatctctgatcccaagcccatagttcctcactgtggttacaaggccctgtcctggctggtgacctgcctggtccctgactctgcaagcccaggtgggact

SEQ ID NO: 14 - DNA, 8856 bp, Homo sapiens
cagcttgtttctgttgtttggtgcattaggccaaaagacctaggcctaatagatggaaaagatggcaggatgtcttggccttgctctgacagttgcttctctgatctcagatatttcccaccctttgtaatctgtgttccacacaggaagtagttcttgttttttaaatatcgaaggtgtataaacgtaaagtttttatagatgagccacccagggccaatatctgtttaagtaaagacctaaatgctttgcagagacagtaaagtgtcatgtctgtcccagggaaagaaatccaggacaggaaatgctcagtcttccagcactcctctggctacctggagctcaggctatgagcctcaacccctccctgaagcattagctctggagcagaggctgtgatttacttcagagatctgggcaagtccctttaacctggtagtcctgcctttccttgtttgtaaaacagagagatgaggctgatagctccctcacagctccatcagaggcagtgtgtgaaattagttcctgtttgggaaggtttaaaagccaccacattccacctccctgctaatatgattactaaaatgtttttatatgaaagggccaattcctcatctcccctcttcctttaaaaacagaccaaggggcatcttttcttgtctccctgtggcctaaaaggttactgcttctgtggttatctccttggaaagacagagtgtcaggactcttaggtacaccaaaaatgaacaaaaaaatcaacaacaaccataacaccaacaaaaataactgctgtgtcggttcttaagacggcttctgagctagaaacagatttttctaactgtaaaaaacgtggccccagcctgtctgcaggccacctctgtctttaggccttggggggaggagggaagtgagctcatttactggggtctacctcagggtcatcaccaaggtgttctacaaaacgcactttaagaatgttttggaaggaaattcaccttttaacagcccaagaggtatctctctctggcacacagttctgcacacagcctgtttctcaacgtttggaaatcttttaacagtttatggaaggccaccttttaaaccgatccaacagctcctttctccataacctgattttagaggtgtttcattatctctaattactcagggtaaatggtgattactcagtgttttaatcatcagtttgggcagcagttacactaaactcagggaagcccagactcccatgggtatttttggaaggtacggcgactagtcggtgcatgctttctagtacctccgcacgtggtccccaggtgagccccagccgcttcccagagctggaggcagcggcgtcccagctccgacggcagctgcggactcgggcgctgcctgggcttccgggacccgggcctgctaggcgaggtcgggcggctggaggggaggatgtgggcggggctcccatccccagaaagggaggcgagcgagggaggagggaaggagggaggggccgccggggaagaggaggaggaaggaaagaaagaaagcgagggagggaaagaggaggaaggaagatgcgagaaggcagaggaggagggagggagggaaggagcgcggagcccggcccggaagctaggtgagtgtggcatccgagctgagggacgcgagcctgagacgccgctgctgctccggctgagtatctagcttgtctccccgatgggattcccgtccaagctatctcgagcctgcagcgccacagtccccggccctcgcccaggttcactgcaaccgttcagaggtccccaggagctgctgctggcgagcccgctactgcagggacctatggtgagcaaggctacctggtgaggggagacaggcagagggggtctaggagcctccttggggggaagaagctggtcacaggctgtgaccgaggcaaaaggtggcctaattattttccaatagtggtgctggaggtggggatgctggcgctgaaagacctttaaatatcggctactgcccctgcccaggccttctctgtccagcagtccctgggagattctcacctttgggaagtgcggggcaggagagcagaaacaagagaagcccttggtaggggggtcgttgggaaaaactgtggggtcttgggctgaacgcgttgcccacgggctggaggttgcgatccccggacggaaagcgcgggaggaggaaggagagaaccggctctgaggtccagagagagtgagggggcagagcgacggcgagatggggagagaacacctagctggagcaggttctgcggtagagagcgcagtcctgctggcctctggagagtgcgcgccgctccggaggctgcgtcgaggggagtgtcacccaatctggcccccagctggcggggcgccctgagagcttgcgaactgcagttgcaggacgcgccttctccacgagctattttcgtcgacttgcggaacccaaggaacctcgcctctatcatttcacggtgtagggtccctagagacgacagccaagatcccaggggctcccaggacgcttgttcctgcggtgtcgtgtcctatggggagttcctggcgggacgaaaggcggacgcgcggctcttcctggccctccaggcccggaaccgacgggaaaggttcccgtgattcccgagtccctgcaggcttcttccagcgggagttggtccgggggccttagaggcctccaagcactgctttggaggatggtttccaaggatcgcggtttgtgagttgaaggctttgtgagaggttaaacccccaaaagatacatacttggtaaactgaggctacctgtaaacacatttcggcattaggagaagattcgagtagggaagtgaaggacaaccaccccgagttacattcctttcccccaataaaaagctctggggatgaaagttcttttggcttttatcttttcgatttaaaaatttgagaagaaaaatgtgactagagatgaatcctggtgaatccgaaattgaaacacaactcccccttccccttcctatcctctcggttttagaaccgcgctctcccgccccaggagattccttggggccgagggttttccggggaacccgggcgcccgccccttctactgtccctttgccccgcgggcacagcttgcctccgtctgctttctctacttctggacctctcctcgccgggctttttaaagggcttctgcgtctcaaaacaaaacaaaaaaaccctttgctcttcccaaccctttcgcagcccgccccagcggtggcgcgggaccagcaaaggcgaaagccgcgcggctcttgccgggcgcggacggtcgcgcaggggcgcccgcggcctccgcacccggacctgaggtgttggtcgactccgggcatccacggtcgggagggagggctgagctgttcgatcctttacttttcttcctcaaagtctacctgccaatgcccctaagaagaaaaccaagtatgtgcgtggagagtggggcggcaggcaacccgagttcttgagctccggagcgacccaaagcagcaactgggaacagcctcaggaaagggaggtcgggtggagtgggctttggggcaggagtcatggggcccgggccccggggacgacctggcgctcccggccctgctgaacgctgagttgcgcctagtcgggttttcgaagaggcccttgcgcagagcgacccacgcgcgcggcagcatcttcgattagtcaggacatcccagtaactgcttgaactgtaggtaggtaaaattcttgaaggagtatttgctgcgtgcgactctgctgctggtgcaacggaggaagggggtgggggaaggaagtggcgggggaaggagtgtggtggtggtttaaaaaataagggaagccgaggcgagagagacgcagacgcagaggtcgagcgcaggccgaaagctgttcaccgttttctcgactccggggaacatggtgggatttcctttctgcgccgggtcgggagttgtaaaacctcggccacattaagatctgaaaactgtgatgcgtcctttctgcagcgacgcctctttctgaatctgcccggagcttcgagccccggcgtctgtccctcagcctggcatggcttcttcgggggtctgctttgcatggggagaggggccacgcagcggcggactaggtttggggattctcggtaatggacccggagcaatgactaacagccgctccctctcactttcccacagcgatcaccctctaacaccctccctcccattcccggccccgcgcgtgacaaggtcggctgctttcagccgggagctagatcggtggcccggctcttcggagccttagcaggcgttcgccaaggggtgactggctgtcattgggagcaatatttggccttgaggagaccctggggaggaagtggcggggagctcgtgtttgcttgtgtgtgtgtgggggggtgtgtgtgtacacgcgcgtgggcagggtccctctgcgctttcctttttaagtgcctctcggtggtgaggctttgggcgggtgagactttcccgacctcgctcccggccccacttaagccgggttcgagctgggagacgcagtcccttcagtgcgccccaaatcctctggcttcaggtggcccggcgcgggggcccagcacgacgcaccgcgccgagaaccgggttctccgtgcgctgcgccagtagccctgggagcgcggcggccgcggggcaccggccgagggctctgccgagcgccgccgggagctcctcccggaccgctgaggctcgggcggcgggcgcggaggttggcctcgcctggaggggcgggcccgcgaggggcggggggctgtggaggaggggagggcgcgcaagccctttcgccgcctgccgcgggaggggcctcggcgctcacgtgactccgaggggctggaagaaaaacagagcctgtctgcggtggagtctcattatattcaaatattccttttaggagccattccgtagtgccatcccgagcaacgcactgctgcagcttccctgagcctttccagcaagtttgttcaagattggctgtcaagaatcatggactgttattatatgccttgttttctgtcagtgagtagacacctcttccttccccctccccggaattcactctgccctcaccacccctgctcgccggctgtcccttccgtcggacctcctttacaatatccacactctgctccctggcagcactgtcgctcccttcttggcccggcagccggggcgctggaagcgtacgggttccttttaaagtgctgctagcgcgcactcgccctctcagcgttgcaagaaaggggagcgcgagggagctaaagagatgaaagcccggggttgtaccttgagggctaaccactcccttcccctatccaacttgtctgggagagcccccagtgtctccgtggcgcgttcccactctcttgtcaaaactcacagaggtctctccggaatcgtctctcaccccttccctggggatgagcgggcacgatcaggcacttttggctgaatatttcaaactcatcggccacaataaaataagccctcaagccacccggttagctcccagaccaccttctcggcttctggaccctgtcgccctctgtcttcgcccagcccctgcctctcactttccctccctctggctctgaaccaactggaagttgtgaaagttgggctctgagggtggaggaaaagggagagaagctgaaggtctaaagtggagagcaatgccattttaattctccctcccccaccccttttcaccccctcaatgttaactgtttatccttcaagaagccacgctgagatcatggcccagatagcagttaggacaaaaaaagattaacaggatggaggctatctgatttggggttatttgactgtaaacaagttagaccaagtaattacagggcaattcttactttcaggccgtgcatggctgcagctggtgggtgggcgggtggtgtgagggagaagacacaaacttgatctttctgacctgctttccatcttgcccctccatttctagccctaaatgcatatgcagacacatctctatttctccctatttattggtgtttatttattctttaaccttccactcccctccccctccccagagacaccatgattcctggtaaccgaatgctgatggtcgttttattatgccaagtcctgctaggaggcgcgagccatgctagtttgatacctgagacggggaagaaaaaagtcgccgagattcagggccacgcgggaggacgccgctcagggcagagccatgagctcctgcgggacttcgaggcgacacttctgcagatgtttgggctgcgccgccgcccgcagcctagcaagagtgccgtcattccggactacatgcgggatctttaccggcttcagtctggggaggaggaggaagagcagatccacagcactggtcttgagtatcctgagcgcccggccagccgggccaacaccgtgaggagcttccaccacgaaggtcagtctcttcccccagtctgcgtgggggagggctggtgggactggctagaggggcagtgaaagccctggggaagaagagttcgggttacatcaaagccccagtccaggaggctgaggaacagagctgcttacctccaagaatttgcagagctgccgccgaacttattttttggagacagagggggaggtgttcaggggaaggggaatgacagcactcagacgtgggctagccccagcggtgtgtttttgctatatcaaagccttttctgctaggttttctgcccgtttttttcaaagcacctactgaatttaatattacagctgtgtgtttgtcgggtttattcaataggggccttgtaatccgatctgaatgtttcctagcggatgtttcttttccaaagtaaatctgagttattaatccaccagcatcattactgtgttggaatttattttcccctctgtaacatgatcaacaaggcatgctctgtgtttccaagatcgctggggaaatgtttagtaacatactcaatagtggaagagggagagggtggttgtctgcatgtttcctcctgcctgtgctctgttggcccctctttttctttacaaccacttgtaaagaaaactgtggacacaaagccaaggtggggggtttaaaagaggagtctgattgtggtgccatagaggagttgacacatagaaattattagacatatcaaggaggctggatatagtttctgtctttggtgcttgagaaatgctagctacattttgctggtttgttagctgccccacttatctgctccttcaaattaaggggtatgcttattttcccccagtaggtttcccctgcataagcagaattcaccattcattgcccaaccctgagctatctcttgactcttccatctttgaaaaaagttcatatgctttttcttttccccttccttcctaactgtgcctagaacatctggagaacatcccagggaccagtgaaaactctgcttttcgtttcctctttaacctcagcagcatccctgagaacgaggtgatctcctctgcagagcttcggctcttccgggagcaggtggaccagggccctgattgggaaaggggcttccaccgtataaacatttatgaggttatgaagcccccagcagaagtggtgcctgggcacctcatcacacgactactggacacgagactggtccaccacaatgtgacacggtgggaaacttttgatgtgagccctgcggtccttcgctggacccgggagaagcagccaaactatgggctagccattgaggtgactcacctccatcagactcggacccaccagggccagcatgtcaggattagccgatcgttacctcaagggagtgggaattgggcccagctccggcccctcctggtcacctttggccatgatggccggggccatgccttgacccgacgccggagggccaagcgtagccctaagcatcactcacagcgggccaggaagaagaataagaactgccggcgccactcgctctatgtggacttcagcgatgtgggctggaatgactggattgtggccccaccaggctaccaggccttctactgccatggggactgcccctttccactggctgaccacctcaactcaaccaaccatgccattgtgcagaccctggtcaattctgtcaattccagtatccccaaagcctgttgtgtgcccactgaactgagtgccatctccatgctgtacctggatgagtatgataaggtggtactgaaaaattatcaggagatggtagtagagggatgtgggtgccgctgagatcaggcagtccttgaggatagacagatatacacaccacacacacacaccacatacaccacacacacacgttcccatccactcacccacacactacacagactgcttccttatagctggacttttatttaaaaaaaaaaaaaaaaaaggaaaaaatccctaaacattcaccttgaccttatttatgactttacgtgcaaatgttttgaccatattgatcatatattttgacaaaatatatttataactacgtattaaaagaaaaaaataaaatgagtcattattttaaaggtaaatcatgattttttttttctccttaatcctttctcttttccttcgggctcatctcttttgaatgaggcttttttctgttcaggtgagttggaggctggatggaagtcaaaaggtggtacctggaggtggttaagttgtagggacaggaagtaaactgttggcagagagagatggtaattgccagcatgaattgttttct

SEQ ID NO: 15 - DNA, 260116 bp, Homo sapiens
tttcaacttttccatgtggaatcaagagcgtgttgttctattacctttgtcttaaaagtgtaacttaaatgaactgaaatattctcatgctttaaagaggttaaagagtatagcttaccagaatgaattaggattaagaggtatattgcaattcagatatctttatgaaagaggcaaaaatcactgactacttggcctgaattatcctctgattcagaatttggagtaggccttcgatgttagaaattgtcggactctctttaaaacatctaattaataattaaaaaccttccctccctttggaatttgttcaaatgccccttcctgtaaagttggccacctgaagagacatttgcagacgtggctttaaaaagtaatgtgacacttgtttcacatgatagacacagttgcaaattgagatttttataccgtttgataccaaacgctcagtagggatttgggaaaagtaccatgttatgggcatttccctcggttctcttttttgcttgtgtagagtttcactggtttgttaaattttgagacttttttttttgccagaaaacctgtggagaagtgtcatccacattttgaatttcctaaagctctaggcttttctcagatgacaggtgaagtggacttttgaaagttttttttttttttccaccattttggaaagttgatggctctgttgttttctttagggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatggtgagcagcacagggattaccagcagcccagcctggagtcatttctgtgttctctgcattccttgtgaattgagcgtttgcacctggaccagtgtttgttctaggagacgctaaagaaagcaaatggagcaggggcggggggacggcggggggacatggaatgtagtaatctctattttggcactcaacctacacgttgacttccaaactttctaatttgagatgtaaatgtgataggttatttattatcagaagttcctgttttggcattttggaaatcatcttgactagtctggcaagagttcaaaatgctttgtgttgcatatggatcatctacactactcggaataattagtacaaaagacacaaaagttgtcttgtcaaaattagtgacaggacagcagtctcctccaaccccaactttaagtagtctactttaaaggattttaagaattgttaatgactgaacctcaaggtaatgttagtatctgagatgcaggttttgttgttagcttataaaaatttaatttacttatttgtgttcagagataacacagagccactgtttctgtattctgtgtttttaaagtttaagcaaagtgttgagaggcatttcagttcaagcatggagtgttgaaaataaattccagagcatccctggtacaaacagactgaatatgttaatggtaaccttcacttcctgtccctgctgtttctccattgtgggccactaatgcctttcctttttgtagatttcatagccattcttggcctccctgaatttctctgcttttccatgggcctttaggaagaatgagctggcccgttttcctcgttcctggacactgcctatctgggcacactgatttgtatgagtcaacctgctattcttatattttctatattccaagacaggttttacttgattgatttacaagtttttacatccacctagagagtcagaatctcctttggaaggtaactgcagtccagaacattagactctaagggcatatacttccaagcagcctggccacttctctctgggtccctccatgtctgctgagagcctgtgcttctcacctgcacttcttcacccggtttcatgagtgtgctttgctgactgtactgggtagggaaggagctggctcttaaacctgctggcaaatgacttcagttttaaattgatcctgagggagatatatttacgtctgagttaaaataatgaatttacatatatgtgaaaatatttcctcctttattgatggtatttaaagtcaagactggagcttattttaattgagccagaatatttgcatttttcatccaatgtggttatagaaggcatttctccttagaaatatgttaccttggtttcttttttctggaattggtaaaatttaggcaaatttattatttcagaaatagaatcagtatatgcagtgttggttatttggtaatttttatggtaattctgtcggaataaatgcttcctatgtacttggcttcaggaacatcagcttttggttatctttatagtttgcgtgagtgcacatgcctgtgtgtgagggtgtgagtgagtgtgagtgtgtgaggatatgtgtgagtgtaggcaaatgtatgcgtgagtgtgtaggtgtgtgggtgtgggtggtagaggtaactatgagtgtgcatgcgtgtgagcatgcatatgtgtgaatgtgagaacaggcaagaacaagtgcatggcagaagatgttgctgcactgcatggagcctgcagaagcgcctgtcctgtttgtcaatctcagctgcatggccacagagtctcattcttatgaagatgctgttgtttgtgccactaccacacctggacacattctcaggaggtcttccactgcagctgcatttgtcttgagttggtcttggacctcgggtttccctcatgattctgttgagggtgattgggaacagaactaatctgaccagccccacaacaaccagaaagccacgagataaaactagccagagaaggagcagtcatgatttacaaatgtttgtgctgcagtgttaaataatcacctgtttcctcaaccacactcccctggctttctgccctgatcagcttgtgcccttgagcccacattttctcctaaatgtgtatgaatcctgtcctgtttggggaccgacattgattggtcaaacttgcagggcacatgcctgagtgatagctgtcctagaaatctggcgaactctggccagtttttcagtgttcctgtttcttctaagagatttactgttttatattttgggacaaaaatcaaataaaagaaaaatggaagtggtgtttttaaacatggattgcaagccgacaggcagattcttggaaaacaaataaatctaaagagaggaacaagtaaaagaaaggacaataaaccctttctttgtgtatgtgatgctaataattaccatggtcttttttacagagtcctctacagttttcatctaactagttcagagcctttttacagtcccaggattatgctgaggggcgtggattgctggaagcgcagaggccctttcttctgcaacctggtcacctgctgcctctgcactcagtcttgatcacagggactggtgtgtgggctttggacctggccctgtctgggtttagagctcgtggggtgcaggatttccaagttgggacactattcgtgtgctggctggtggttgacatcgccatggccctccatccttctgtccatccatctgtccctctgtccctcttcctatcttttctctttttctctatgaatatttcataaatgcttggacccctgcactgacgctattcgtagaaaggaaaacagaatcatatggatgctataacaggtagtttgattgctactgtttccagaaaggttcttgtgctttctttaacaaagccctgaactatatccatttataactgaacaattaaaaatgagttcagtttcggccaggcccggtggctcacacctgtaatcccagcactttggcaggccgaggcgggcggatcaccaggtcaggagatcgagaccatcctggctaacgcggtgaaaccccgtctctactaaaaatataaaaaattagctgggcgtgtggcgggtgcctgtagtcccagccactcgggaggctgaggcaggagaatggcgtgaattcgggaggtggagcttacagtgagccaagatcgtgccactgcactccagcctgggcgacagaacgagactctgtctcaaaaaaaaaaaaaaaaaagagttcagtttcaaaaaccaaatgaatgtgatacctgcattttctctcctatccaccatttcatgattaaaatcacacaaatgaacaaaaagttttgttactggctgagttattggtgaggttgctttaattaacttttccagccattctgtggtgcaatttgttcttcattgtgagcttcccagccaaaccactcacattccactgcatgtccttgcagatctgttttcgtacttttctcagctgagtatctgctcctggaataacatgcgtatagagttttgtttaaacatacgcagacccacaaccaaaaggtacagttcagaaaacttgaacagctttttaaagaagcatttgccacttaacactgaaatttaaaataatgcaagtgaaaaactgtgttgtagatcttgtatgacaaaaaaaaaaggcaagtcaaatttgatttttgtaacatttaggaacctatatcaacatataaagcctttggtaatctttatgcaggaagtacagtgtacccgtagtttcatgtgcccatagtctgattttaaattttattgttatatttgaagtgtaaatgacgaaggagatgacatttagttttctgaattatttaaatgcaattgtggtttaagtgatcatttgtggcatttcacatattggctttcccatagaaagtatgcatgcagatcttaggtataattgttgactttaaaatgtccaagtccattaatgtgtgaagactgtaagtaaaatgccttaataatctctttttgatgtagatgcattacttcataagctacatgttgtgttttctaaataataagagtttttttcatctaaatcttccaatgttctacatgttctcattctcttataaaatttttttcaacaatttgcaaatactgacttttcaatttgaagtgttttgcctcatttttggcccatgatttcgttttaaaggagtaattcgatagttcttattaatctgcaactcggctttaaaaaagaaactaatgataaacgtatgtaggctgtggtcttggggatcttttatcagatctgatagttattgggaacatactttaaagtgatagaaagcagaaattattatcctaacgctgatgcaatgtgaaaccaaagttgatagattaatgatgcaaaggaagttccctgttcactttgattctttcaaaaacaagaatttggttctttgcttaaaaaattattttcttcaaggttggtaaggggaaagtgttatggtctgcaaattcctaaggagttgcttttttttttgctttaacttttggtcacttcttggccttgcaatttgcttttaaattgtccattgcatgggtgttgttaggttggtgcaaaagtaattgcggtttttgcctttaaaagtaatgacaaaaaccgcaattacttttgcaccaaccactgattgtgatgtctgttggtcttctagctgggagtcagatggctttgagttttgttggaagtttgaaatttatctgctattcttcaccataagctcttgtctccttgacttttttttaatggtaagagtatatgtgccagttctgctctgaaatgggcaggcagttcacgccataaagaacataggttgtgagttttcggtttcttgtttctatagaggtccaaccctttttctttgccacatcccatttcctggcacatgacagatacgtggaaaggatgttcagataaaatggatttcagatcataggatgttcatttgtagcacacacaggttctgggatctgaaagcttggtttgagttctggcaacacgaaggactagccatgtgagtgtgagcagattaacttttcagcgttctagtttcctcatcagtttcggaagacaatagtaagacctacttcacacttcacaggctgccgtatcataaacatataggaaggactctgcaaacgttagcctctgctattaggacaaagcatgttggtgagttaaacgttatgaatccaaaacaaaaagattctgttttcttgaacatacacgtcagttttcaaattaagggaaatatgtttgccaaaagtaatggtgaatttgctggactcagatgtctgaaaaacagttcaagatgtttcacaaatcccaaatgtgactaagtttgcacatcttaaggagggatggattaaaaaaaacaaagtttctgtaaacttccttgtaaatgccttcttaaatcggaaaatagggaagataatcttgggaaaatttatttcagtttcctcaaccttgaaagctagtgttgtactgattatatgctattgcattagaagcagcatatatacatcctttttcttgattcttttcctgggttgaactggtggtttgtgctgtattcgaattagattttattttttatagagagtttttatgtttctaaaccaactaactgatgacaaatattctgattctaataagagccccgactctcttgagctccaaactcacatgtcctgaactctggttaccactgtgttctttattttggctaagtatatcacctttcctgtggtcagccaggcttgaaaccgcaccatcacctttgacccctccttctctcctgctcccatgtcctaccggttttgaggtcctgttagattttcctctgtaattactcgctcgtgtgtctcttcaggccaacctactgtactgtgtggtgaaaaccctcacacctcatgcttagatgattaaaatgaccctctgtctaatcaccttgcctttcatctccactcttgtcacgcatgggacttgctcctgccaaattaggcttattacagttctgcttatgccacaaccctgctctaaaagctccagtgactcccagctacttgtagaataaagctcaaagtctttgacttaacatttagatatcttctaaaatctggccccagtctgacagtccaatctgatatgttcagaagtagatatgctactatcccatcgcataacctatgctttagctaaatgcaagggctcttggcctcttgtccatagaaatgttttgctaacaccaatgcatgtttaaattctcaaatgtgaatatgtccccagtctctttctctcctcataaggtcttgtgtcctttggggaactagcttataacactagatttttttatttttaaaattattattattttaagtaatagacttcatgttttagagaggttttaggtttacagaaaaattgagcagaagacacagagagttctcatataccccgtcatacatactttcccctcttattaacatcttacattaatgtggtacatttgttacaactgatgaaccaatattgatgcactgttattaactttccatcattcacatgggggctcactctgttgtacagttgtatgggttttgacaaatgtatgtcacatatccaccactgcagtatgctacagaatactttgaatgctctaaagatccctcatgctccaccagtttatcctgtcccttccttcacagcactcaagttttacattttagttaaacttcttgagagtagcacctggtttttctaccttacccgctccctgctcacattcagtgtgtttgctgagagggcctcagcagatactgaataaacctgcaaattacaacactttgagacaggagggcaggggacatgtgtaacagcattagtgttgtgcagttagaagccagggtttgagccctatccctaccacgtaattgctgtgtgatcatgggctaagtacttaacctgtctgactctggcacagagagtacccaaacatgttagctattgatagtaatagtaatatgactcttatgggtataatttgccaggattaaatttattgatgcatttcatctcactcctttcagcataacatcagttgttagtattctctgaatggttcggctttagtctgattgaggattggctaattgaggattgaggattgaaggattggctaataggagatccttacatgaggttggttatcaggttctagcttaacaggctagagttagggaacaatatcttaaatcactggtcctgaaattggcacaagttgggattttagctattggatttctcctcaaaaagaacaattcctgggataaatgaatatcagataaatcaggaataaatatcactcccatttttcaaatttaagagcaaaaagaagtcacagcatgatgttttgcttggatgggatgtttctgggttgcctttgattacatgtgatcatggggtgtgaacatttcaaatttccagaaacaagctgctcagaaccagaaacaaccaccaaatagtggatgcttaagcggcgaaatggtgatgatgggaggaaaatctccctctggagaggtagttggtggcctcccaccacctcctgctctgacccccaaggtcgaggagggcttgcttttccaggcagctttggggagactgggtgatagtaaaagcaaaaaactccctgttaccttgtttacatagaaacgtttccagatatgtctgctttagtttattatttggtaaaattcacatacagtaagattcactctttgtggtgtgccgttctatgagttttgaaaatccgtaagttcacatagctgccaccaccatcgagacacagaacggttccagcacctccccaaaattttgaccaccacttgtgctttaaactcagctcagtaacgcatatggtgtgagtccccagtaatgatagaaagcataggaacttcagtagctgcttgatgctgtgttcatttcacattaaaaacaaacaaacaaacaaaaaacctgtttcttctgggtcctgttagcaaaacttagtgttagtttctttcttctatttaaatatcttatgtcgaatttgtagtagaacgaaaatctttttgaaaactgttcagaaatctacaacctaaagcatctgctattttgaatctttttttttttttttttttagcatccagtgaatgtacattttaggccaatttaaaattccgttttatgtttaaaactacaagacagccatattaaagggcttttagttattgtttttgttactttaaattaattacatgagaaaattagaatctgaacacttaatgcagctataacctaaagggaaaatagcaaatgctttgctattttttttttgtcttttttttctttttttgaagcatctttcccctttcttctttacttatatagattggactttgtctcaggtagacagaatttttgtattaaagttattcctagtgcaatttaggctgttatttttttttttcttgcttgctcttttttccctttcttcgactctttcctcttcctggtctctttcttcctgtctcttttttttttctttagttgtagaaagttgagttccatcccaattattaaatcttaggagaccattcccacatggttccgtaaatggtagcttcatcccgcattctttcatctctttccctgctctctggcttgacagttgaaaaggtctgactgtgccacacaatggtttgattggtttctctgggggagacttttccctgcctcatcattcgccaggcaggtggaccagaaagtctcttgattcttttgttccctctcaaagtccgaggtctttgactgaataaatctgccgtcatgggataatttgctaaaacgagactgaaagatgtgagagaaaagcctcactacttgggtgctgcattaatgaaataacggggccttggagtttgcaattgaaaaatcaccaggaatgcaatgggtggagacgggcttcttttatttcccataataaacttttagttctatcatttaaagcatgcctgtccctttgctcgcctgcaggcccgagtgtgtttgcatttgtacccatgtttaagggtttctggggacagccctgcccggctgaaagccgtttgggtgctgtgtctagttagtcattagattattactagtgggtggaaagaattccatatgacacaactaaggttgagttaacacaggacgaaaagtaatttacagataggctgtccccagccatctttgtagcccctgataaggtttcatttcagaatggataggcgacatttccacttacgggcccattctgcgacacctgtgataacagcttctggatcctaattgaaattggtttcaaaatggattttcacttttctctgtctgtggaaaatattgaatggactcagagctgccacagagaaccccagaccttggaaaatggagcagaaagctaggatcatctttcataacagtgtcgatgatatgacagttttgttatctgtcttattaatgaaatcattgatcacctgatgagggagataataaactacatttcaccaccagtcacgaaactcaattagactgctattacaaatagggagggggagaaaacaaccatggaataaatgtagaaaaggtcaattaaaacttttcattcccgaagtgaccatttcagaggagaacatgctgagtgactgcagtgcaagtattttgaaattgtagtggtcagcattatattcaaggactttcttcttggccaatgtagagtagctggcagttttattaagtaaaattttatttctcaaatattacttgtttcattatgtaaaattcagaagtagaaggggaagttctgctttgtttaagcgcatcataatggggaaaatgggagaaaaaaatccacagattctttccctccccacatggtgacgggatttggggccagccccaggtaggtatgttgggtaaggaagaacaaactgaaaggctcgtaacctaggttctttgaaagaaaagtagcttatcatcccttcctctcttaaagtgctttaggaatcctaggaagatgagacgggaattaggtttggatttaatgaggtggctctattgtttggtgttgggctgctctggaatgcgctctctgttccccttgaaggaagggaagagatgctgatgacctctcatgtttcacagtgaattgtattcctaggtgtttctccattctctgtgccagcaaggatcaatccatcccatctgagcttgaaagaggagctgtgatcaaaggcgctaatgatgtcactgatctctgctgattgattaggagcagaagttctggagaactcggcctttccttataatttcaaattcattagcgtctattaggattgctagctctcaatccgcaaaattagaaaaatgaatgatacagacaataattgtgtttttcttcatctatgactgttttttaagcttattggaaccatggttacattttataagcaacctttcccttttaaatatattgcaaagaaatggagtcttctttataaattgggttaaatattttggaatttgacatataaattgggaaaaatatgtgggtgtgaagatatttacattgtttccaaagcagtttaatcacatacagattacatgttagataatcctaaaatatatttaagtgttttattaacttggacattcaggagtttcttatgcagattttaaaatcctttgagttatttttgtggaactacctaatattttccccttgtcattcaagaggatgagtcatttctgtgtgcatatttatctttaaaaataaaaacaaatgcatttcatgccaagagatgacagtcttacaattgggaaagacgcaactggaaaggaaaaaataaaaagcaagagggagagagaaagagcgagatgtctctttctggaactgctcacgactgtaaccattggcttacatccacctagagtagggatcaattgcaaaagcattgggaaaaattctgttttggaaggcactgcagctcaagaaagaaaagttgaatggaaaatggagaatgtaaattattattaaggttaccattaccttattggtttgctgttggttttctaggactcttgcttcatgcttgcttatggctaattcctttcacagcaaattcattttgaggactgctctgagcagaactgataaatgtgtttgtggtcaagggtgggtataataaagagaagagatggtgcaaatgaacctttgggaggacatggcgtggcagttatgaatactaggcttagttaatgtcgaagactcccctttcacagaatattttttgttttagtggcaatgataagaaaaataatctgagacccttacctataaccaaaagagaacttccagaaagatttagaacaatggcatggttgaaataatggaacttacatcaatgtaaacattttctggtaaaatatgaagctaatatacaattgaagatttgttccaagcatttaaaaaccagaaaacatacgttggtccatttcacattaagcttaaattcaatctttcctaaaatactaatgtttctaggcttgttttcaaatcctggcaagtttgagagcagtagaaaagttcctttcttataaacgttgacagcagttcctgtgtaggctaacaatgttttataaatagagtttacttagcaaaaaccatgtgtatgcccagtgaaataatctcacatttatttaccttttgatttatagaaaacatgtgccctctgacaaagcctttcggctcttttccgcaattaaaaagaatcatgcttgaaaaaaatagctaccgtcttaatgggaaactttttcacataaattcaaagcactttctttgatcagtttcgtacaaaattagaatatttttatccatctgtttggcccaaaaaactggatgactcagggaaaaataaaagatacttataaatctctcagttgtctgtctacatgtgtattcacacacacacatatcagcatacatactggctgaatattggggaatccaaggattaaacaggctggtgcagtgttacagcagaaaaatttctcttgttgcttgttcttgccagtgactagtgttggcttagcacaaggtagtttgttggtttttctagattgaagaggaaacatggtcctacacgtacctattgctaggccttcatctggatacatgcaaagtatctctgccttgattctcttcaacaacaacagattgtaaggagagagagagataagataatttgcaaatctcttgtcactccccttttcttgaaaaaaaaagatatgatttttaaaaagcatgttttattttcgtttactactttttcaaaaagttcagagttgcgagttaggggtagaagagaaaaaccctttcttaataaagaagtgataatattagctgggaccaggctacaaaatactgctgagtcactattccagactagatccctggtattcacactgctctgggggcagggaggttggtggtggggagaaagtgagtctctatcaaatatagaaactttataatactggggtatactaataatacaagtacaagtcttacaggtaaacgccagcataactttgtaccttattttaacttggggggggggggggggctttcatttttgaatagaagtgagggattatatgtgcttaaaaacaagagtacaatttttatagaaattctctcttgtggtgataatgtcagttttcaagctctaggaaagcctagctcctacctccgtaaacaaataccattgaccacagtgacaacgacttgaagcccaatatgaaatctaagggaaatgaaccatgttcgacagcggggcgtcttcaccagcaatcccaaaacccttgaccttgatggagaggcatctgagaatgggtgaacccctttggaattattttacatggcactttatggacatgggcctatgcccttttttttttttttttttttttttttttcagattcttaaagagatgtatgacccagcatttgccagaggctctcctttacagggagtatttggagctctaactttcacttggaaaatttaggtcaaatgattagaattctctttggaggaatgatgatctgtaagagcaagactgtctcaaaaaaaaaaaaaaagagagagaacctctcagtgattaggaaacgtggagctgagtctttctcatatacaacatgatgtgatcacatagttgtagcctagctaattttgtagttggttgcacattaagaattcaaaagattctgcctgcacatcactttatctgtgaaaacgaaggacttgggtcacatgatttaaagagctctctctcccttgatattcttgatattcaagtctccatgacaggggctccaatttccacaggaattttgcagaatgttaaatgaaaggaaagatgtcccataaataaggggagctggagaagaatgagttaatataatttaagtttagaacaggaaattcagaattccttttaaattaagctgtgtacatcacatgtatgggtccatcttgggttaaaagccactgaagattttgtttaggccaaaatgtactatcacattgttgagtcaaatactattccagagaccaggcatggtggcccatacttgtaatcccagcactttgggaggccaaggaaggaggattgcttgaggccaggagtttgaggccagcctgggcaatatagcaagaccctgtctctacaaaaaaattattaaaaaattagctgggcatggtggctgtagtaccagctacttgggaggctgaggtgggaagatcacttgaaccaggagatcaaggctgcagtgagctatgatcatgccattgcactccagtgtgggcagcagagtgagaccctgtctctaaaataaaaattaaaaaaaaaattgcaagtattttgaagggtactctacagataaaagtttcaggtacaaattcagggagattttgcccaattctggctgaattgctgataattacaattagctgccacaacagcagttgatcctttgaaatctgaaatgtgtgttttcttgatttagacttggtattattcattacccaccaggcttcctatactcatcttcctggaagaagatgtgtgtggcagccagaaggaacattttggactcttgtgtgactaactcctcccagatcatggccctctttcaaacctcttgaacatcctcatagagtgctttgcatagttttctgtttggcatctggttttatgtagttatagttcatcatggcttcacttagagcttttgcaaatttctttgatgctaatttagttgcattaaactttttggagtggaaaaaagaaacaaaaccaagagtacaataaactttgattaccagacccctaaacactgaacctctcaagtaacccatatttgtaatttattctttcagattggcatttacaggcgggagctggggaacgttgttattgaaaagttaggcagcagcgttcagatgcagctgaagcaagggcactaaactttcacagggacacttggagaaggtgctgcatcatctaacgaagattagatggtttattatatagaaattattaaaataattcattttagaaagagttccagtaaaaatggagcctaaaggagccccaggaatgcaggacgcctctgacttcactgaaggccacatagcctgctcactccagcctgagaccttagacccatccatgctattccctgctctcctctgtcttaaatgtgtttttatttttatttttatttatctacttattttttgagatggagtctccctctgtcgcctaggctggagtgcagtggtgcgatctcggctcactgcaacctctgcctcccaggttcaagtgattctcctgcctcagcctcctgagtatctgagactagaggcacgtgccaccacgcctcgctaatttttgtattttttagtagagacggggttttgccacgttggccaggctggtgtcaaactcctgactttgggtgttctacccaccttggcctctcaaagtgctgtgattataggcgtgagccaccgtgctcggctgtgcttttatttttatgaaaggaatacttgctcattgggaaattcagaaaagcataaaagaaaaacacgaagctggcctggaatctcaccacttggaaaataaaagttaacactttggtatattttcagtctttctctctgttcaggtaaccatatgctaggatcattttctgtgtcatgaaccactcttctccaacttggctttaatagctatgaatttactcaatcaatcccctatcattggacatgcacattttttttcaattgtgaataatgatgtgatgaaattccttccaaaaaaactgtgtgctttgactacatcttacccaattagctccaagaaacacagcaacttatatttccatcagctgtttatgtgagtgctcattttcagaaacacgtatcaacattagtgaaatattttaaaagaagataggataggtgaaaaccttacctcgctttttaaactttttaattgaaatacaatacacagattaaaaagtcacatagcataagtgagcagcttgatgaattttctcaaaatgaacacaccatgtaaacagagcccaggtcaagaaagaaacgctctgttgatccacgctactgctgatgggcatttgggtggcatccagggtttggctgtcaggaacattggctgccaggtagctgtcttttggtggatctgaatacacatttctattgggcataaacctaggagtggaattattgtctcctagggtatgcatatattagctttagtagacactgcctaatactcttcccaaggggttgtatagacttgcttctcattcgtgtcaacacttggtattttctgtatttttcactgtagcccttctttgggctatgcagtggtatccagttgtggtttcatttgtctctgatgactgagggactcaagtatctttttaagatatttatcggccgtttggatatcttcttttctgaagtgtctgttgaagtctcttttttaaaaaattttttagttctttgtgggtagataattgtttaccagtttttctatcactgatttgaagtgatacctgcattggttactgccttaatatatattttaggttctttttctgtaaaattttattgtatgatcaacctgtctattcttttgttgtaccatactctttcagatgttatacacagagtacattttatctgataatgcacattatctcttattattcttccttttcaaatggctcttggcttctattcgattttttcttctagctgaacttgaggaacacctttgtagaactatgttacttattgaattcatatgtatgaagtgaaagtataaaaacatgcatggatataatcatttctttaatagtggttaactctggggagagtggaaagggaacaagatggagagggttcagctctatctgtattatcttatttcgttaaagagaagaggttttaagcaaatgtaacaaaatattaacatgtattaaacctgtgtggcggatacctagatgttgcttatgttattctctgaaatacgtcatgattaaaagtatccctttagaatttattattattattattgttattattattattattattttttagatggggtctcgttctgttgcccaggctggggtgcagtagtgctatcttggctcactgcaacctccacctcccagattcaagcaattctcctgtctcagcttactgagtagttgagactacaggcatgcaccaccacgcctggctaatttttgtatttttagtagagatggggtttcaccatattggtcaggctggtctcgaacttctgacctcagatgatccaccagcctcagcctcccaaagtgctgggattacaggcatgagccactgcacctaaccccttcagaatttagtctggtgttatattaagctaacttattgggctttattgtaattatattggctgtgggaagcaatcttagtcgtttttctgtggcattctcacaaggttactctcttcccaggcgtatatcaaagccacacaaatgcacacttgctttggtgtttacattttgcatttatctttagaagtgttttaaaaaaatctgtcacttataagaaaatacgtaggaaataacagttggcaagacctaacaggtgtttgctgtgttttcaccttttatactttaacatgttctggaagcaatttagttttacttttgtctcatctgtcttgaactgaaagttgcaggtacgttgatgagtactctggttaatgtaaacacctcttatattggctcaggaaaagtacgattctccagcttctctacagtgggctgcatgcttattaagtcacaccagctgccctctctgttctttgagagtggcatctgttgtttggtgactttttcttctgaaatctgtcagtgccaaggacaaggattaggagtgggttgaggctgtttgttatttgtttgttgttgctgggagttacttaatagtggtggaaaaggccaaaggaatattggagctcttacccttgaccttaagttaccctaactttagggtaaccttagtcaactaatgacttacaggtgccagacttaagataatgctggttgtcaaatcaaagagagaaggtatgtgtaggatgtggtctcagttccgtacatggtatgttgctaggatgcgtatgtatgaggtggattcttataaaaagtatcacaaacacctttaagaacaccacatagcaggctatacatcccttcaaagataagaagtgtcaccgtctgaggtgtaattccagcagtttcttaagcctcaacttcgtacacttgaaagcacacccacaacctgctgctgaaagcttttggaagtcattgagagacatggctcttgtttattctccaaattttaaatcatgcagcgtttggttggccttttgtctgaggagatacaaatttatcatagccatgtcaataagtacagaaaatttgccagcccacagagaaatttgaacttccttcctttcccgaaggagagtctcggggaagtcgtgcatacaatagaacttttcatgtctagacctggtccaggagaattctgtctcataagaacttttcttttttccttagcatactcaaatggaatcaagctcagaaagaggttggggacagaatttagggaaataaaatatagaaaaccctggaccatctattttctgaactcctttgcagttataagtgtaaggattatttttactgatgtgcttccatagtcaacaaacacttattgaggctgtgctaagtgccaggcactttatttgattgtgaggataacaaaatgtggggcctgctgttaagatatttataattggataagtaaactagcaaaattcagtacacttattaagtgcaatgtaaacaacatctatagagtatgaaggaaagtctcacagaagaggtgaggagttaaatccttcacatgtcaatagtgatggcagggggaagacaggagtgggaactgggggctggagaaaggcattgtaagttgagagagcagtagaagcaaatacttaaagcatgagcattctcggtggtttggggaaatggtaccaatcagggtaggttgcttgttggataggcatggtttggggagaggaggatggaggcagagaatgtgaatggagaggtatatgagtcctattggtggaggcccatgaaggcgatgctagacactttgggctccatccttcatgtgagtgggaagagcagagtggtgggataccatctgctttaaaaactacccttcggccctagtgggaaaaatggtttggagtggggagaatgaatgtgatcaggaggcctgggaagagagtaatatatatatattttgagatggagtctcaccccaggctggagtgcggtggcacgatctcggctcattgcaacctccacttcttgggttcaagcgattctcctgcctcagcatcccaagtagctgggattacaggcttgtaccactacatccagctaacttttgtatctttagtagagacagggtttcaccatgttggccaggctggtctcaaactcctggtctcaaatgatctgcctgtctcggcctcccaaactgctgggattacaggcatgagccaccatgtcaagcctcaaatcaatattttaaagagatatctgcagtgccatgttcattgcagccttattcacaatgggcaagatacagaatcaacccatgtccatgggcaaatggagaaagaaaatgtgttatatacatagtggcatactatgcagccattaaaaagaaggcaatcctgtcatttttgacaacatggatgcaactggaggacattatgtcaagtgaaataagccaggcacagaaagaaaaatgtcatgtgttctcatcatatgtgggaggtaaaattgaagtagagagtagaatggtagtaggtaaccagaggatggggcacttgggggacaggactggggagatgttggtcaaaggatacaaaattacagttaggtaggaggaataagttcaacagagctattgtacggcatggtaactatagttaatgaccctacattgtattcttgaaaaatgctgagagtggatgttaaatgttttcaccacaaggatgataattatgtgaggtaatgcacattctaattaagcagagttaattgttccacaatgtgtgtgtatgtatacttcaaacatcatgtttaaataaatacacacaattttttctgtcaatttaaaataaataagtaaacaaacaaataaataaaacaatttgtaggagggaggaaatcagagccccctcgcacttgttcttcaagactggggtgggaatgttcatgcctcccatggtcagctcctcctttccctagtttttagcatgagattgtgaaggctgatatgaatagaagaattgggtttaggaatggtgaatattttgaactgtctttgtgaggaatgggaaaagatgctgagtgcataagagtgggacttacagtcatgttgggggccccctgaggttggtgtggtggttttatgatgacgtcagtgggacccccgtccattcactgcagcttctaacagagcggagaaaacaggaggctgtcctaagttaaggatggcagcctgggggcctggaggacactggcaaaagacgatgcattcacctggctgctctcagcccatcagcctggtgatgtgcatgcttgtgagggcacttagccatttatttgtgcaagatggcatttacgaacatagcttttgtggacatgaaacccataaccttgccttcgttcttagtgatgctacctgatcattgacataaaatgaatacaatcgatactgactactgctctgatattaatcactagttttagtggaattgctgtcttacatgtttttagaaccaggaagcatgtttagtgagtctgtgtagtatactgatttgccctgtgtgtgtgtgagtgtgtgtgtgtgtgtgtgtgtgtgtgtgtgtgtgtgagagagagagagagagagagagagagacagattctatgaatttcaggtgaggtcagatttttggagagaacacagaccaaagaggggccaatgcctctatctttggaatcccattataattttcatttaccatcagttttaagtattaaatgtttttaaaaaaatgcattcatgagccacatgaagatgatggatcaacaatggactgcatatatgacagttgtcccataagattataataccgtattttttttttttttttttttgagacggagtcttgctctgtctccaggctggagtgcagtggcgtgatcttggctcactgcgacctctgcctcctgggttcaagcgattctcctgcctcagcctcctgagtagctgggactacaggcgcacgccaccatgcccagctaatttttgtatttttagtagagacagggtttcactatgttggccaagatggtcttgatctcctgaccttgtgatctgcccgcctcggcttcccaaagtgctaggattacaggtgtgagccatggcgcccggccaatacggtacttttactgtacttttcctatgtttaactatgtttagatacacaaataccattgtgttacagttgcctacagtactcagtatagtaacatgctatgcaggtttgtatcctgggagcaacaggctatgccatacagcctaggtatgtagtaggctctactatctgggtccatgtaaatgcactccataatgttctcacaacaaaattgcctaacgacacatttcccagaatgtgttcccatccttgcatgacagtacagccccaaagtgacttctggtttctttgcgctagtgtgtctgtctatgtgtatgtgagggctattctatatcatgatttgtggccacctactagctttgggtcttggaataaagtacttaacctgtcccttagctgtggcagtaacagtttctacccgatggactgattctgtcaattgcccagcagttttggacatttattacaggagtccctccttacccaaggtttctatttctgaggttttagttacccatggtcaatcatggtccaaaaataagtaagtgcagtacaagaaaatattttcagaaagagacagagagagagagagatatatcacattcatataacttattacagtatattgttgtaattattctattttattattagttattgttgttaatctcttactgtgcctaatcgatagactaaacggtatcgtaagtatatatttataagaaaaaacttagtgtatacaggattcaggactatctgtggtttcaggcatccactgaaatgtatctgtggaggataaggggggactactgtactgaattttaatattacttaaaactaaattgcacataattttattgtttaagtcctagagtgtgtccactaggcagcattctgttctcctagaaatggttttcatgcatttcagtctgtcctgtgtttttgcacaggctcaggtttaaccaatccacatataaatgcctattttttttttctgaaaagttttgactaaaggagagtcttctgtctcatgatttgcccacagtgcccaagaagtcgtgagggagctaggataagacttgaagcctgaccttccttctcataacaggaattgccagaccagcctgtccaaaatgagaagcatttgttcagacacaagaaaactgtttttgctggctttatttttaaaatgatataatttatcactctttcttgtgtggggcaaaaatctgcctccccatcacttcaacactgcctgacccctccttgcctggtgtccttcaaaggcactttaaaatagtggatacgggaggtagtggagcgttctctggctttctgcatctacatgagttagtgctaattcttcttccgcaagtacttacaaatatttgaaggataaggcctcaaagtctctttccttcattccttttacctttttcctgtctgagttggctttgaatgttcactgtctgttcacctgggcctggacatatggtccctttggaaaggataaagtgggctgcttggcatggtggatacaccatagagcaaactattcctgttaatgggatagattgaattaggaaaccaggtttcacagctgtttgactctccgtgacctccatgacggaaggcgatatcctaggtattctttcctacctgctgccaagtcttatttctgccattctttgctgaaaatgacttgagtagtaattgtttggccttaggtataggtccttttttgagacagagttttgctgttgttgtccaggctggaatgcagtggcatgatctcagttcactgcaacctccgcctcccggattcaagcaattcttctgcctcagcctccctagtagctgggactgcaggtgcccaccaccatgcctggctaatttttgtatttttagtagagacggggtttcaccatgtaggccaggctggtctcgaactcctgaccttatgtgatccgcctgcctcgacctcgcaaagtgctgggattacaggtgtgagccaccacacctggccaggtataggtctttatatttatctttattaaatatcttctccttggcctcagcccatcatcacaggataaatccgataggacatggctcctgccctcaaagagctcaccatgttgtccagctattaggctaaggtgaaaggagaggacacacgtgtgctcacacacatacacgcacatatatacagtcttttgttcaccttctacttttgcatgacaaccattgcatataaaaactcactgtaaaaacgaaagcagttgaggtagagctgtctgccccagctgggactgtaacctgcttggtgagacaggggaactggaaggggagtcctgcttgtgtgcccgtactctggttttctgcctgtgtgtattgaggtaaatcagagttctaacgggcttttaatgtgctttctgtaaacttattagaaatagatatcttgcctgatgcctgttatttaccttgcatactaatgtctgtggatcaacaatggaaaattttcatctgctccaaagcaggctagaggcctgaaaatcattttcagaaattttagaaatgttagtaacccagctttgcggtgagtagctaaaaccacatctaacatttggatccagctttgtgcgttttcaaagccctgctgcttcttgcatgtctaactggcatttttataactctgttcctagtattctcagtgtattcttcttttgtttctcgttgttaactgactgctttatagatgccatttgttatctatcatcataataaattttggggaaaaaatgccttgtcattttagttggcagtgaaattgtcccaagtcttttctttttagttaaaaaaaaaaaaaagaaactttttcttagagtttgagtattttaagttatgtgtttttgacaccattaattatgtctcatctggttgtttttaaagtgccaccatctaacattttttttctgcaagagagttaatctgtgtgtgccgcctgtgtgtttgtgtgtgtgtgtgtatgtgtgtgtgtgcatatgcatctcaaggaggtatcaaagttgcgccctagagggaagtactgatttttaaaaattttagatactacattaatcccttaagggaagttctacagtcttgatacctttaggaaggtcacagccatttgcctagaaggccctgattccaggtcttgccaaaccaccttcagatgaggtagagggtgtttggaaaataaacagaacttgtcctggcctgtgagtacagtcatgcagtcctcccacatccccggagctcagcatccccaggattggctctgcaacggagatctcaggacggctcctcaggcaagcagtggagttgggaaagctcacctcatggtgagtgttttctcgcttgtgctcctggatccttctcactctccagcctcagacacttgactgcctctctgaagctccgaacctgccctggcccagggcttcccgtcacatttcccttcatttttcctttaaggaaccaatcactcaatgcagttattccattttttgcacatttgcgtgtttactttctgtctctgtgcagaatgtaagaaccatgagcctgtcctgtgtccttcacatagtgtctcagtgcttggaacaggggccgccacagtgcaggggctcaataaatatttgtggaatgaatgagtaggtataaaaatgaccttaagccacacctggaagaatttaggataatttttactcccttcagggaataaaatgctccagtctagctttgggttaagatgcgtttgcagagtagatgcttgggccatttatttggggcggccacacctatatgtacccgaatcatgattctctgctccctgcctccagtctgattcaccatctttgactggttccctttaaacacatcaacgtgggcttcctgaaggttatgtagagcgagagccttgcgttaacgtggactgaattttcagggatttgcacagctgctgtgacgcccagaccattgtttcagtctcaatgcatgagcaggcgctgactctcctgtctggggtagctaagcccgacactgcttttaggcctgtgagtagcgaactgtacctcccgctgaccggaacatagcaaagtggtgaatttcaggtgacaaaggcccccatccttctctgtactgagtaagggctccgtgctccagtagcacgacatttcatttggttttcaagttacgtaatgaagaggaattcagagtgtgcttgaacatatggccccaaggccatccagtggtcaactccccctgctctctaagagcaagttgttttaactgtgattgtgttagtcagaggattaaaataagaagaggatgcccaagttaatatccttgcatttctctagaaagggaccatagtgtcagaactctgtaacttctgccggggcatcttggtatccacaaggtgaggcctattggttggtattggtgtattaaataaagcctaaaaatggagtgatttttatgtcattactcttagctgcatagatcttggatagctgttgataggttgtgaagacttgatttttctagggaccctgggaaaagccgattaaacttgatgacgttaagagggacacatatagtagagaaaagcagtcagtaacgggggtcctgcagacagccagactcggatgtgagttcaggtcctgccctaagtatcaggggccaggaaggcctaagtcagggctacattgtaggcctcagtttccttatttgtaaaatccagaggataaaacttcttgaagggttgccatcaggagtaatagaaatgaagcacatgatgtatacacgacattgtcgattccctgtccatgtcctttctgttgagaaatactacttgatggcttctttaccattttgttccataagtaaacatgctgccaaccaatattcagatacatttccttttcttcttttatcctttctgctttccttcccttctttttctttccctcttgattagaaaggtccagcattttttaacatctcaagtgagacatgaaacggctttgaagatgatctcttgtcaagtgtaccaacagagattttagaggaaatttggaatcttcatgtcagaagcagtgttgtcttcaccaggttcataaggtggaactaagataaacttatagtgtgaactttaagtaacaaaggtggtgacctctttaaaaatctatataaatttaatctttaatgctttaaaaggggatgctgaaggatgcttttgtgtaatatattttttggtgttctatttacacgtagatttttaaaagatcttttttgggaggtacatcttctgcaatgcaacgttaatcaggacgcctttgtaggtagagaaaatatttagtctcctgtaaagctggcccctcccatccacattttctgcagctcttatttaacactggtgagaattaatagttgaaattcaaagagctgactgacattctctagcctagataatccaactatgtttccttaccactttctgctaaaagagatttacgatgtacctgcattgagaggtaggtccctttaaaagatatttcccattttgtaggaccatgaaaatgtctttaatcatgagtaaatgaagagagccagcattgtcttctgaagaatcttggggatccaccttatttatttatgtactgttggatattagtgaggataggggaggctgtttttgcttttctccccattaatttttgtgtttaacgttgtttaccttattggacacactccacctgcacaacttggcaacaaagtcatgtatgaaaaatgatcaaaaaaggaattacatttaattgtagcattctagttagagccaagatacatagaaactgacacactgtgtctgctcatttggcccttctatcctgccagaggaagatagcaaaccagatttattgaatacttactcatctgtccatccacccattaattcatgcattcagtaggtatttttcatgtatgtcctatgtgccaatactgtgctaagtactgagggagtgaattaaacaaataatttctgcccttagggaatagatggtctggtggtgaagcttgattattaaataagctatactaataaattgtgatgattgccgcaatagagcaacactgcagggatatgagaggacctagtgggggcactggcaccattgggaacagagctgggcatctggggacatttcctggaagaagaggtatgcaagctgaaacttatgaaagaatcagaaaaagcactgtaaaaacagatgtgaggaggcaggtacaaagggaggttatgttccagacaaacggggttgttgggcagactttccagaggtaaaagggaaccttgtatatcaagcaattgaaatcaccttactgggactggggaatggaagtgggaggtggtatgttttgacgaagctggctaaatagagtctagcttatgaatgcctaagaagccctgtttcattttatccttaaggcagacatgacagtgttcaaggatgggagataggtttgtattggtgttatatgactcaagctacagtgtatgtaataggttagtggggcaacacagaagacaggagaccattaggaggctacttcattaactcaagtgcagactggtgatggcttagacttcattggtggcagtgggggtgagataagttgacgcattagaggccaggcacagtggctcatgcctgtaatcccagcgctttgggaggccgaggtgggcagatcacttgaggtcaggagtttgagaacaccctgaccaacatggtgaaaccctgtctctactaaaaataaaaaaattagccagacctggtggtgggtgcctgtaatcccagttactcgggaggctgaggcaggagaatcgcttgaacctgggagacagaggttgcagtgagccgagatcatgccactgcactccagcctgggtgacaggtgacagagtgaaactccgactccaaaaaaaaaaaaaaaaagagacagagagagaagttgatgcattagagacatgttagtttaaaattgacagggcttagtaggactctggggatggaggaaggagagtcaaagatgctacctggttctctagctagggcttcatgggtagatggaatgccgttcgctaagacagacgggagtagagcagatttagagacaatgatgaccccaaatttgtcaggttaagctggagggcatccaagtggctggatataaagctcagaaacttagaaaagagacttgagttggaactgttgatgttaattgggaaaggatgaagtccaagaagcagagccagaaaagttggatgtaggcctgaaccccttgggacaacaatgccgaaagcagatagagcaaaaagtgctgcctcctgggagcttggctaactgagaatatggtgactcttcctagactatacacattaaagtttggccctgtcctttcttaatgtaaatattgatgagtctgtttcattaattaattatcctctaagcttattgtcctcattttgatgtggtctgtgtacctatgatgaggttgatcaatactgggacaaatagagttggtgtgagctgaaaggtttttctgcaagcagtttgctgtatgaaatggatatgggctgggaataggggcaaggaactgtccttcaggcatttttacaatacaaaaatcgatactatcatcatgggcaaaaaagtaaaagcgaaagtccacaggaaatgtacatactgacttacattatttgctatttttgtccttctggagagggagggagtacgttttcaggggacggaggaggggagctttagcggtatctgttttattttctttaaagttatctgaggcaaatatgggaacatgctaacattccttaaatctgagttgtaggtaacgtggataactagcatgtcctttttagtacttttctgtatgttggaatatttcgtaatcaagagttattttttaaagaaataaaaataagatgggatggggtctgtgctgactgcctgtttgatttatatccaggaaaccatgagaaaaccacaggtaatattgagttaaaaaggagctgcattcagaaaccaggccttgggtggatgtgggtgttcagatagttcttcatcaaagtcataaaacacaaaaacctctgctccttgctgggcatgggagaaaacgtcccacctgagaacaaattaattttatgtggagacttttaattttctctcaccttttgctaccaatagaattcctgagtaatttgagtcaggatttttttttttcttggaactctagatcaaaggtgtgtccttccgagctcaggcagagtgtgttcctggaggccaggctttcacaggcaggaggaaagggagagcagctctctgggtggaggagatagaagcttcctcgagggatttttttaaaccccttttgaatgggctcattgtttataagaacagctccttaatggaaaaacaaaaaggcaagagggtctgtaatgtgctctcggctttcctttgctcagcttcattgtttatttgatttatcaagtctcaagtagttgtgcctctctgtgaccttccttgagctgtttctctagagtatccatttactttatttagaaacataatatttaaaaactctggagctgagtcaaaaaatcgtcacctttttgatgtggtcgtttccccccttttttgaaaccctaaacttgctggggccatcaaagccctggattgcagtctcttaatcatcaagtctttctgggtgctgggcccctggggcctgtggtctgtgcaaggctggagacaggctggcctcaggtcctgctggttctcgttgcctgtttgcacgtaattagaggacaagatgctagataatttggtgctaagtggtagagaagggactgccaaaggcacgaattcaaggtggtgctctaagggggtggccctgaagtggaccccaaggtatgcttaagcagagattaggaggccttcccctcctgttttaacacagctgcagaatgattcctgaaccttgattttccagattaaacattttcaacagaagaaagaatgttgtaaaattagagtttgtttttcacatttatcatcctctttccagcgcccccatctctctttggttcttttttgttttgttagactttttatgataaggacttgttaaagaaagtttgaaggccaaagagtagatgtcaaatataatttcatcactttaatacatgagctgttttaaattttagcatcttttcttttgtctttatctataccttgtctcaggttttgttggttcttacgtattttatttttcttaaaactaaggagccaccaaaggtgtaggcagaactctgttaggaagctgatggtcaggaagagatgctgcatggacccaagtgtggagattccagtgactagcatcttagaggacatttttgtatctatgattgcaatttcttggctggctactcacatttttactagatgaactttagagtcacctcattaaactccgcctcactccaagcaaaacacagcatcaacaaaaataaatgctatctctatagattgcgattggaattgtgttaaatctattatttttcaaggggattgacatttttataaggtacaattttcctattgtgaaatatgacatgtctctgttcaaataggattttttttttctgtgattgtagaagtttaaattttttcatgtttttgcatgggtcgcatgtctttcttggctattgtttggtttattcttggcagtttagcttgtatgaccttttggcttaattgggagcagtatggtaaaatggattctcatgaggactctgcattcacactgccagaacctactactggttctgttgtggctaccagtgagacttcgggcaggatatttaattcttccaagtcttggttttctcacctttaaaaggtggacagtaatggtatctacttcatagggttattgtgaaaagtaagtgagttaatatgttaagggcttaacactgtttctggcagttagtatgtgttcaaaaaatattatatatatatatatatattttttgaaacggagtttcgctcttgttgcccaggctggagtgcagtggtgtgatctcggcaccgcaacgtctgcctcccgagttcaagcgattctcctgcctcagcgtcccgagtagctgggattacaggcatgcaccaacatgcccagctaattttgtatttttagtagagatggggcttctccatgttggtcaggctggccttgaactcccaacctcaggttatctgcccgcctcccaaaggatgaatcaatgaattcaatggatcaatggattcattgaatgaatccttgcctgggattataggcgagagccaccacggccggctattattatctatttttattgactggtaattgctggtgaacagaaaagctatggatttctgcatgtttattttcaactttatggctatactaaatgttttatttgtcttatcgtttttctgttacatcttctgtgctttccagattagtctataatactatctgccaataataatatttttattttcctttcagttgctgtatagtgtatttctgttttatgtaacattgaactggcttcaacttcctggataatagtgattaataatgaccataactatcttggctgttactttaatattattttttttatcaggttaaggaaatgtctttctagtttgggtttcattcttttttttaaaaaaagtattaaattttatcaattactttttatcatctcttgcttttatgatatataatttttctcctttgacctattgatgatctttgtatgttttttcataatatttctaatcatgttttctggtataaggtctatttgattctagactttggtataacttgatatgctagtattgtatttagtatcttagtatttttgctgtgtgtccatacatagttttgacttttagtttttcttttttgtcctcacaatactagatttggtattgagattgcatttgttttcaaaatgtattgcaattttttccatatgtcttaatctagaaaagttttcacaacatgaaaccatctgccccttgagtgtttgaataaactcacacacaacgctaccagggtctgagtctggagcctttattggaaataattttgaagagctatttcagtttcttccattgttattgagtctttcatatgttcttaagtcaattctggtcacttatatttaatcaggattttaaaatttaattgcatagaattttgaaatacacttttttaaaaagcaaacaactctttcctgtctatgtttacaccccattttcagtttgtgcttgtattgtctgtctttctaatcttgggtggatttgcccgtggtgttttagtttgttgtgttccccatcctctaaacagcctgcttcgggatatatttataaattctaatggttttcattttttccagatcataacttatttttgccattgttgttattttcacttcttacctttttcaacttgtaaaaatgattccatatactgtttttttttttttgacagtaagatgatattcatgccgctgactttgttactgcataaaatgactgttggtaatattatttgcaaatgttaatacctttaaacattttccctatgtaattgcaaaatatagttctctgtgtgtgtgtgtgtgtgtgtgtgtgtgtgtgtgtgtgtgtgtgtgttgagcccatgcacacatatatgtgttgcttgggcatgaatgttcattataggatatatccgaatctatcttggtataatattagatgatgatagattttgaaaatacttcaagagtaattgattcagacttgcttcttataatccaagaaaggaaatgattcatcctgttgttaataatcagcagagaggaagagagactcctgctatccttgctaatttactccagcactctgtcaagttttggtaagaacattctcacttctgtgtcatcaggtcttacttgctgtgttttgagcctgtttcctcccctttattcttcaaagccatcagagtacaaagtgggtgttcttagtaatcttttacatgcttgaagatacatgttagagtatctgaaccttccatattttatttcttccactgatagttttattttgattttggctgattacagcttttcctgattagcttttaaaaatggagaacaaaagactccttgcttttataagggtatgattagtactcaatacaggaaggagttctgaaatgctaactattgatgaagtcattcaccttagtggtttaatatctgtttctatcttgtttttaaatagggtgactttctacaaccatctccctgttgtgtgaatgtgtttaggatttttgtacgttgcatgttctctcttgattgatgattgttctaagtttgttcttttctaaacatcccattgattggctggattatagtttattttattagtcctttattgttgcttatttaaggcattctttttaaaaaatagactattttttagagtggtactgggtccatagcaaaattgtgtggaagatacagacatttcttatatgccttcctgcccccacacagccacaacctcccccactgtcaacatcctccaccagagaggtacattggttacaactggtgaaccaacatggacatcgcattatcacccaaagtccatagattactttaggggacactcttggtgttgtccattcattctgtgggtttggacaaatggatagtgatgtgtatctgccattatagtattatacagagtagttttattgccttcaaaatcccctgtgctctaccagttcttccctttcttcactcatccattcctaccacccctagcaaacagtgatctccacagttttgcgttttccagagtgccatatatttggaatcatatagtacatagactttttatactgccttctttcacttagtgatataagtttcctccatgtcttttcatgacttgatagctcatttcatttcagcactgagtaatattccagtgtctggatgtatttatttattaccgactgaaggacatcttggttgtttccaagttttggcaattatgaataaagctgctataatctctgtggtgtgttcatgttttacttttctttttactgatataaaagcaggtggtggttatccttgtagctgattttttgttcctatctctgattatttttataaattccttaaagtagaattgctggatcaagaaatagttacatgttaagggtttaatacatattcagaagagctaactcaacttaccctttaccagcggtgtgtgtatttatattattagtcgtcttcaatacaatagatgccaggatagagacctttccacctagttagtttacctaggctgctataacaaattaccacaaactgggtggttttactctctccagttctggaagccagaattctgcaaccaaggtgtttgcaggcccatactccctctgacggctctagaaaagcattcttccttgcctcttccatctcctgggagccactggccatccttgctattgcttggcttgtagatgcatcactccagtctttgcctttatctttacatgatgttctcccctctatgtgtattttagtgtctgctggcctattttttttttttttttgagatggagtctcactctgtcgcccaggctggagtgcagtggcgcgatctcggctcattgcaacctctgcctcccgggttcgagcgattctcctgcctcagcttcctgagtagatgggattacaggtgcctgtcaccacgcccagctaatttttgtgtttttagtagagacggggtttcaccatgttagtcaggatggtctggatctcctgaccttgtgatccaccggtctcggcctcccaaagtgctgggattacaggtgtgagccactgtgcccggctctgctggccttctcgtaaggacaccactaattggatttagggttcaccttaatccagtataacctcatcttacaaattacatctgcaaagatgctgtttccatataaggtcgcattctgaggtccttggtggatatgaattttggggaggacactattcaatctagcatgattgcctgatttttattttcttttgttactcagctttaaaaaataatgaaaatcttattagaaaattaataataccaagcagcagccacaggaatgatgataaatgaactttcaccctttcctcttatgttgccatcatcttcagtgataaacttgataaacttattcttgatttcttcttccttgttaatacaaatattaaacaataatatcctagatatcaaacttcactgtaacattttcaaaagaaaatgtatttggggtttacttagatatggggtgaatagcgttttaaaataattttattgctaatactcttcttcatgttttttttttttttttgagacagggtctcactctgtcactcagacttgagtgtagtggcatgatcggggcttactgtagcctcaacctcccaggctcaagtgatccttccacctcaacctcccaagtagctgggaccacaggcctgtgccaacgcacccagctaattaactttttttttttttgagacaggttctcactatatagctcagtttggtttcaatctcctgagctcaagcaatcctcctgcctcagtcttccaatgtgctgggattataggcatagccacagcacccagccatcatgatcatttttaatgctattttgtcaggtttattctagatggctccaaaacatttaaaagctcactttagccattattttatttaatcccaaaatgtagatatcatgaaaatgagatgtggtggtttataaaagttgatctggtgtagaaccagaagtctgtttgaactaactgaaaattcaggcatttagatctaggatatattattttcaaagatgatgtttgtctaggtttatttaggcaactggatttgttgtaaatgttgtgggccttccagtgactaaggcctgaaagaccctgaattttgcgttccatagtgcagttgcactgatggtcaggggtgttgtccccaggcagggcagttgtcattccgctgctgttgcctctgggtgctcatgtgatttttcaggtgtctcatctgtgccttcttgtgagcacatgatcttgttttgagactctcaaaaggcctttcaaatactttttttcttgcaaaatcaagaacgtcattattctttctgtgagtctctcatgggtacctgctatacgccaggcacggtgctggccactaggggtgctaaccaaggcggagagggtggattttaaggaattccaactagggtgaaacgcagtacctaaacattcagttataataccatgccaagaatattatggttgagagactttgaaagtgctctggggagctggaaggaggaatatgaaattatttgattggaggagggttgtcagggaaagttgttgagaggagctgagattttactgtttttcgttttagacaccagcttctgcagcataagcccatggtaagttcgctatttggttctcatatgctgagccacgttttaaggctgtgttttatacctgggattgctgacgatatggtctggcttatgtgatcatttgcataatgcatggtgacagtgaggctaagttcttagctgctggtccaaataggcccagtgtgtgccaagagttgctgaaatggctgccctggcccaaagagggagcctagcacatgccccatgactccagggacaggctgaggctctaagctctgagaggctggtgtttgtataaatggtcaacccaggaaagtgagtacacactactgctgccagggtgtgtgtgcgtgtgtttcttagatcacaatctttcatccttgatactaatagcaccagttgcaggctggagagactcactggttgttcaagaagacaatgcacatatactctgtagcagcacatctgtggtgcataggagtgcacaagggaagctgtagcacatctgggcagctccaaaatgtcacgaataaagcatctggatatttgtacttcctgagagctgcaagacagaagctagagctcatctgtagtatctgagaattgcccaagaaatggctctgagcatcctgccataattataggaaaaatgtggcttgaagagcgtgtggatcatactactacttgaaagcatctcagcatgttttgtgaatcccctctgaatggatgcaggaaaaagatgcgggagagcatgagtgggtgatagggaataagaaagcagcctggagaaggaagcggtcttttaggtggtccctggacctcttcccatgagttgggagaaaacacatggctaaattacagtggatttgaatatgtgtggattctgatggactcaggaaacatgccctgaaacccccacagtagggtgaattaagagccctgggtgccagctttgtaaaagcagtcagtccaggtagaggaggggacccagtagcacaggacaggaagacaccaaactgtgtagatctcctcagcctgcctgcctgcatgcccaggtgggatgggagccagtgttcaccttaacaggcatcatgtgtgttgcaggttgcatttcccaggaggcagactctgagatagagttttgtgtgcaggatgtttattagggaatgccctcaagacaggcatctggggaagagaggggaggagcaggaaggagtacagggagatgtcaggatgcaacgaaggtgccatgccagcctcagctgaccccacaggggtccagtggggagtaagagttgtcccaagtcgtactgagacggctgggccttcacaccttcacacaaattagttattgatctaataattcctgggggtgagggctgccccaggaatgagtgtccctctgctcaaagcagctctctgtggcacaggcaatccttgcatgggctgagcgctaaagggtgtctgtgtctctgggttgggcatcatgatgtcaccataacatatattacatggcttcattcattcattcattaaaacaattcacatttattgtgcttttcctaaaatcagtcactgttctaggccctgaagggagtgttgaaggaaacagatatggtgttccttcactgtaggaagagcaggcccgccttctagtcaggagacagtcggtaaacaaggcagtgaacatgaaggtaccaggtggaatgggtgctctgatgatcataaatgggctgatgagatagctggtgattgagggaccctgagacacctgaaggtgcagccacagggagatctgcggcaggggccttgcaggtcagggaacggcagcgcagagccctggggcagacctaggcatggtgtgtttcacaacagaaacagagactggccagagcagagacgaggggaaggagatgaggctgaggcaggaattttagttttattctaagcatgacgggaggtagagcagaggggagcgttctagagagggcacctcctagagagtgcttagcatgtgctcatcccattctgagtgttttgcatgagtgacgcatctaatcctcggtaatcctatcaagtggctactgtcattatccctccccattttacagaagagggaactgaggcagagacatgcctaaggcccatggccagtgtcggagctggggacccaacctgaggaggccaggcttacatttctggctcccgatttccatgctgtggtcattgttttgaaaaggtggcctggtcaacatgtggggcaggaggagagctaggaggtcatttaggaggctactgcagcttggctgagtccgggtgagagggggtgacggtccagctctgaagagggagggaagtggatggactcagcctatgttgtggagagaggaatccaagatgactcatcgttttttgacttgagcaaatataaaacataaatatagatataatataggacatcttacttgttctttatttgacggcggtgtagggattgggaagtcttcaggctgtcacaggtccttcagtgacctggaaagaaaactaaactcacttcctgtaaggggcatggatttctgactaggaaccccttcctatctgctgtccccagaaattgtccacttttcaaagcttgattgtcctgggcccttgctatggccctggctggggtaagataaggtaatgacgaggtgcctcaggccccttcctgatttgccccccacccaaataacagcctggcacatgaaagttcatcagcatttagcctgttgccacctgtccttgtgctgtttgcttgcacctggtgaaaagcaaatatggaggttggcatcaccaatatgatagtgtttataccctgaaaggatgagaacgtcaatattaacagtgatttttttttaattttttgagacagagtctcattctgtcacccaggctggagtgccatggcgcaatctcggctcactgcaacctctgcctcctgggttcaagcgattctcatgcctcagcctcctgagtagctgggactacaggtgtgcgccaccatgccaggcttatttttttgttatttttagtagagacggggtttcaccacgttgaccagactggtcttgaactcctggcctcaagtgatctgcccacctaggcctcccagagtactgggattacagatgtgaaccaccatgcccagctaatttttttgtgtatttttagtagagacagggtttcgccatgttggccaggccattcttgaactcctggcctcaaacgatctgcgcactttgcccacttcggcctctcaaagtgctgggattacaggcatgagccatcacgcctggccaaaagcaatttgtttgggactcttgtttgccaaaaaaattcctctgtgtgtgtgtgtgtgtgtgtgtgtgtgtatttatatgtgtgtatatatatatacacacatgtgtatatatatatatatatatatatatatatatatatatacacacacatatacatatgcatataaaaatgtgtttttttaatactatgtgaggccttgtcttccattgaatattggaaagttggtaataagcttagctggtcagaagtgaaatgtgaggtcctttggcgaaaaagtttaaggagaaacttcggctctttgggtaaagagcatgcgtttacagggattattattattatttttttaattttaaagcaaggatataaagcagggtctttggtactatttggagaatttagacagaaaagaagaaaggaaaagtagtacctgtttacattttcatttccattttttcccctaaagctgtcctgcgcaacatggtagccactcaccgtatttgactacttatatttaaatttatgtaaattaaaatggaataaaattaaatattcagccctagtcatactggccgtatttgaagtgctcaccggccacgggtctactggctgccttgccaaacggagcacctgtggaacacgccatcaacacagaaagtgctattggacagtgctgctcatagccttagaatccaagagattcctggactcttggaggcccgttgtaaatcgtagggccccaggaacctaggagagaaagagttcttacagacaaacttacagatgaccctaaacatgaaacaacaacagtaacaaagctagctcatctacaaggaccactctgaagtcctgtaatctgaagatggaagtctcattttactggcccaggcaactagttcctggaaagttcggtacatggatgatttttctagctagttagtgcttgatgttatttaccaagatgtatgagaccttgttccttcgtgtgagtattttaacctaggccattatctttttgcaaaatgggtatagtcatcttaggggaatgtagtgtggggcaatggaatgtttttattacacctcgaaatcacagttgaatggtatttatagagttatactaaaaactatatgaactggctttggaagtttttgtttttgtttttgttgtttttttgtttgttgttgagatggggtctcgctttggcacccaggctagaatgcaaagttgtgatcatggttcatttcagtcttgacctcctgggctcaggcagtcctcccacctaagcctcccatgtagccgggaccacaggcatgcgccaccacactggctaatttttttttggatttttttatagagacagggtttcatcatgttgcccaagctggtcttgaactcctgggctcaagatatccacccacctcatcctcccaaagtgctaggattacaggggtgagccaccgcgcctagcctggaaattctgcataggctgaaatttaagtcatgttacccattgctgtctgtgatgtatctggaccttccatttgttaggcagtaatatttttagtgtaggtgagaagttctgatattctaatataatccctagaaagtctgttttctagattataggagttggcaaaccatagttggagggccaaacccagcctgtttgtgtaagtaaagttttattggaacacagccactccatttgtttatgattgtgtgtggttgccttagccctactattgcagagttgcagaattacaacagactggcctgcaaaactgaaaatatttacactgtagcctttgacaaaaaaagctttgccagcccccagtccagatactgggtgaacgattggaacgcctttccagtaaggaaacatctgtgcaggtccaggtttgccagaggattttagagtagatgtgagatttccttattcttgggctatataatttagtagacaatagaaagggtaattacacattatacctttttggatgtcaaagacttttttggatgtcatttctcagcgataaccttactttctactttcactaaggaaatcttggagtttcactccaacaggagataattttcaccgacttctcatctgccagggtctgtgcccactgcctcccacagatgagctgttcgaactgtttggctgctgtctaaaggcaatgctgagcgcatcctgggtcctaccctccagccttttccaggccatcactccacctctctcccgcctgtgtcacctgatttgtctttctgctggattgctccatcaggatacacatgtccatcctctgaaaagaaacagacactcagtgaccatgttcatctcaccagctgccaccttcccctggctcctctgtgtgtaagctctctttcacagggccattggagctcgctgttttcaccctcagccattctcttttgaacccactctagtttttgccccagtcacttgttccacaaaagctgccttgtccaggccactgttggtcctctggttgcttagaccagtggtcagttttcagtcttcattatgcttgacatgatgacaggggtcttccccctgctccacctggcacagtctctgcatgatagctgggccttctctgttgtcctccgcccccaccactgcctgtcctctgcaggccactcctcgttcttatctcctgcacatgggagagcacagagttcagacctgggccctcttctccctctgtacttattccttgggagctcgcagccagttttatgaattgaaataccactgatttgcttataacgtccaaattcattcttccagccctgctctctcccatccaaacttcacacttgtgtatcagctgcccatcagacacttctgtttggatatctgcaagacatcttaaacatgacattggcgaaatgagctactctccacccacttcaggctgctacaccttttctagcccaggtgatggcaaggccatgctttcagttcttcaggctcccaacggtggaacattggaaccatattccccactccctcacctctccgtctctctctcactctctcacacatacacacacccatacccccttgccacacacacatcccaagtctagcttgctaggaaattctgtggacttttctcttcataaagcaccagaatctgccccctgctcactgccttcctaggagccaccatcagctctttcctggattgcaccaacagccctcagtttcctcaccaccatccttgctttactagagtctgttgtcaacacagtgagcctttacaaatataagttggattatgtcactctcctgcttaaaactcacccaagggtcccatttcccttggagtcaatgtccatacagtggccttgggcagcacactctgtccctcccgttacctgcccacccacgccttccctctgctccagctgtattagtctgttttcacgctgccaatacagacatacccacgactggacaatttacaaaagaaagaagtttattggactttcggttccacatggctggggttgcctcacaatcatggtggaaggtgaaaggcacatctcacatggcagcagacaagaggagagtttgtgcagggaaactcccctcttaaaaatcatcagatctcgtgagacttaatatcacgagaatggcatgggaaagacctgcccccatgattcaattccctctcaccaggtccctcccacaacacatgggaattcaagatgagatttaggtggagacacagccaaaccatatcaccagccatactgcccactgccttttcttaaacacaccaggaacatttttgccttgttgccctggctctttcttcttcctcttcccctgtgtctgttctcctgactcgctcatgtctgtcaagtctgtgctcaaatgtccattttttgtgtgatccacccagatcaccttgctctgtctgcctgcctgcctcctgcctacccccggttgcctggtcccactgaacaccactctacttttattttcccatagccgcttggtaacctctaacaaacactatcctttcctcctggtaaactctaatcttccagtgatggggatgtgtctattttgttgattgctagagtccaagtgtctagaccagggtctagctactagtccccagtacacagtaggagctcagtacatgtttgctgaatgagtgaaggggcctgattcagtctagtgcagcccttctttgtagcagtgaaggaatagctctcctttcttcttgaaggggggtgatgagttccttggagataagaggcaaggccgtttagctttaatttgtttttctgtaggtggtgggagtgggctatcttttcaaagacacatattccagaatggtcagtaccatggtatctgccgtcctggtcattgcccgaggagcttttacaatgactatggaattaagcgcctgcatctgggtggcctgcagtttgccttactgatatgatggtaagctggggtctcagcagaagctgcagggatgatacacaactttgttggcactttaggtgatgcacattttgtcctgactgtcttccctggagctttctgttctaagcagagcagttgagtgtgtggacatttgttgtgtgctgcttttggccgacatctcagctgggacacagctgggcccttgggcccagaggcagcacattcactgtacccctcagattctcagctgaatagcacctgaagttcttgttagcactgattttttccatgtcaagtttggctagtgactgagatccatgaaggcgaagccattttatcatccttggtgcaccaggatccagctggtccccacacttagcggggttgcgtgaatgttcatggagtcgtgagtgatactgcccctagcaaagcctctccagacatcatatgttagacatcccagcagcatgtgagcctctgctattgtcttactggacgagcccgtcgaggagacagggtgcactcttgcagaggagcacactgttgtttgcatcagcttcgctctattaaaccttccccttgcttatctctgctggcccatctatgttttttcacattaatttactcttccgtttgtcttcagtccccataacctttgaataagctgcttactgatgatcttccttccatcatatttaggattttgaatatctacatgtttttaagccatagaaatgtagaactggagctcagtgggcaaaggcttaagttctggatcagactgatggggctcacaaaccaacgctgccatatgccaagtgtgttctcttcctttttgcacttcattttcctcacctttaaacaggtgataattgtggactctgcttcattttccgcccttatatgaccttttcagtttcagttcccttagcttctaaaaggccaaggtcatgaaatctttctctttatttgaagttacagtcctctttatgtttttgatcattgaatatgtgacctcctgctgcctccgtctctcctccccactctgcatcaggggatatttctcaatatttgatgtgagggtccctgaggcctttgctgacactcctctccacctctggccactctctttctatcactctcacccacccctactagaatatgggctgcaactaggacatgtaagctctcaagggaaggacggagtgtccctatcactggagcgtcagcacctagatcagcccctcctgtaacaaagtgggtgttcagtaaataggtgaattagacagggatggataaatcaatgaacagagtcccttcttagctccgtgagaaggccacttcccattccagtctggctcctcagtttagtgtatgccttctattgaacagcttggccccctgcctggaaatttgggggctagatttaaaaagtgcctgaggggagagggaagcgatcctgtgctcttccttgggttccagcattgcctggtttcccaggaccctcaggcagggctgcactgaggagggctgggctgtggaccctggggatcaatatcccaccttcactgacctccaaaggagagcagcaaaactaggtgaagattcagggaatagtttctttgagggaatgctcactgagttaagttgtggaccttgtatttttctcaatagcctagggctaaagaagcagattgtcttagacccataaaagatgaggaagcagattgttctggcagagttcagactggggttggcaatcccgctatttgtgcaagccatgggcttgtgcctctctgggcatctgtttgcatgaattcatgtcttgttcttctgactgcagaaggaacaggcaggcccctggagagaaagagagagaggaacctgggtggcgttagagaagaaggtttagaaacctgagctgatagatctgttttcatgaaggacttcatgtgacctatgggccttcacaggatttgtcaggacttgtggggaaagtcctgtacagaactgtggagggggcattctctgtacctctgcttggaatccagctgccttctggcatcttggtggatctttgaggatatctttgggtcagcaccagcatatggggactaaagtaatggggtatgagtaaatgttaatcaaattgaaatagggcttcatgacaagctggccaggacatcagtccctgtttcggtcaccatgcctgacttgtgtgacaatcctcctttatcattctgtctgtgacttggagctcagttgacaagttcagacttggtgccagtaggagggtggttttgggccctgtactgttcagagttatgtgcgtgggctgtgggatccaacagacccaggcttaatttctggctttgctgtgtggccttagggaagtttcttaccttctataagctttggttttatttatttatatttattttataaaatggaaacaataagctcatggtgaggatttaaggaaatcaaagagataaagggttttgtacagtctgatattcggtagttgttactgttagtgttattatacatcatggtatgcaagttggaatccagttactcccatatagagttaatggtttttaatgtttatgctttttatataagtttgtttaaaactcactttcagccgcaaaagttttgtaagagagactactgtcatttcttttttttttttggagacagagtctcactctgtcacccaggctggagtgcagtggcacaatctcagctcactgcaacctttgcctcccaggttccagtgattctcgtgcctcagccacccagatagctaggattacaggtgtgtgccaccacgcctggctaatttttgtatttttagtcgagacagggttttgccatattggccaggctggtctcgaactcctgacctcaagtgatcagcccaccttggcctcccaaagtgctgggattacaggcatgagccactgtacccagcccctatttctccaaatgaagagactgagccccaaaagggtgaagtctgtttcctcagcttatacaactggaccgagggatggaaggcaagcatttcggggggactggcccagtgtactttattcatgctagcatcaatggtgaatcccaacacttaaaagcatttatcactttgttgatcacagacacacagacacaccaagtaccacataggtggtgtgtttttgatcagctagtctcagggtctctctgggaatttaatggactcaaacagttgcacaaggtgcgactgtaaggtaacagacggcatttacagaaatcaggcaggaaagacaatcccaccgcttcatagacatacttcatgtcagcatgggggcagaggttctactgagagctgacatctatagaacacttcccctgcgcatcctcacttaatcctcccggcaagcccactgctgtttccacgttttacagatgaggaaatggcgctcggggagttcagtgacttgcccgagctggagctgagtgtagtgacagagccaggccttgaaccctggcagccagactcctcgcccgtgccgtcaccctctgtgcggccctggggggcggttgatgaacacagttcatcaaaaacgaactgtgatccgacagatgaaagccgaggtctgtgaacatgtgaatgttcttttgtgaaccgaaatgtgcttcagttgttttctctgtgtgtcagggaagagcgaccatgaactcccagctcgttgggcaaagggctgatttatgaggatttgctcaactctaaccagctggttaacaacacggagcttttaacgtttccaggggaggaaatgaataaacaggcatttgggatgaagtccactgagtccgcgggactggctgaaaggtgaattcagttggaagaagttttgacatacaatgcagacatctcttgacccagttttgaatcagagttctcagtaaacaaagtcaggaaattagaatttctgggtcaattccacatttcataagcaacgtcaaaagaaatatttattttgtgggaaggttacctggtttaggtggaataagtcagacggaaaagcaaaattagttacccagatgatgggtgttctttattgattttaaattcagtaaaattgccatcagaaattctcaattataacatttatgttttatctagtattttaactataaatggcttgtacatatttgagagtcttttatcctatggaatacttgaaaccatgctgcatttaatttaattttttttagaaaatcaaatatcaccagctatctgctttccatttgccttttggccttttggaaaaatacaaaattaggatattttggtagaattaacatagcaggccaaaatttctgtaatcctttagtgatttctcagaaataaaagccatgtggcagtggtcaagcttgtgcccagcataaaatgactaaaagtgtaaactggtaaggggctgatatagaccagctctgcttctgttcttgagttctcttagcgtgtactttgcttcctcatctcccctgggtaactcccctgttgcagggaacatggacccttcctgagagccagtggctgtgctagagttgatcatgttcccaaagagttctctgagcttccttctgctttgggggaatgagaggttctgaaagtcttttgtgctcgtgaaaggagcctggtttagaaggctctcatcagactctggcaggatcattcaggttacacataaaaaaagggaaagaggacaggaaaatacaggaaaaaaatgactggagaatattataatatttatttgcttctaaatcagaataaatgggcagctttccacaaaagccaaaatagacagtaccctcgttacctggatctgtgcaggacattcatccattcatgctgctagttttattgcaaagactgaacaagtcatattaatgcaattttaaaaaaatagggccagactgggctttagaaataagtaacttaaagttgcttgggacatgaggggacatgaagagagagaaaagatttctgtctctgtgttaggcatttcaactgattcttttagaatattttttgcccgccgtgtctgtcaacgatggcttggctaatgcagcctagtgctcgtggaggttgcatctctccaagtcagccaggcatcaagtatttcaccagcacttatggtacatctacctgtgggagaatgcaacataaaaatatacccgtcgttgtgacaatttgacttgcagggaagagtaaggtctacagtgtgctcagtgggctaccctgcagagggcaggcactaccgggtaagggcactggacttcttgttcacttgtccgtggtcctttctctctccttctgactgctgcttcccagggatggggtttgggctacttcatcccaagtctgttttcataattgtaaaatgtggaataatcttcataatttgcaaggttgctgtgagagtgatattaggtagaaggtgaatggctctttgagagtcataaatggcttgtgctttgttaaatagaaggtgataatagccaagtaatgaaatgtgttaactttactcacggaaaactctcagctccactgctgaaaactcatccccttctcccaggcaaccatttggaggcccaggccagaggctggaccaggaggattggatgcatccgcgctgtccatccctgctgctgcacaaacgactcagccacagatcctcttggatgggctaccttgaaagggggaagctccaaagaatgcgtacaaacccatacatttacctaggtgcgggatgattgcaagaccactttattcatttaattcatttacactttttagtgtaaaaaagtttatcctttttcatcttactatctaattctgctttttgatagaaatgccagccatgcaaattctcctctaccacagaggcagtgagttaagacatgcggatccctcttttctgtttgaaacccatggctgagatctcatgggtgagagcagaatgtgcatgaatcctgcaggcacccccaccctctgccctttggagcagttaatattgttttatgttcccaagtgaaaacttcaagatttttttttaaaacttctcttatgaagagaactacgaaggagataacgggcctacgtacagaagaagcaaattaaaaagaatttccaactcccatgtcactatgtttaagcaatgtgaatacatccaggagtagagaaaagactagaaggaaatatacttttctgttcaaaacccatagctgagatctcatgcatgagagcagaatgtgcacgagtcctatagacacccccacccccgtcctttggagccgtaaacattgttttattctcagaggcaatgtgaaggtacattctgttcaattttgttgggaaactctgcccccaaataccattaaaatttctaagaaaaatagataaaaacagatcatggcacagtcttgggtcttttctttattgtcacctgtattttcaacctccactatggattataaatgccagagggctgtctgcagtgacagaaggaattctctaaggactcagtgacttagctttgacctacatttggaagaaagctttaagaactgtataaacttgagcaagttgagaagctgcaagtcccagggccttcgattaccagacgtctaccttttttctccccgcattttctgtgtcctgtagcatttgattatggtttctaataacaaaagcaataatcattgtggaaagtctgaaaaatattgaagaacatagcaaaataaaacaaatattagccttatttcactattcatgtgtggatgacaattgttaacattttagtacatttccttctagtcttttttctacttgtggatgtattcacattgcttaaacatagtgatgtgggagttggaaattctttttaatttgcttcttctgtacttaggcctattatctccttagttctcttcataggaaaagttttttaaaaaatcctgaagttttcacttgggaagaagtgttaaaatgtcttgctaaatgtctatttcgtgaagcctgtgacagtggacttgtatgatagaaaaggccatgaaatcacatctcatacagacttctgaacaatcttgaaaatttttgcaatcaagtctagctttgaatctaacacttattagaagctaaggtgagatgcaagacagtgaactgataatacagttcctagagctgtatagagtcagaagagctggaaagtgaggtgagtggggaatggaggacactgcacaattgttatagaaccctataattttacatagaatgattaataaataactgtgtgctgagtcaatcagattgttgctgcagggagaagccacaaaaagctcacaggttatattttgcctgaggaattagggttaaactgggcatgagctcacagaatgtctaatacctccttcccacccctacaggggatttaggaaagaaaaaaataattctcaagcaaatacttgattgtggcaattgtggtgagagtgctggcatctcttttatttaccattaacttgtatttcagaaagaccaggtactttcttaaaaagtcagcaaggccagacgtggtggctcacacctgtaatcccagcacttcaggaggccaaggcgggtggatcacgaggtcaggaggtcgagaccatcctggctaacatggtgaaacctcgtccctattacaaatacaaaaaattggctgggtgtggtggcaggcacctgtagtcccagctactcgggaggctgaggcaggagaatggcttgaacccaggaggcggagcttgcagtgagcggagattgtgccactgcactccaatctgggcgacagagcgagacactgtctcaaaaaaaaaaaaaaaaaaaaaaagatcagtaagttctctgtaagaactgtaatatttaagtttgaaacagccctgataaaaacacatttatttctacattgagaagtttttaaatatatacatatgtgtgtgtatatatatatatatatatataattttttttttttttgaaacacagtcttgctttgtcgcccaggctggagtgcagtgttgtaatctcagctcactgcaacctctgcctcctgggctcaactgattctcgtgcctcagcctcctgagtagctgggattacaggcacgtcccagcacgcccagctaatttttttgtatttttagtagaggcaggttttcaccatgctggccaggctggtcttgaactcctgacctccgcctgccttggcctcccaaagtactgtgattacaggcgtgagccactgtgcctggcctgatttttttttttaattttagcgaaatattggaaaacacagtaaatataagaagtaattgaatattacttcttatatttcaattgattgtaattgaaatataagaagtaattgaaatataagaagtaataagaagtaattgacttctcacagataaccatcactgctaacattttggcatttgcttcctgttcttttctcttttctctttgcttctcttcttttttttgtgctttgtgggcattattaatcttctattgttgggcatttaggacttttacttgctctattataaatattgtttcagtgaacatccttttagggaagtctttgcatagaacctgaattacttctttgggtatgtacccagcaaggggaggattgggccaaccagtatatacatttaagacttgtcctccatatcatcaaattggtgtatgtatatgtgagtattcaacatgcaccaatgctatcctgctaataacagtgcatgctccttattaaacctttaccagcactttttcgtttgataccaagacaaaaaaatagcatcatgtttcaattttatttttttcataacacaatgaaatacaactatttttcattttcatattgcacatttaaatttcttcttcactgaattggctgttcatgcacagtttgaggcggcttttttgatacagagtaacattttgttatatattgcatatgtttgaatatatattaggctgtctaaaataaacagctgtaagtttcatattttagaaaaataatggtgcttgtgaatgggtgcacagagacagatctgaagcagacattgaagggctgtctggaagttttttgaattgacactttccattttataccaaagagaatatgcatgtagaaaaggacacatctcataaatgggcagttagataatttctcacaaaccaaacatttgtgaagctagaattaggctcaagaaacagacccattcagcaccctctagcccatcttgatttctgacacctaacagcatgtattttattttttatttttttgtttttaatttttttgagacaggatttcacttcattgtccagactggagtgcagtggtgcgatcacagctcactgcagccttaacctcccaggctcaggtgttcctcctgccttagcctcccgagtagctgggaccactagtgcgtgccaccatgcctggctaatttttaaaacgttttttagagatgggggtcttgctgtgttgcccaggctggtctcgaattcctggcctcaagtgatcctcccaccttagcttcccaaggtgcagagattgcaggcatgagccactgtgctcggcctgttttcgaactttatagatttgttttctttttgtgtctggcttcttctccttggtctacattatgtttacgagattcatctacattatatgtagttgtgcatgttcatcccccttggtgtatagtattcctttgtgtggctatatcacaatttatgaatctgtcctactgctaatggacatttggtggcttcacatttttggttacaaagagcgatcctgtgaatattctgctacatgttttttggtgcccctggtgttgggagtagaacaatattttcacaaactttcttgtgcccacatctttattctctcctctcccctaacatctcttgagcaaagtaaagaacagcacagacttggcaatgcacagtgtttttgtctttccttgacgttacttttaggaaggatgagagtaatgaagttttcttaacaaggtactgagttctgatttaaattgtagataatgactgttggcttaagaccaggctatcatttctaagtgaagaattatgtcttatgtcttgttattttcttctttatcagtttttcttgatttactctagtaaatggaaggcttttgaattgtcttaaaaggaaggagtttattaacttgttggtcttataagcaaccttcctaggtttactagcttaatgaaaaacaatctttggggtaagaaattggattcaggccatgtgcatgcatgagttgagtttgagagatgtaccaaatctggatcctgctgctgtgtgatcttttggcagaattaaatagaaggcattaaaaatttttatagttgctttttaccagctttatgtctgattttttctctctctctaaattctttggctgacatgagttttgaagttctgccatatccacttatcagcctgtggcaaatgcagtccttaccaacatcaagatgaaaggctgatagttaagagaaaaaaacaaaagcatgtgctacataaaaatgccctacctttttaagaaattgccagagttacgtttatttctctctctctttctctgtatgtatacggaaaaagctaaattgttaaatttttattctttaatctttcaagtgtatatatacctatttaaaatttatcagtaattcccaaacatatctaaactgacaatttaataactcaaggagggccagatatttgctggtgtgtttccaattttatgggtatctctgtaaactatgaatcatcttgtacttctctcatatgcatgggctaaatattaacctccacagcaactcccttgagcatggaacagatggaaaatcaatgctgggagagaggaattctgtagtatggtagtttgtgtccatttgtcttgtccttaatctgtttgtttattttcgttcccattgcttactgtccttagcattttgtcttccactaaagaacaccagccttaagttgatgaatagcaatatcatgttcttaggtgataacctggcaagcgctaacagaggcataaagaatcagaaccaggccaggcacagtggctcatgtctgcaatcccagcactttaggaggccgaagtgggcggatcacctgaggtcaggagttcgagaccagcctggccaacatggcgaaacccggtctctactagaaattacaaaaattagtcaggcgtggtggcatgtacctgtaatcccagctacttggaaggctgaggtgggagaattgctcaaaccccggaggcagagggtgcagtgagccgagatcacctcattgcactccagcctgggtgacaagcatgaaactccatctctaaaaaaaaaaaaaatttagctggtcatggtggcgtgtacctgtaatcccagctacttggaatgctgaggtgggagaattgctcgaacccgggaggcagagggtgcagtgagtagagattgtgtcactgcactccagcctgggagacagagtgagaccctgtctcaaaaaaaaaaaaaaaaaaaaaaaaaaaggaatcagaaccaggctggcagaatgctgccataagagacttccctctgcccccttctcctctgtttgttgtccctccaaccccccaactggagctatgctttcacttttggcatcttgtttcttggggccccattgccaaggcccacagggatgctccagtgttattccctctggggcctcatcccgatcagaaagatgcctgttgttttggccacccttggaagacagcaagaacagcaacagcagcaaacgtatactgttgcttccagacactccctggaagtcccaccacattcattcaattatttattcacctgtagaatacttcactagtgcctatggtgtgcacataagagatagcagagtactgaattccagcgcctgccctcaaggatcttatagtctagtgatggagacatacaagtgaatagctaattaccaaacaaggtaagaaatgctctggtagacattgggtggaaagttgagcaggctcagaagatgggacagaaggggctgaggatggttcttcatgctcagagcctctattcaggctgggcagtttggagttggtcttgcagacacctgggcttcatgcaaggtttgtgagcctggaagtgacatgtgcttctagaagatttttaggaaggggagcatacggaacaccgtaacttttaactttgcttccattttcactaatctgtgacaagttggcttttgtactcttgacattaagatttaatatatgcgatttttggatttgccaagcatctgtttcccaatgttttggattttcatctatggttttatggttttaactttgtttgcaagactagattctacatttttgattgaattatttagaatattagtatactcagtgactttacaaaattgacttgcccacgtttaagaggcattttagatgtttctttctgtggtcagctcaggcaggtacaaaagaagttcaagacttgatatcactagcagctagttatagacaaggcctaaacccagaacaagtagggaatgagacccccaaatgcaccagcagtctatttgatttaatggcatgataaattgtatggtacagttgtgtcttcatgacccaatcagtgaaattaaactaatttgttacttcttttctgatgtttaagtgtccatgtggaaaaatgtttccatacttgggcttcaggaatatgtatttctaagggggtattttaaaaatatcctcccagccccatgaaaaccctgatgtttttgcatattatttgaactcttaaaaccttcatgtagaaagatagttcacattggataggtaagtattataccagaacttttgctggtttctgtggtttctatagtagggatgcagggacactataatgccaaagatttgtaacagatctgctataacccaccagagagcgcaccctactcaatagtgatttgttttttctttttttttttttggacacagtttcactctgttgcccaggctcactgcaatctccacgcctggctaatttttgtatttttagtaaatatgaggtttcaccatgttggccaggctggtctagaactcttgacctcaagtgatccacccgccttggcctcccaaagtgctggaattacaggcacgtgtcgctgctcctggcccatgaatagtgatttaaaagcctcatttcctttatgatcatttcattattgctttcccttgcaatgttaagactgttcctagaatgaaagatttcattacaaaaaaaaaaaccaaaacccccttttagatttttttaatttttatttatttatttatttatttgacacatagtctcgctctgttgcccaggctggagtgcagtggcgtgatctcggctcactgcaagctccacctcctgagttcatgccattctcctgcctcagcctcccgaatagctgggactacagccacaggccaccacgcccggctaattgtttgtatttttagtagagatggggtttcaccgtgttagccaggatggtctcgatctcctgaccccatgatccgcctgcctcggcctcccaaagtgctgggattacaggcgtgagccaccgtgctcggcaattatttttatttttatttttatttttttttagacaaggtctttatctgtctttcaggctagagtgcagtggcatgatcttggcttactgcaacctctgcctcttaggctcaaggagcttcccaccccagcctcccaagaagttgggactacaggcctgcgccaccatgcccagctaatttttgcatgttgtgtagagatagggtttcaccatgttgcccagttgttctcgaattcctgggctcaagcagtctgcccactccagcctcccaaagtgctgggattacaggtgtgagccaccatgtctggtctttagattctttaaacagatttcaacacgggaatatacaactatattaaaacaccagctttcaaagcttgtccgtatattgcaggggtatggacaggatgtgtcctagtgattattttttctactcagccattaaattagaacctgtgtttttgcatgcattttggtgtttttctagcaatgaatttcaagtctatccagatagacccattacaaaaggaaaaaaaaattgcataggcttggaaagtaatattttaaaaccattcagatttcaaagattgataaagacaagtaagcaaaagattattacttgaacagagtggccggaagactgaagcatcagcacagtaaggaagccattaaattggccaaagaacaatccttagaaacattgtggaaaactttaggggtcaagtgcaagccagacaaagtcaaaaagagagacactggggtcatgagatctatgatgtgcccagtggttgtgatgtgtaaaaaatagagatggtacatggccaggcacggtagttcacgcctgtaatcccagcactttgggaggctgaggcgggtggatcacctgaggccaggagttcaagaccagcctgaccaacatggtaaaaccttgtctctactaaaagtacaaaaaattagccaggtgtgctggcgggcgcctgtaattccagctactcgggaggctgaggcaggagaatcgcttgaacccaggagatggaggttgcagtgagccgagatagcaccattgcactccagcctgggcaacaagagtaaaactctgtctcaaaaaaaaaaaaagaaaagaaaatagagatggttcattagatagaggcagcgttgaattcaacaaggactcagagtgaaagggtagagacaactgcagttggggaaaaggcaaatcagagagaggcagctacagagcagaggcctgttgttgatggagatgagcattctttggcagtgtccggaggggtgtgacaagcagaggtgagatagaagagtactgtttaatgtggggcaaagaaaggcaggtgtatagagatagataactcttggtttgagtctgagtaatttatgaggcctttggcaaggaagactgtgacctgaatattacagaaggaggtcagtattgcaaaagatcagtgtttggatggaagatatctagtttgtgaggatagttgttatttgacaggaaattccaagtttgccgtgtagatttgaagataggttgaaaatacaaaaaaaaaaaaaaaaaaaaaaaaaaaggtgtttattcctccttcccctggaccactcctccccaggacttcagagacagtaatgcatagaaagggaaacagaaatgaatttcctttaggcaagagagctttgtaaggccgagctacttgggagccaaggagaagctgcttctttgtgacaaagcaggggttgaagttgcagtggttgctaatattctgctgaatgagctctgaggtgcattcattttataggaggggtggtttcgttttctagctggtccatactaagatttttatttttgtctacaggcagtagagtagataagaggaactcagtagaattgacagaattgtcaggcacagtaacacagccttgattatgtctttcgtttgccgttttcatcaactcttcttgggaactttcgtagaactggcccagacaatgtgattaggatggaagagttctttgaatgacttggcagcagtgcagtgcgaaatctattattatttctcttaaagtttttctgccaaaaaagtacatttccatttgtgtcaacaagatgtgaattaaagaataaagaaaaatgcagaaaaaattacatgtgttctcaacttaaaccaaaggtgcaacattttagagtatcagagtagtcattgagactgtaaagttcagttgaatctatccctgaggggttgggttgagatcgcagcctctttgaaaatttgaactagagactttccaaaccaattcttgttcaaacctcctctacaaaggtaagcctggtctatccccccacagtcaaaacctgaagaagaggcctttcctctccatggcctttacctaatgtttacattactgcttaccctgtgttaaccctgtagcctctgcgtcccttctcaggtagtttctcatctagaaaaatcagtaatgtgggccttgagggcagcagccattctgtttttactccccttagaaggtcagggttcatgctgggacacacggagcccttgacatggatgagtctgtatgaattgaatgtgaagaaccaacctgggctggtttgtattgtttgtgttgactcagcctgctctaaaccctattacccaatttttgacacaagaggtggaaacactccctcagaatcctgactacatttgtttctgcctctagcaaggagtttcccaattatgtgggaagaggaactctcaaaactttattcttggatatgcctctttcatccctattaacaaatgtatgtgccacactaggtcatataattgtcaggttcagaatcataggagactgatttgatccctgacttactaactttgtgactttggagaagttaatttctctaagcctatttccgtcatctgtaggatgatattgctgtctgcctcatagttattttaagatttcaaagcattcatattaaatactgtggagatgatagttaccttattttttgaatatttttcctaggtgtgtttcatagttttactaatgggtgttgttgtcatatcctgagacaaggtaggtcagaggacaacacgacttttctgcaaaagaccagctagtaaatgttttcagattttaacaggcgatttagtttctatcactactcaactctgctgttgtggctccaaaacagctgtagacaacatgaaaatgaatgagcctggctgtgttccaacaaaacattatttatggaccttgaaatttaaatttcctatcatttttgcctgttgtgaaatattattcttcttttggttatttttcatccattaaaaagtttgagatatatttgagctcacaggctgtacaaaagcagtcagaggatacaggttgtcagtaatcaccctaaaataatttgcttgatttttcttagtaaatattgtttatggagaaacaaaatgtattcctcgggaaaatttcaagtgtctcaagtcactgtagaaaaccaagtagaagggattgatgttttcaacagatatttgaagaactaagcatacttgtctagtaaatgttgatttggggcttgaccagagatacgttgaagaagtgggtaaaagagatgaccagttttaattatagattattaacttggagctttttttctggttgtaaaacagcagttattccctcctaagctgtctatcctgatgcttggtgaaggcgtccactggtctgttgccttagaggttacggagctctcttctgcaccatcctttttcctaggacatctatgagaagttggctgaagttgataggagatgtcccattttatataaggggaagcagcagcccaaagaaattctgtgacttgcctaacattagacatttctagcagtataggttgggcatccctgatctgaaaatctggaatcccaaatgcttccaaatctgaaactttgggagcaccaacgtgatgccacaagtagaaaactctacacctgatctcatgtgaggggctgctgtcaaaactttgtttcatacacaaaattattagaaatattgtatgccgtgaccccaaggctatggatatgaggtgtatgtgaagcataaatgaattttgtgtttagacttgggtcctatccccaagatatctcattatgtatatgcaaatattccaaaatctgacaaaatttcaaatccgaaagacttctggtctcaagcattttgaataagggatattcaacctggacatccaaggcctggaaatccaatgcctggcccagggctcaattatcttgccaccctgttttgcattatcacacagattatcaggttagtgatagtacctagctttcataaatgccacagtttataaagctctctttcatatgctattatgtttaaccctcacaataccctatgaagtaagaggggcaagttttactatctgcctttggtagaggaggcagctgacaacctgatatattttaatgtaccctgggtcacataccgattaagtgctaggagcaagtctgggagctaggttttctaactccttttattacactgtgctgccttattatactacatggcagttgatgccattaatacccaaacattaaaaaataaattgaaaaagaaataacatcctgccatggttccagcccttggcagtgatttttaagtggaggtttgtgttatgagaatttttgctttcaaaatactgcatgcacctcctgtaaaaggttgaatgaaatgattttagttttggtaagtggcccatgcacgtttattatttatttatttaggtcttttttgctccagctcctttggctaaatgaagcactgctgtatttttattgcataccccatcattaaaagaaattgaaaagacgcttgttagttttaatatcgcatggatggaaatatatctggcacatttaggaacagttacaattcctaatagtgcattttaagaagtagtctggttttgttcttgattaaaaaaagagaaaactttcttaaatttgctataattcgataatcatctttagttgggaagggagaatgtctctgtgttgtatgattctgactttattgactcatttagcattcctttccagccagtgggaagggattatactcttgggcagcatgaagggcctttcatttgttggtaaataatccaagcaaagctgcttccaagtgcaagtcttttttcctttttctgtaaaccatatgcttctttaacttttggacatatgcccctttcaataaactatgtgcggctctaactgttggagctattgttaagttaagcacaagccaaatacttaggctgcttcttgcatctaagcgttcatcacagtccccctgaagacagtgttttttttgtttgtttgttttgtttttttgcaaaatagctattcagaacctggaaaccctatagaaatggggaggtgtggggagaaatagggtgacaagaagataatttagccacagcatgagaggtgtcatttacactgcaagatactaaatgtgcccaaggcctgagcttgacaaaagtaacaacagcgacaacagaagtagaatgagaaattcgaagaagtttctgaaccatgtttcattcatgactctggcttaaagtttacagttaagttcgtttgattaaagtctgtagtattcttcctgacggcctttagaggaagaggcagaataattttaacaatgaaaatagtcttcagctgggcgcggtggctcacatcacgcctgtaattccacactttgggaggccgaggcgggtggatcacctgaggtcaggagttcaagaccagcctggccaacattgtgaaatcctgtctctactaaaaatacaaaaattagctgggtgtagtgcttggctctctctctctcatgctactcaggaggttgaggcaggagaatggcttgaacctgggaggcagaggttgtagtgagctaagattgtgcctttgacctccagcctgggcaacaagagtgaaagtccatcccaaaaaaaaaaaaatagtcttcacatgtacagatagaacagtggcaagcaaatgaatgctctcaaaaactcctcacagaagccacattttaggggttaatagtaatttataatacaaaggaaagtcatgccaagctgggcacttacctgaagggtgactttaagccagtcgcttaatctttgttaaacctcaggacgtttagctgaataactggttgatgatactgcatcctggacaggtctgtgaagattcagtgggattaacgcatgtggagcacatagcactggcctggcgtttagtaagtgctcaataaatgtgaggcgcagagtatagtctagtgttgttaacgcatttcccatttatgcctttccagagtgggctggtaaaagctgagttaacaagttttcagggagggaccttagggtatttttgacattttggggaggtgtttgcatatgcataggagataattaaaatgatataattttacataggctaatttatcaaaatgatataattttacataggctaattttacataaaatgacataattttacataggctaatttatcaaaatcttttaaagtcctataccagcggggggtgttattaatatgtgcacacctagcctcctgtatcttagctatgttctattgtttcaagggatggaataaatagtttaaagcaaggcttcaacagataaacttgtgggataatttttcaatttgtatgtacttaatttgaacttctttagataattatagtaaaggtcatacatagaattaaaaataaaagacaaacaaatcagctttttctgtactctaaatgattgagaaatataagttaaaaatccatacaaatatttttatgctaattggtgcatttccttgacatttttctttttgtttagaaattttgtatagaaataattatatatttctcttcctcccacttcctttcgtccaaaaattcgaatccttaaacaatttagagacatggcagcctggtggctaagtgagtgaactcctggggctgtggtgtgaggaaggagagcagctagcgtcatgtctgtggccatgaaggtgtgctttgtgagaggtgaaattttgtggcctttctctcctccctcataggcagtacctgagccattatctgagattttgtaaaggtacagacttttgtggctaactcactagaagcaggctgcttagatacaattgtgaagaatcaaaaggtggtattttcatttgggtttctcaaatgcacatttcatagctgaggtcagtgggccatagctaaagggggtttctgttgcagaaacctgacccgggcagcacctggcctttgcccagaggctgattgagtgtaggtgagccttgctgtctgtccctcatgggggtcatgtggcctctagctccttttggtacaataatggtattatcgtgatatttaaatgcactctccaggagcgcctgattcctgcaagggcataagcatggtctctaaaatgttattaaaaatataataccaccatatgctcaggctttctcattccgtgatcttctaaaaacaaaaacatgcaacataaacacaccagatgcagcccattaagtttgtgttcacttctgcagtttggaaaaatgttagaaaggttaggaaatagaactttgctggtgatgggaggagggtgtggacctgggaaccagcatctgaaagcactgccaaaggaagaagctgctgcacacagaggtttattccttcgtgcctttaaaggaaaaccaagctgtaagtcctctggccacacaggggctgggccagatctccagagtgataggatcattcccatcggaggatgcagccaggtggcagcaacctggacactctggccttctgaacaggcctgtcattgtttctgcttaactgttggccgtggatctcgttatggaatcttaactgctcaggtctgtatgtgcaaagtaagaaagagagactcttcattctttgcttgtcaaagactaaaactgaattctcaaagaaatctcgaatacctaaatgctcatgagactgtgactcacagagagagatagtcataaatgtgctaccaagcaaaaggcaaaatttttgaccctccagggaatttattgtactgcctttgatgccactaattaactcactctgtgtaagcagcgactggcaactaatagcagactaatagaagaagctccatgacgttgttttagaattcttaattcaagaaagagtcttggcaagagcttgaaaaataaggtagatctcctcccttttaaaggcgaacccgctggggccctcaagggtactgttttgtttatattttcctgttctcaagtgcatgctggatttggcaagtctttctgtagggagctttgaaagatggttagtacccttgggtttgtgcttgcacttaagtgcctgttcagggcagtgttcaaccaggtcacagcaatcttcgctgacctcgtcatcagtgttcagaagcatcctcccgggggtagagatggggctgcagacctcttatttgtgagggttcaggggcacaggaaaatgtatggaaaccctatgggctacagggcatacttgctgaagcttcagacaagctgatagtgttatctgctcatcattgtcattatctttttaaaaaaaaaatacaggaggcagcttgctctgcatgccatcaaagctttctgctgcagtgaggggaacagccatttcaggttttacattttcgtttatctgaattctcatcttgctctctctgcccactcccttctatcccagggacctcttttgaagttgaatggagctctgtaaactgagcagttggggagtgaggtgagaattttgccttggtttgagctctaacctgctgctctttggagcaaatggtttccagtggaagccattgggatattggtcagtctagattatgttttattctttggtaaaaagaacagtagaaatatgaaaacaattaagctactctatggctctgatggagggcattttctttttctttctttttttttttttggagactgagtttcactcttgttgtccaggctggagtgcaatggcgtgatcttggctcactgcaacctccgcctcctgggttcaagcgattctcctgcctcagactcctaagtagctgggattacaggcatgcgccaccacacctggctgattttgtttttttagtagagatggggtttctccatgttggtcaggctggtcttgaactcctgactttgggttatctgcccacctcggcctcccaaagtgctgggattacaggtgtgatccaccacgcttggcctgatggagagcattttctactttctctcctttcaccctgggacctcctggttggtgaaagtaggaagagagagcaatcccataatctttgagggagagttgtcacttgaatttccccaaggcttcaaattctgctgcagccctctcatgttgcaggcctggcagtgcagtttaaaggttgcaaacaaagctgagtgctttctcctgatccatctgggcccctccctctgtcatccgtcattgtcaatgggagatgtatgtgtagctgcacaagggcaaagtctgaccccgagggtattggaaatgttcttagagtgggcattgtttgctcacgccctttggaagccaagctctagacattctagggagcagcccctggctttggcagaactgcaatctagatggaaagaggaaatattctgctttttaaaactacaggaactttattcccccttcctagcgtaattctgcaatgcttttgaatatacttagcctcttctctttttcatttctgatctctctttggtcagtcttggggagaattctgaaacagggagcgaggacttggattccgttggtttttattcaaagagcatcaacatgtaaataaccaaagaaataaaagctgataagatgcaacaaatgaataataggaaaaaaatgaaataatgctctttgcaaacacagcgaagcaatttcctgggaggaaaggagagacgattatgctctgtgtcttgttcaggacaggagggtggggccccaagcttctggagacacattaaaaatgcctggaacacacaaagcccctggccgagtcctggagtgcggtggagagggtgtgcagtgctgagtggggcctgtgtgtatctttgcgcgtggtagggggaggattgcacctgtgcgggtcctccacgtgggtccagtgtctccccatagatttgtcatttgggcttctgtcggtgtttcccaggagtggatttatgttgtcaaaaacttaatgggagagtgtctcagttttgaaattttctgtgcatagcaatgtcattccttttctttttttttttttctttttactggtggtagtagtggatgttggggcacatatccaggtatcattccaaaagcctacccaggaacagagctcttgtcctgttaacaggggacagggaggtgtggattcagtaaagcatactgggaagtttctttgcatcacttactcacctgggacatgacggctagtttctgagctgggcctaataccttgtcctaccgccatcattgggttgctgtgaggatcacatgagatgatgtaaataatgatgggaaagggttatttcttttcttaaggatggggaagatgtttgcttgtgaggggtccagattagtcaacaacatatttatggagcctcagtcctgtattttaattcatttgaacgtgactttattatatcattcaatatagaagttacaaggtttcacaaactcagaccttaaatatggaaatagtattttcttgttagaatctcatttggctagaaatctgagtatcctccggtctttccccccacccccccttaacattttgttgcctcctccctgcccgccccatcctcccttcattttggctggctgcaacctgagtgccacttttctgggaaagcctgatattctgacttcagttttgtaatttaatgatggagagtttccttagtaaaccaaatttagagtcctagaatgcttatcttatatccagaccttgaacataaaaggcattttatacccgcaattgttcatttaatgagcaattgcagagtgcaggccggttaagggattgagctatatgcactattattgcaagaagtattccgaaataccagaaataggacgtaagctctgatcagggagactgcgagcacaattaccttcttttcaaatccttctgtgacactgcgggaggaaaaaggactttgaaacttgaaaggaaagagcttgctttcaacctcaaaagctaggaggaaagggctctgaaatttgctcagaattcccaattcaccattagcctgtttcttcctttagcctcaaggcattctccgctttttgaaaagatgttaagaaattcagtcacaatagagagcctagttttgaacatgtttcactcggtccattgaggtctaggctccagcctttgtgtggggtgaattgagctgagcggctagctggttggagagaggtgaatgaggagtcgctgtgcactcgcaaattctggcaaagaaaaaagctcaccccttcctttattttacaatatgcattcctgtacaatcctgctagtggcaatatgtggagtggagcctgttcttaagtcaatacagagtacttggtttatagcaactcttgttaagtttgtcttgtaattgaagctgctgttgaccttgcttggggaccatttgtaaaaccgtttatttagcataaactgaaataataaaccctccttctctcaggctgattgtgatagggtgacattagtttgatttaatgattagccgcctgacccttctgctggagagagaggcttgaatagggagagttcactcggaagcactcagaaagaatactaatgagcttgttaaatttagcatggctccaaccacttttaattcctctaatgggagcagcattgcctgggagagggagagggagagggaggcagagagataccgagaatgttcctagagggtctgcgcagctagagagagctcaccaagagaagttggcgcaaagtagctagccagagcctggggactgtgttgtaagtattgtctgttctcttatactccgcatcttctaggtcttgggacaagagaggagtagtgggtattaaaatgggttttaagggaaaatcaatgttaagtgggaaaagggggtgaacacgtgtactgtgagctcctaatcagctaattttgttaggtgacaggaggtgtccttagttagtgatgcctggcagagttttgtttttatcttgaaggaatcacctgaaacttttctttcaagtcatggacagaaaaaaacaaaacaaaacaaaacaaaaaaacccgaaacctgttccctcggttaccatgagaaatcggatagatgtctgtctgcaagcgcccacaagtgcgtgttcgagtcctgcttcatgcagcaacgtgattaccttctccagacttttattgcaaacgtcctaagcactgcttgcaaggaccccacttttttttttttctgagtttctagcaccaagaatatctgacttgatgtcacttgcttttggatgagtttggaaattctgggacagtttctaaaacgtgatgctttgggcagctctctgggggcagggatttgttaacttccacttgagcatggatatgaaaagagaaggaggtacaaagtgggattatgatgacagtatttaaagtcattttttcctgaaagattttagtgaattgcatgtttcggtttgacccccgagcttgcagctgttaaacatagagaagcgggaacagttgccttgtgtttggctgttaaagtccattggcagatgctcttggagcagtgggctgtttgcttacatttttgcagcagacttctgcctgttgccatggtggacagtgtgtttctgtcaataatttggcctggcgtagcctgtctgcactgactctcaaactttattgaacaactcggctcaactgaacaagattagacagctttcgtcttttggcttgctgaagtggttgctaaatttataagagcaggcaggaatattgcttggaaagtgtccctttcactgtatacagagtgctttcaagcctcgtagctgtttgtattgtggagtgtgtatactgtcaggttttcatatgaatgcccgtcaaaagcaacttggtacaggaggtaaacttcatgaagtatttgtctgctggagttttccttttggagcggggaggtgtggttgggtaaaattagggtagcactgactattgtaaaagcaagtttcctgatggaagttttcacgtaaaaaaaattcctgcctgcatttaactttactaagggaatagtaattttaatttaattttttccatattaaaaatgtgcacttcggttacttcttgttataactttaatatttacttttgttgggtgaactctcattaagaaaatcattgagctaaaaggtaccctcatttccactcaccctccccactccgccgccccgattaccctcctgagtttattctctcaagaggttgggggaatggtgggaagagtctctggccagaccataacccattcattattcagttatttgtgaggttggattcaaatgctcatcataaacatgtagtttttaagacagggtttattatagggatgccgttttaagagaagaaaagttaatttattctaggacaattaagtcaaggaaatcctgttttaaacctggaacaggttagccgagtttggttattcatctttcccagagaatgctaattatgtgtcagagcccccctgaggaagggttttctggcctccaaatgaaggtccctttctacagaatttgcacctcagtgctagaagttcatttcagatttaagtttgaaataaaggctttatacagagcacaaattagtggaaaatatgacttgggccatttgtaggttatgggaatttttataaaactgacataagttttagtgtttttgacacccttttgcttttacgtaactgcaaaattcttattctatagactgtgaattttctgctaatgaagtacaagggtgacctactgcctaaaaatattagttagaggggaaaataaaaatgtattttgtcttttgtagtttgttttaaaattgcaaggagcatggtatgaattgctttcatagagatcaatgtgaacatgtgagattacaggattttttttgtttttgtttttacttgatagattaaacatataatttaccccttaattataaagtttgggatgaggatctgcacaaaacattattaaaataatatttcacagttaccttgtagtagtcagcaaattctctgtaaagaccaaaatatacctcattgtcttttctgttctgcaagtcatttgctaaggtaaggaatatattgcttagttttcaagtcctacacacaggcagaaagactaaacttgctgctggctttaggtagttcaagtcctgagtcaacataaatagtatttgttattttcggtttgtatttttatgcaagtctgtgtttacagttctactttcttctgaatttgaacaaagttatgaaactgctaaagcattattcttatgtttattgggggagcccttagttaatcatatctgctttatggattattttgaagataaatttgtatatgagaataagatgtgctcaagatctatttatctaaaatgcacaacaatattattatttatacccaaatacagtttttttttaagataggaataggaaacggtttttacattagatgtctaagtggtacctggacagcagctttctttccatcagcacttatctgccagagcacagtctgttgattaaatgtggaacttgtttaggagcatgtagtttagagttcatgtatgattcaaagagatgaattggtccacttgttgtgggttcacataggcagtgtgatttaattttatgcatgggttctttgatctgctattatagaaaggtcatccaatcacatttgcagagaaccatagtggagaaatggaaagttcttactgatcgaagggaactgaagtattaggaaactggaatacccgctgtatatggaatttcttcaagctgtttcttacatgtttgaagaaatgtatggacccatcagagcatggacacatatcaacatcccccacaccttccttcctcaccctcagagccatctcacacctggactttcagtctcactctgtgttcctcttaggtctcagctttgttgtatggacagaagcaggaagtatctcacgagaggctctgtaggttttcatgattggcacctttatcccttttcaccaatgagttttctgttccatttttggctctgtcaaatctcttgctgggttacaaatctgacttaaaacaacaaaacagcataaacttttggatagcttcctaataggtcattctctaggagcaaaggccctacatcccctggagcaaccagagcctcagtgggtagctggaaggactttgtgtcaccccggaggccccgcgtccccaggcaggcaaagggaagctggacatgcacagtcttagattggcaaaggtttcagttccacgtgggacctgcaagatgttggccagcccatgagcagaaacctcatgggcagacccatctagaagctggtgatgccaatttgccaacccctacatctcagtttaataggctcatttcctgctctccttcatccttccctgtgtatttgtgtactttggaccctcattcataaacaattttgtctgcaaagatcccatcccagccctgtagctctcaaagttgctgtgaatgagaaagatacttcttttccgggagagggatatcgagaatgagacctaattgatcatggttttttaattgctccttaaagtagtttacagagtctttcatttttcttctttctttagaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccgtaagtgcccatgccagtcggcacttgttcaggagctatggggagggctgtgtgtgtgtgtgtgtgtgtgtgtgtgtgtgtgtgtgtgtgcgcgctttatgaagttttggcttgtataatttattaaaaggtgtaattttctttccactttccttcttactttccctacttctttcccattctttttagagagagatgttttcttacgtctctaagcaacatcagtcttcagtggggcggccttcaggagagtggtccatttgtgactaatccacatgagacttttgttgagaagtagaactagagttactccatccaaacagatgctgcaggagaaaaatttgttgttatgaagttatgaaagcaggctgcattaagagaagtgctcaacagccgcaattcccatttttaatgattttttaatgtaatgattttgcctattcccatttttgatggtttgtaaaaacaaacctcttttaacaaatctgtgctaaattccttaaaatggaagattttcctttgtgctgtattttcctctctaaccagcgtgccagacacatcagaagctcctttctcagcactaatcacgtttaagaaattaactaggactctgaactcatgtatgggatggttttctccaacggcagaatataaagaaaaatgtataagggttgagtttatttctgacctgtttctagttaaaaaaatacaatttggttgtggagtaatgaagttcatattgaggtgccaaagcttgcagctcttgattacagatttatcaccttgccaggattcagacttgccatttaaccttcccggctccaattccagatgatccattgagctccagtgagggggactggtttgtgtttccccttttccacatcattcagaaattttagtgttttaaggcaaaaggtcattagccagatgactgattagtgaggacagctgattagtgcatgtttttttgctcaagaaagtgcccaggataaaagctaatttcatcccttcattagttggcttgcagcaaaggggaatgctcactcctcagatcaaagggcctcgcataaccttaagtctcagcaaccgctaccccgcaccacctcccccccaaccagattatattgttggaaaagatggaagctacattattttttttaagtggagagagcattttttaaaaagtggtcagaagcacggagggtagttttctggattcttctaagcttttgaaaaaggttacaacttctctgtttcaaaagtgcttgtccatcttatttctgcagatacagaaataaggaggaaggctattgggcttgttccttccttcattcagggtttacttagttttattttattcatctttccttttagtaatgaaggtttaaaatagccttggtaggctttttctctgagcacattcctaagttttctgcattgtatttttatttgtgagtctcttttaaacatcatccatgcagaaaatgtgagggactcctacatgctttctacctgtatttatagaccccagtagtagacttactttttaagaaaaattcaggctagactcttagccaaagctccctgcattgtttttgttcttatgtgtgaacacaaacttttcccatctcatatttatgttttgttgtcttttcaagatgcccactaattagtgaggtatttaattagtcaggacagctgaagagtacttcttttttggctgacagtagtgagcagataaccgttaactttctctctgtgccattcaacttgcagcttgttcttggttcgtttgttttaacggtttcccccattgaatcttcccgtcctctgaggggctgggagctctctacacctgggacccttgtcttccttcagcggtgcaagtgggacccatctcctggacctccaatgtcctattaactaatgatgggcacgggagagctcttagggggatctgaattcattcatcatcactctgttttgaggttacagcattcatagtggattattcgttacattctcccacaatattgtccaaatcagtgttaaaattatgtgataacttataaactgtataagttctctgtaaccaaatggcaaatacaattttgacctaccatcccaatgtactccctaaattggtcataaattacattattatatagataatatggatgggaagtcctaaagactgcacagattggctcaacacttgggaatttgggttcaaggtccagctttgtcacttgctagctgtgtgaccttgacaagtgtgctgatccctctaggaatcctttcctcactgtgggatagggtgataatatgactgcctgctccatggtgttcttgtggaaattgagacaatgcaaataaagtattaactaaaatctctggcacatgttaagtgcctcaaatgtattaaggtagttcttctctgctttctcttcctccttctcctcctctttttttccttctcttctacatcatcatcctcctcctcctcatcatcatcaatatgtgataagttgactctctaagtcatgtttgtgagggttgcacttgtatttgattcagtgtagactgttttttttttttttctttctttcttgccagacctggtcacctgcttgcctgagaccagtttcttctataacacagattaagaattgagcaaactgcaaacctgtaactgtggtgtcgttagagctgtgcactgtggccttctgaacataatcttttctcagtcaacctcagtagatcgactataacttttttctgttttgtaagtgaagaaattgtaaagattttaaatgagtttgagaagtgttaacattttaaattcttagcagaaagtgttttatgtaacaaatgcaaactttaatacatgcaggaacataaaagatatagtattatttattcatattgaatatttaaagacatcctaaactaagcctcagcatcatatgggatatgactttactttttctttagaactctgttggattacttaatctcctgccagtatcacaagtattttttgagatactttataataaaatctatctgctcacatggatttaattatccaggcaaagctaatgattgatgtgaattgaaggtgataaattttccatgaattttttagtgtatgaagaaatgccctctttttaaaatgagacatacagttttggtcacatttgtttatcttgtgggcatagcttgtctcagtcgtgggccctgtcaacaatacaagcgcattgcagaccttcagtagctcaagttcagaaacatctttttaggccagtccccttgcccttgagttatttgctagctctgctgagccggtcaaaagaaaagactcctctaatccagtgggctggccatgtgaacactcacagcaattccttcatttctctgtggttggaaattgtagactctccaagatgcctaatttgtgtttctatatatatgaactttgtatttctaaagtgtgggcaggcttcctgtaagaccggaaaagggaaaaccatttttgtttttttttccccttcagaaggacatctgtaaaatttttattgcacaagattttattatatttgggtatgcaatgttgcatcttcagaaattgtagttaggcaaaaatcaaagtattttaggttttgtggcttaaaaaaaaaagaaaaaagaaaactcagggacagcgggcacttcaaacattcacagcatatgtttagaataaaatctcccggggggatacgggggtattctctcatgaagggtcgcagtggacgggctgtatatcaaggcgcaaaagtagacgttttagatgcatgactcagacatggcgtggtgttgacaggctttcagctacaggatcactggcgctttataatttgggggagcgtggtaggggttagattggaggacctgatcttgtatcagagtcagggtaagaagccccatcctctgcccaaagattcctcagcaattttcttctgcccatgctctgtctgtagccaggtatttctaaccgccatctctccctgctttcattgactgccatgcatttatcttctataaactttcaaaggcaggtgacataatagttaaagcattcctgtaccctggccgacacttaacttttattcgcttcccttttacagaaaacatgtgttgcattgtcttctgtcttactgtcaagagtctagtttttaaactcttcctgcagggatctttgtgcaaagtttctcggattcactagtcatgtcatattatagggtctctgctggctttggtaaagggagcagaaagatgcctgctttttaaaaaatttcaggtctcctttacagttttatagttgtgtgaaggctgcttttcttctgcccccaactgctcctaagcagtagttcttcatggaaaatatgattcattcttccatgcaaatgctttgattgaaaacataccactggtattcttcctatgttccccagctcagatgacagaactattggttgctaattagcaaaacctgaggaattagcttaaagaaaaaaccctgaatttttaattggcttgcatttattttctgtggaaggctgttgtgctaagcccacttgcattcttgtgtgctaaaaaactgcatagattttttttctacctgtctgtctttatattaggtgactttccacatccctttagaaatacatcttctgagtgaatggaagagaggatgtatattttacatatttaataggtacacttgctcatacttctctctcttactatccaagtgtcatcttgagactgtgagagacaaaaatgcctaagaggcataaatgaacagttttgtcttgaccaaactgcaaaggcagtgacagttccctgagctcttagttctcttctcatccagactgtcttttacatctttggagaacagttgatgagccaatcagaaatgctttgtttttttccgccctttgaaaattagattgtttaaccagaaagactgatgttgggtcacaccctgggggctttgctaggtctcttgcttcctaggctgttagtcttgaattgcagtaagagctggagtgaggagatccaaacaagtccataaacctttgcaaaactattatttgtgagcttgagaatagctccctgcttattcttgtctttctcttagaaattcaatagaatgacctggctttcttttagtaatccagaggtaatgttttaagactagaaacagtgagccacttacatagccttttttttttttttttttttttggagacagagtcttgctctcgcccaggctgtgcagtggcgcaatctcggctcactgcaagctccgcctcccgggttcatgtcattctcctgcctcagcctcccgagtagctgggactacaggcacctgccaccacacccggctaattttttttttttttgtattttttagtagagacggggtttcaccatgttagccaggatccatagacttttaaagagctgcattgcaagacaacttggagcaaagcaatacagatttagggataattcttagtgttccagatttgaactgttgccagtgaatcttgactactcttgtgcctgatgcgaccgtgagtctgcgtatctctgttttaggagatagtgaatgaaactgggaaccaacagtgagaaaagtccctgtagcatttagaaaaatttgttaacaattttattcatcaattttgaggataaatttattaaaggagactgggagaagcttgaagaccacccaggtcaggaagagaaagaaaagaccaagagagaccgcatttttctagagaaaatcacttagccccttagtgcactggtccagtcctctcttcccctgccgcctggcactgttctcttctacaacgactcagctcccattggccactgctctggtgctggccctgcccttgttgccctgcttgtatagttgtttctcctggaccagttacttgctttctctttgccttcaaatcctgcttatgtttaaaggcctatctaacaacccacctccttggaaagtctctaagagccatcttacaaggatattttcctaccgtggacacttgagtagtcatgtcattctcacctttaaacacatcacagctacttccttgtgttgcccctacctggtggcccgacctcctttggaataatgtgattagtccgaggcagtacttactttctgtgggcaccaaaactcctagggtaggactggggactcatgcgtgccaccatagggcagagaagttgggagctgctcagatgcttatcacagtcaccatggaggtggaattccaggtgacccatgctcacagcctgcccatcagagtggcttcttgaccacctgaagagacattgctgtttctgcttcccttctacaatttagttattgtacacaacctctgatccaaacttagtcacctaatccttcctgagagcaggcaatgtacaaagtatttatggtacatttgtacatttgtaaaatctgcatttttttattttttatttttgaggcggagtcttgctttgtcacccaggctggagtgcagtggtgcgatcttggctcaccgcaacctccgcctcccaggttcaacccattctcctgcctctacctcccaagcagctgggattacagacatgtgccacctcgcctggctaatttttatatttttagtagacacggggtttcgccatgttggccacgctggtcttgaactcctgacctcaggtgatccgtccgcctaagcctcccaaagtgctaggattacaggcttgagccacctcactggcataaggcagggacttcgattctttggaataagctggcatttcactcatagacttggatggggaccgtaattttaagtactgtaagattaacacaggagagctgcctctcttccatgacacccatctggcatcgaacaagtaggtattttccctgtggttaaggggagcatgatgtttgtttgcctttttccaaatttcagtgatgtatcttgtcttcaacagcctctaggcaattcatattttggtaacatcttcccaacttagcatccaagtatgcgtctgatccatgttgatgggaggccccatctgcaactcagttcaggatcatgaatccagttgcttaaagattccatgtaattatttatcttttctaatttggcacccacccaaatggcacttttttagtagttgcttgtgatttctttccctccgtcctttccctccctgtttccttccttccttccctcctagagtaaagcatgagaaacagcaactcttgccatttcatagccatctgctaacagctttccctcccgctttcttaatagaggcaacattatcctcggccctcctcctttttcttgtataattaaagaatgttacctttgatgtctcttgaagctgcaatctcccatcctgccttagctttcttgatctcatacctgtaaatttgtgctgtatcttcatagttcttagggaaagggcttgatttttctctgtgtgctgttcacagtttgggttaatttagagtaaccgatctggcattttattgctctcttctccctgtcttctgatatagtttggattcttgttgtacgctttgaaaaggatccaacttcctcaattctttaagctattaaatttgggtctatcctacaatggactgttctcatcattctaatgtcttcacttcttttgaggggggccaggcttttcattaacctcagtttttcaatgagtttcttcttcttagatcaaaataaagcaagattccatttgattcctttagctatttatttttgtgttcattctgtcagtcatgtattaattgagcatttgcttattgagtgtcacctaagtgctaaacagtgttgaacaaaatgagcaagtgcctgcttctgttgagctttaggccatcgaaaagtcaatacaagggagctgtcaggggagagagagtgaggagtcctttgggagcaggtgagggacttacccagccttggcagtccagaaggcctcccggaggaggtgatatctgaaagaggtgaggaaagagtaatctaggcaaaaaggagcatttgtcaaggcctggaagccaaaggaagaactgacatctgcaggacttgagaagaatctttgtggttggagggtgaatttcaggagggaagtggcaaagacagggctcaagaggtccaggccagcaggcttctgtgaggagctgtttgtttctctcctgcaagagtctggggtgattactaagacttgttccatggccctttgtatatttaaacagacctttgggttcccaatcacttacccagaatttctccattgcagaattgaattcacccctgctttcaatttgacagcgtgcgactccatcgcaggtcacagggctcccctcccaggcgtccctggctgggctgctgtctcattggtctttaaggatgtgctgctgcattcctttgtgtagcaggtcatatatatatttttttgagatggagtttcgctcttgttgcccaggctggagtgcaatggtgtgatctcggctcaccgcaacctctgcttcccgggttcaagtgattctcttgcctcagcctcctgagtagctgggattacaggcatgtgccaccatgccacgctaattttgtatttttagtagagatggagtttcaccatgttgtccaggctagtcttgaactcctaacctcaagtgatctgcccgtctcggcctcccaaagtgctgggattacaggcgtgagccaccatgcccagccagcaggtcatattttttcttcaagacaacacaatttatttttacttgttctcaactgctgagctgctctgtaataggtaaccccaatcaccacaatatcttgatcacaaagtacaaataaaaaacataggaaataactgtggcttcgttcctaaagaattaacagtgttctgtatcaaggcacattttaatttccacttacagtgttcaaaatgaaaaaaaaaagcattgagttttattttattggaaaactcccaaatgctctcacatcagtcaagctagagaaattgtgcagcagggccaggctgaggttggagatagggcccagaaataaccaagtgaaattcagctgggaaatttagtagctaacaccaccaggggagcatgagaacaaagactggcattagtggatgagcctgcaatccagccaggactgaaagagtctcaggggagaggatgggaccccggaggagacttgtgccatgctccctagggagccgcaggcctaatcagtggacattgtgaggatcaaagggagcccactctaggaagcggggtgtttacgtcgtccactggggggacccagatctgcatcctgattgtgctcctgtcttgtgagtggagtaaaaggaggtgcctgtttcctaggtaatttagacaagagcagagaagtgcacgtgggggatgctgagaagcaaatgccagctcttcttctggtttgctttcgtggaataagcctgttttcaaatggggcaagatttcacatttcctttcccttcccctacccctgtgtctcctctttgtaagaaatttattccctcctcccccaggggtgaagggaaactaacatacaatggtagctttcctgtgacctcgctccctgctagagaatctgtgatccactccaacttggtgtctgtgatcccagcttggctcagtgaacctgaccaagtgggttgaccttttgatcaaatgtgcagtttacctctcatatataggtctgtgagatgcatttttatgtagcctctatcttttatgatgaatgatgttttaaatgcagtatgtgtttatcacattgccacagatcgatgatgtgggagatagtgaacaattggagacacctgagtgcctctgggggactcagtccttctgataacactgctgacgtgacctgcctcgagtctcactccattaagtacatgatgcatgatatttattttcattaaaaaactttgtgcagtgttttgagagcctgctgtgagtcagacactattctaggtcctgaggggtcagcgtttgccaaaacaaatcaggttcttgttctcaaagctgacataccagccagaagagacatacaacaaacacctaggcagagccttaacaagaagatacaggttgagtaccccttatctgaaatgcttaggactagaagtgttttagatttcagattctgaatatttgcatatatagaatgagatatcttggagatgaaatccaagtctacacaaacaattcatttatgttttatatataccttttccacacagtcttaaggcgattttatgtagtattttaaaacaattttatgcatgaaacaattttagctgcattttgactatgacccatcacatgaggtcggtcaggtgtggaatttttcacctgtggcatcatctcagctctcagagttttggattttggagcatttcagattttcagattagggatactcaacctatagctggtggtgctctgagggtaataaaccaggtgatgtgctagagagagacttgggtaggaatgttgtgccttaggtcaggtgggtggggcagggaaagccttgctcaggaggtgtctttgcagccagaataactgaataaaaaaagagaagctgccctgggagatctgagggagagcattctactgaaaggtttgccgtgaaaaagtaccaggagcggagagcatgccaatgtggtcattggccaggggttgggacagtagggggagatgagattgagggaccttgtgggccaacaaaaagccagtggaagaagtgttgtgatttgatttttattttagggctgtcactctggctggtgtgcagtgacgtttgtgaaggcatggaatgtggaatcagggaggtgacttagcaggctgctgttgcagtggcccaggtgggaaatgatccttgctgaaatgatagccagcagaaagtaagctctctgtctgcaccacaatgttatgccatgggctttgctcttgaagtcactaaatccccacaaaacaaccttatgagcggttgtcatgattttcccctttgacatatgaggaaactgagacctggtaaagctaagtaagttgtccatttttacgtggtttggaagtggctgaactgaggtttgaacccggtttattggctccagaactcagattcttcacccatgtcccataacggatgagatttcaaaatgatagtccagatctgtgcaagagcgtggctaggttgccagtggtttgggatcagcccagctggggagtgcttggaaactatgtcctggaacccaggtggtggcattgccagttttgggcaggggcttggagtacaagggtgtagaatcagggaaggcaggccaaatgccacttcggtgtccaggctttgttcttatgcatcccagtgtcagagaggcaggaactggtccttgctacctctgccctccccgtgctccaggtgttgggttgtaggggagaatgagacatttcttcttattttgttaactgatattttgcaaagaacttaacattaccttacctagaagttaaaaatggggaagcctgtggtcctctctgtacccccatgttttggaggatgtaagagttggtacacagtagtaatcaccaccacaggccatatgtgtgatatttcccatgtgccaagcactgggctgaggacctcattatgtgatcttctttagttttcacacaaactcatttagcacttgaattataattatggagattatacagcctgctcatggtgctggtttgagtctggactccagacctcggctttgtaactgagaaacggaggcctacgtgcattccttttctagctgtcttataaaacgttgtccttctcatggtgctcctgttgcccccacatctgcttcgttaatggtgcagtggcttttggaagatgggctgtctctttggatcaaagatcttaattcattatgtgaaatctcagttctcaagaacagtttgtataataactggagctttcacatgtcaacagataatacaagccagtatctggccctacctaggcatttttggggaccagctctaccagccatacagagtccactgtaagatccttaactgtctctatatgtggttctacacagggctgcaaaccaccctgccccacccaggggaggaggtggtgggaagacagtatcccctttgtttataaatatacttaatgcttacatgtggcagggggagagaaagagaaaaaaagtgagagagagagacagagagaaaacagtttttttccacaaaggcatcttggtatccaacagtcccgctaatatggacagttcatgtctcctgactttggtgtctcagataaactaaaagaatcttaagcatgatgaagaggttggaggaatgatttatgagaaaagatcaaaaggactgagtatagatagcagggcccgtgcaggctaaagacagacatggaaattctcaaccaataacttaaagaaatatatgctaaggaaggccaagactgacacagagagctctgagtagaaaatctgtgaaaacagtaagaagaagaccactgggatcccttcctgtctctgggacctgcaagtaggactgatacttgctttaaagacaaatatgagatatctgcctggatctgtataaagtaatgtttcaggggacttgatttgacctgagatatatctggtctgtgagataaagatacatgttgtggcaatgctctcctgctacatcaggaaaataagaaaaggcaacattgagacttttaagagtgactataatactctgagatatagctagctagaatagtctaaagatcatgaaaaattgctacaaggcttttagagaagtcagagggatgaatttttagatttttttactggttccccaacattaattgagctccacacacagtagaataaaagacatgaccttagcgttctagattttataatttggggagagaaaataagaaacaacacatgaaacaattaagttgcatatcaacaagtgtaaaatagcaagataaaaggcaggacctagatctggtgacggtgatttcagattccaagggggtttttacaatagagctttgactccatggcaaatttaaatacactatgaaattctcctaattaacatttcccttcttccttccaaatatcaaatttatggactctgagaaattcacataacacatatgccgatgctgcgttttctttctgcttgatccgttccagcttttattaagtttaatgcctgactttcattaatttatgaggagttgtgaactgcaatctgaaatgctcccctgaattttagagttttcttgcagggaaaatttcacgtgagctcatcctgacccttgctaatatttcagccaagcacatagtttattgtctaatgacctttcaaggcccttcagtgatgttggcacgtgctgtcatattctgagggtggtgcgcagctagtctttgtcagtgttgatttcattctgcctcatacctgatttatcaaacctgagagcccacagcatgcctaatttagcacatagttcctgtccccaaaatctaataaactcagaagtaataaattttctgggtttttgtgggtttgccctctgagctagggtagttaaaagttgcatttggcatgttttgtttaccatagcggctacggaaagtgcccttttcctttcttctgtgtcttctcatgggtttatagtaacagggaactgattctaggacatgaatcgttcagcttttggtcgttaacgctagatgtttctcatacacgagtccttctcatgcatagttatttgaagttaatatttcgcattggtgaccatgtattcttatgtctgggagcgcagacatcagactgctggactgtgtgtgaaatagcctacttgagatgtcatccctggggactacctaccccactgccaggacaaaagacttttgagacccaccttagagttcctttttggaaatgtatgccaataggatttttttttctttttttttttttttgagacagagtctcgctctgttgcccaggctggagtgcagtggcacaatctcggctcactgcaacctccacctcccaagttcaaccaattcttttgcctcagcctcccaagtagatgggattatgggcacgcgacaccacgccggctaatttttgtatttatagtagatacggtgtttcaccatattgctcaggctagtctcgaactcctgacctcaggtgatctgcctgcctgggcctcccaaagtgctaggattataggcaggagccaccacgcccagctaggatgttcttaatttttttttccttttggtaatggtgcagtcttgttcctttgatgccacactcctgctattaatcttcagattttctgaagtgtttctctcataatgagccaccaggtgagcaagactctaaggcacagtttttttttttttttctgctgctttctatccagagtattaagattctaattagaaactctattatgcagagcttgataggaaagctgtgattggccccactcctgaaaagagtcaggattcagtggggtgatgatgtagtgtcagccctcctgttctgtgaatttcctgatcccagtgtttggagggaactcggtgcaattaggagtgaggcctggagtctgactggttgagaagctccacaggctgcattgtctgggttttggaagtaaatgaacttggaggcatcggcaacactaatgcttgagtgtgttctgtcgtttacttgtcctcatttagctaatgatatctgagaccaaggtaaaatactgatttatttcagagttccttgtttcatttgaatgccaacctagttttgccaagagccaaagtagaaacagagttgttctaaggagtcataagtttgttttcttttcacttaagtaagctgatgatatgagagaatgtttttgtataagttttacttttattaaacaaattccattcttcaaagttaatttctaaaaaaaagtatttcttttaggaattaatattgaaggccttttggtgttctgaaattgtaggagagggttttggtgcagaggattatggtgttagtaacaatggaatatggtgatgtgcaaagatttgaagcaaatgattattgatagggtggtaggtgaagattacttgtgtttttttttttgagctcattttatgtttaaataccttttagggtcttttttccagtctcagtttaatgtttcctaagatgatgctctgctaaatgctttacaaaatcaacctgctcatgttggctcatttctgatcagtggtgtcagatttggttgaacaattggggctaattttctgaggatcccagaattgaatgacaattgtgaggctgtaagcctgtaatccactgagaggttataaagagatgttactagaattcttcctcagagtaatattccaaaattgggatgccaagccaggtagaagcaaagttttctccttgaaatggatttgaaaaagccaaactttttttttctatatgcgatgactatttgattattccaatattagtttgttgtttttctaggaaagatccagcaagaaagaaaccttgaagctctctttataatttaacattttttaccatatttgatgacaattatcatgtacaagttaacacatgctcattttaataaatcatgaagccggccgggcgcggtggctcacgcctgtaatcccagcactttgggaggtcaaggcgggcggatcaggaggtcaggagatcgagaccatcctggctaacatggtgaaaccccatctctactaaaaatacaaaaaattagccgggcgtagtggcgggcgcctgtagtcccagctactcgggaggctgaggcaggagaatggcgtgaacccaggaggcggagcttgcagtgagccgagattgaaccactgcactccagcctgggcgacagagcgagcctccatctcaaaaataaataaataaatgaataaataaataaataaataaataatgaagtcctgaagaccctggaatggaaagccacagtggtccatccttccttctccaaccctagtcccaggggcacttgtcactgtttttgttttagttcttttggtaaacaatcattacaactccagaatgtgcttatatttttatatcctgacatgtcaactctagatatttcttatgcaatatattgactttgaaatgagaaagttaatctttaatttttaatactctgccctcttctttcaatattgatattatattattacttgtatattgggtgcttttataactttaaagagtgttgtaagcttctctttcttttcctcatcagcttttcatagcaaaacgagtaagatgttaggtcccctgtgccatccacatctcatcttctggagccagcttttctattatagtgtcagggttgttaatatgtttgtggggtcttactatcataaccacatctgctatgtttttgtccatagattgatttttaaagttgaagatctagaaagcatctacagcattatggttgtggaaattctctgtgttgaaccagtagaatgttaagatcatacctaaccttctgtgttagtccagtttctaaattcttaaatcacccaatggcgatgtgtctagcattacgaacaagtgctttatctacacttactctttaattgctttcctacctatcatgttgctttttggtagttgatttagttttttccctattatttgtctttacaatagtcttacatccccccactccccaacctcccaaccatatcttttgcacttaagggaaagctcccttctttcctggccaattcattctcctgagaagtctgaacgaggaatctctagacatccctttgtgatcttctggattggaaccactgtttcctaggtcttacgacttcaactttgccattcctaatttattcctttattttattggaatacatcaagtaacttcccaacaacagtggaggcagaatttctgagtctttgtgtctgtgaaattctctttattctgcccttgctctttcctgatggtgtagttagaattctaacttaaaaggcttccctacaagatcttttaaggcatcactacattttctattaccatccaaagttgtagatgagaagtctgatgtctctttgatttgtattcctttgtagatggcttatttttttccttcctggaaacttttgggatctttttatccttagtggtttgaaagtatgtacctagatgtgttttaatttaatttttattttcattaattctgcccatcccttcatggaccatttgaatctgaagattcattcgttaactctatggatgatttctattctatctttaataattttatctgctgtgttttctcttttctttcttcccaaaattctacatagttgactgttagacctcctaggttacttctgtgtgtctcttctcttttctctgatatcctgtatgtctttgcttttggttctgtgctctgggaaatttccttgacttcatttttcattgctccacattatttttaactttttgcagtcataatcttaatttctaagaactttaagaaatcttttattgaaacttcttcttaacatcttgctcttgccttttgtatgtaatgctttctaaaaccttctaaaagtttcttccaaggttagtttttcttgttgatattggtcattctcattcctgtccttttttctcctcataaaacctagtgatccttgggtgtcattccccaaaaccgtggagaaggatagctggcctaatgttgttctgcttggcatatggaaacttggatggatggatggaacatcctgaccacgtgtatcagttggcaggatttcctttagggaaatagggtggagcttctccacatgccagaacgaagagggcttgattctggggagctataagaaccggtatggcttgggtaccaataagggtgtcacaccaacttgctgggaccaacactagaagttagagctggtgtgactcttgtggtgagtgcatttgtgtgatagacctgggtggaaacagggcttcaaaatccacgctgaagccttcactttcccaggaaagttcattctgttttttgaaaaagagtcataaaatttttatctggagaaatgccagctacctgtgctcatgtgctgtgggcaggagacaggccatctgactgtcacgggtgtgtccggtaaaagatctgcccagcccagggcttttttcttttttgttttttagatggagtctcggtctgtcgcccaggctggagtgcagtggcgcgatctcggctcaatgcaagctccgcctcccgggttcaagcagttctctgcctcagcctccctagtggctgagattacaggcgcccgccacctcacccagctaatttttttgtatttttggtagagacggggtttcaccatcttggccaggctggtcttgtactcctgacctcgtgatccccccgcctcggcctcccaaagtgctgggattacaggcgtgagccaccgcgcccaacccagcccatggcttcttaggtgaatcagctgccacctgtttctttgccctcttgaagaatatttcaggctgctgcttctctacgcaccatgtccacctataattccagtcttacccactatgcatcttgcagaaatgggttgaaattttttatcttaattttatgtatttctttgactgtgttaagagtttcacccatagacccagactgcctcagttcaaatcctaattctgccactcctaacaatgtgattatgggcaaattacttagcctttctgagcccccattttctcatatatacagtggggccgggagtagctctgacatcatgggttcgttttgaggattaaattacttaatataaataaagctcttagaagtgcctagcacagagtaagggcctggtaaattttattctttggtactgttattttatcattactacaaaacttacttccagtttttcatttcacagaagtctttggagggacaggtgagaaatatgtttgcccagcctgctatcttgaactggaaatgatggattaaatatgttgcatttctgctagactgcaatagtgtcagttaaacttaagacccaggcccacctctgccaccttctggcagtgtgaccttgagcaagttcttagatactggactggcttcctcatctctaaaatgggagtggaaatggcagccgcacagggtgataacaggaattaagggagataatttgttaagacccatggacttccattcctaccatcacctctctgatgtcttggttctcaccctaaaaaaaaaatactgacataccaaggacggctcatgggctgtctgactgacagtttttccctctgcacatttaagatctcttctgatgctgctgaatccttctttataactttcttacttttagtttttaagatgtattttattctccttatgattttacaaatttgagaagcctgaaaataaatgaatttaattctaaacttctacctaaaaactaggcatgtatcatattttatagaattacttacaaagattaaagaggcagctttccaaagacagtgatccaaaagccaaaaagtcttttgaaaatcttacttcttgctactggaagagctagtctttcatttcctgagaaaaatgtcactttttatttttttttaaccaaatggattaaaaacagtaacaaccatatccaactggtagtattcaatagaaatacatgataggttgatagaaatttaaatcaaataattgaattctggctaataccataacagacaattaaagtgggtgatgctgtcaaactgtgtcttaaattgagtgctcccttattacagactggctactcaggtaagtttttctccaaacatcttcctatatatgtatattttctttgattttatttttttattgcatattaagtctatttgaagatacttgattggcaccctgttttaaatttgtttccttccttttttctttttcttttttttttttttgagtcagggtcttgctctgtcgcccaggctggagtgtggtggctcgatcatggctcactgcaacttccgcctcctgcctcctgggttcaagcaatcctcctgcctcagcctcctgagtagctgggaccacaggcatgtgccaccacacctggctaataattttgtattttttttatagagatagagttttgccatgttgcccaggctggtctctaacccctgagctcaagcaatctgctgccttggcctcccaaagtgctgggattacaggcgacagccactgcaccaggccctacatttgtttcttaacatggttcattttaatgcctactgcattgtttaaaaatcatgaacttggagaaataaaaatacgctgtaaaacttaggttgctttaaaattggaaaagttattttcagtctgtcccaaacactactggagtttaaatattttaagttggcactgtattgaaataggctattccctcatagaaactggccctgtctaagaaatgggcatagtgaatcatggggatgcatgtgtgctgtttaaaggcaccacagtctgcaaacagttttgcaagtcagatctcattgagaagagggaagtgggtagatttatgagcttcaaatacatgctgcccacctcacatgaagtacatgtcagtgtgtttctttttcaaatcatgcatctctgaaaaatgtgtaatgggctgtggtgtcagagaaaaacatctttatcccagcttggatagaagagcatgaggcagtttgtctactgcaagcctgggatcagctctgaggtccgcttactgctgggcctctctggccgaagttaaaaaggcttgttaccagaaggagtgcctgcaatcaagagccatgtcagaagtgggaagataggctgtcattcagagaacaagactgtgtggttgaaagctggtgaaaaactgaaagctaaaaaaatccaaactgaaagagctggaatagccccagagttgaggaggccatatcgagtgtgggagtgtaaagtgtagatggttcaggggctggctgtggactgacgctcgtcattgggtttttctctggggttctcactcttttgggctggagacagccctgtaatccagaaacaggaaggccacagcttcccagccctttaggctgaccctcttctaataagtgggttttggaacccagaccaaagcccagagtagaagaatgttgtcatggtagctatagaattgctggtctatgtcaagtgaggtgtatacttttctgaaaattttaaatactgtgcagataaaacacaagaccatgatataagatagtgtggttatgtgacttcttgcaggatatatcatatggctgattttggtttcctttactcattgcttaccaggaaactcagattgttgtttccaggaaactcagattattagctgctcagttattccaactctattggattgcggcctgcatattctctcttaactttctctaggtcttgatcatctaaactgttctctgatcagatttttctttagttagcattttctaccttgtgaattcttgtatgctggctgaaatctttaatgaaatgaggcaaagtattaaaatcataccactctagatcacttgctgaggcatgttacaatttcactcagtatgagaaatagtcatataggtgagcgttgttaaagcaatgtgtgcagacagacttgtgtgacagaataagtggatgttgagaagtcttgtgttgaatgaatttgatcacagcagttttccttctcctcaaatgtcagaacttttcagagaaacacaggcactaccctttctcctggtatgatttggaaaagtcagtacctctagcctcttagaaaggtctcagagggaactgttttaccattcaggtttcaaacttttctcacctgcagtatatgtgtgttttaaatatttttctctctcatttttttaaaaaaattccttttaagttgaaccaggtttaaggatatttgtgtgctgctgttttttcaagccccaatgtgcagtgattttgtaagtaagttttaatatttcagtatttatatttgtattcctcctgtgaaaatatgtgattttattaatcgagttctgtatgatcattccttgtgtttttgagttatctcagacatgcagctttcctatcttggcgcccagctccatcgaaccccattgtacagagtttgcacgtaaatgccgtctatagttataccctcaaaaataagaggcttgtctcctgaggacagctctgtattatgggcagagtataatcctgaacattgtttttctttgctctcaaatggctggggacagtgagtcaggagtgagaactccctttgtttcatgtcgtgtgcatggcaggggaagaatgtcgcagggcagaaaatgaagaaagacataaaaggatctcagctcaaggaggtcagatccatcagaggcttagcgttgccttcaaagatgcctgggacaggtggcagttcaagacaatcacagtagtggtgtccgctggagccgagataagggattgccgtggaagcctgctatctgctgcccgtttgctttgatgtaactctgctagcaagacttgggggagcagatgactgccttcctccgtggtctgctgctgttgttcagccttttaaggtctcattacagtgctccttgaggattaatcctctttaaggtttacatgagatggttttgtccaagggcccagacagggaccttggcgccacctgtacaaggcaccatggcaggcttttctttccccttacctctccaagttgttggtacttacaaatacttgttagcgtgaggactgtaagcatgcagcaccctttgctgactcttgttgtgtttttgctattgtgcgagcaataccgttagcactaaattgtcagcttccacttcctcactctattctctgtcaactgtgtcccttttttgaaagaaaatctgctgtagcttggctgtagaagggattgttgagttcttttgacccattgtctttatgaaatatctatctgcataacttgcatctacctggaacacttcatcttaaaaatacattctttgagcgagcaaatcaaaccgctagattttattagacttgctattttaaataccatcatctaggaaaagaaaagtggcagattttatttctgacttttttcacacacacagcagcaccaatggcaacaactaaagcaaaaactatctcttgagtctcagaaataaactttgtcccgacactttgaatttttagttgaacaaagcatttcactgtcatttaaaatctctcaagtggcacttgaaggcaagcaagtcgggaactttgagaccagcatttgaatttggttccatgatactgtacttggctttccatacttggttggggacagagatgattctgagaattactaatagtacacggacgcttttcatcccttggtcagtggttcagggtaactttctgttgtcagcaactaaaaggtaattcacatccaactgactgcatttgctcagcttctccggtgttggtttggttctgtaggaagaggagcacttagaattaaaacgagtaccataactggtacacagtcccacaataagtgtcgtccacattttctgcaggtcagactctttacaaatttgaaataatctttaaaataacagcagaaacaagctaagctcctgtagtcagtttagtcagggaaaaagacatagtcatataggccacctgacattctacagataagcatgtgtttggcttctaaacttctgcaaaggattgttttgtggtgtgtttacattgattgacagttatcaaaaggaaaatcaccttttgagatggtctattttaagggtaactcctctccacccatgagtgagtaaataatggaaggcaagacaagacagtggggagaggcagctgcggtgggagagtcgaacaaagcagaatgatgactcggtgggcatcaggggccttgcctctgaaggtgactctttaaactgtagtaacagaaccaaccttgcgaatcttggtgtgaccatgtagcatcttggcttcgtgccagactcctgaatcagaattcctgagaactggatcttaggttctgtgtttttaacaagtttttaaacaatgaagtgtgagaaccactgcttttaaaggtcagatgtcaatctcaatttcttcaagttcccagttggtaagcacttacattttccgtcttaaaaagatcctgtacatttgcacagctagttgtggcacatcagaccattctttgaattacactttacttttggtaattacttaaaaataaaattgaatatttatgatgacatcaatttagtactttccccaataagtaaagatggaataccagttattttatgctatggagaatttttatttatttctcaagtgttgtgcctaaactgaattaacaacaagaagtaaggataatttgtataattacgtttttgtatctctgaatttccttttaggaaatagaaatatatacacccttgtatgcattttaatgcgtatgtattttggtgtgtactgtcaacaaaaatatagactttactaaatatgaaactgctctcatttgctagaaaaaccaccaagtttgtgaattagttttctatcattactctttggtcaagacactgcatgtcttttaaaggaaggtcttattgctgagattagcagattcaggatgtagaaatgttggttgagtgtaattctctctccggaaatgtgaaaatagagttactaattactggtgaaaaaagtgttggcctggtctgtccaattgtcccatcaaagtggaagatgttaatttaagggatgagtaacacatacttcagacatacgcatttgaaataaatgtcgataatggacttgccaattgattttaccgatatgaatgctaatattttgttagcacttgtgataaccataagaaaacagtagaggtgtagaatataataaaaagtttgaagtagtacaagttttgtaattaatattcagatttatccttttggacattttgatcgtaaggtctaaaagacactcttgcgtgttctagtaaaaatattctgcattcaataacttttcaccctgttcaggctctaggaaaatctgattatcagaaagctaggtgtcttttctgattcagcatttggtacagaggggattactacagctggttttccttattcagttttaccagctgattatcttttagaatatacttgacttgcacatgcttttaataaagaaaagataggtgctggtgacttggtttcttggaggaaaatcagatgtgattttggaattagaaaggacaggattctagtctcagccctttgctggctgacttgtgtaagtcacttaacccctcagcttccttcctgacaccaagtacctgcttcagatgattgtatgagggtcgagcatctggatccagacattgacatcctatatgcactttgtcatgagagcccatattggtatgaagctcttctctctcttaagtgattgaagtttgaatacctgaggcacagaacagtctagtttcctgttccaacaatatcacttctggccaatttgtggttatacctacagacctcatggttcttctctaataaaaatcataaaaaatctgattttatgtgattaggaggtgagggttttataactggaaagactgtgtgaaagctaggactttttcaataaaatacatatatataaaatataaattatatataatatatgacatatattaatatatataagcatgctatctgatttcctggtctggcttatttttatcaaatagcatttttcattttaatattcctctagggtctctaattcatttgtcttcatgtcacagacattgggagataacttgtttgcatgttctctgatttaaagttacaggtgtggaagcctgggaggtaatggccctcaagccaaggggagaggggattggctgccatctctgttgccagtctcagaaaccttccacttgttgtggctacttggtaccttttaattttaagatctggggcttatttattaccaatgctgaacttaagataaccagagttgctgtgctgagggacagagaagcacacactagcttctgttactgctctctggttttattctgatttaaaacaatagcagctggtattcaatgggtgcctactgcttaggtgggtgcactcctgatggagggggaggaggtggggacatgaggatcctgcatttctaagaagagcagacatacaaactggaagctgtcactccccagtttggtgcacccatccagatccttaagggacatcagatggaaggaaaagtaggcaaagaccaatgtggaagagagggcaggggcttgggaattctacatggagataatgttgtcagccatatatttaagcaggttgcaattaacaattgttgactaaaataacatacattggtatttcgtttctgttatttgctattttgggggcaggggcagtaggtaccgcttaccttcactgcaccaaacttttgcctatttgctttctagaccagcatttatcaacatgtggtcccaggacacgcagcatctgcatccccagggaacttgttagaaatggcacttcttgtgcaccttctctgtcttactgaatcagaaactcttgggctgggacccagcaatctgtgttaacaagctctttaggcaaagctgatgcagcgaaagtttgagaccattgtgttaaggagtattacgtagaacaatttgggtctgtcattaagaggggaacactgaggcaggtggggaggtgtgattcaagtcgaagagggaaagagagtcgtctgtctggtttcttctgaccttttgtcattggcaaattaaaacccaaagtagctgatggcacaggaatttagatgcaggagccagtgaacataatatctctttttggtggtggtttgtttaagtcattctcttattaagctgtaactttctgagcctgtcattttatatcccatgaacatgtgcctatttagcactcaggtttgcaggcggcaatccaagaataataacagaaattctatgggagaaaatgataattgttgatccccaaatactggattcatggaaacttatgaatgtagaaaaaaagttaagctttacaagattaaatcagaacagcatatctggagccatgttcatgcaccaattccaagttaagtaagaggcagtagccattcagagtatatgtctaatttcagcttcttccttatattctttgaaatactgttttgcccccttaatttaaagaaatgaaaagaaccaagcactttattcccctctacaagacatcaaggagagggggtaataaacagtacctcgccgatgcattttaataaatactggtttactgcatcccacaacggaaagcaaatacatgcaattacttgcaaatttcttcagtgtttgtacttataaatctctgcctaaaccttcccagctgggagttcagttagtctttctgctgtggaaccagggctttgttctcctgttcaacctcggcacaagctggaataattcagaaacgtattagagagattgctgctcccaaaaggcataaggaaataaccttcactcccggccttagagaaatcagcccaatcagagttcgggcagatttctcgattaaacaaagaactaactgtgcacaaattgcaccttaacaatttgtaaggtgtccaccttagaaatgtcttgcatatggaaagctgatattttttaatcagggcagtggggctgctaaagtcaaaatgtcgccagcattttcctaccactccacacaattatcatcccccgcaaattaaatttaaagttgcatccataagcagccctcagccttgagacccatggcaccgggttgtcaaatacagatggagacaactccctctataagtgcgagggtccagggcgtgtgtgcgtgtgtctgtgagtttgtgtggatgactcgattcatctggaacacatccccgggagttttgggctgtcaagttttatttcagcaaatttcacactgggaaccaaacagggggtagaaagttattgcacttaatgttgttgtgactttccttgcttctagtcaaattattcagaaatcaaagtcaggcccctgtgtcactgtggaatgttgtttagaatggaccttttaagagggatttagtagatttctgctgattgttaagagatgctcctgccaaaccgtcacccttgtggcatttttagaaaagtgactgtatttttctataggaaatctgggaatattttactttgtgtcagttctctatctgttctgtttgaggtacctttgctctttaatgcagggaagggacccagctgatataacaagcaggtactcccaagccttaatgcctagggtaagaacctcccaaaccccagcacttactttaagaagagagtgtacattacagctggtcttggtcacgtcattctggcctgaatttgacagtttcacattcttagtgtagcagaacaatcaagggtgctggcaaggatggtttgggatggttaagagcaaacagaaactatagcccctgggccccacagaaactctgagattccccacgtgattcaaaaaccggtcgaggaaaaacactgaaaattgctttcctcacatgttctttttggttttcttgttttgcttacatagaaatgtagacacaggacacattcattgacaagatccctttttctaatagaagtcggaatgaaagaatacagtgcgggagtcagaggcctcggcttcccttgttggtgtgctctgtcctgtccctccttcccttggctgagccttgtcacttgtaggtgagggaagctcctatcagccctgcctgcctcctacagccctggctgcctccaaggttgcaggaggcttatatggagagtggttgaaggagccttgctgaactgtgaaagggtcacccaaatggtgttcttcccttcatagttttgggtttcacgatgctgagtttgaaagagtttgaaagagttcgtttctctttcaaaacagtgatttgttgggttttgacccatagctatcccatgtacgttaggagctcttaaacagtggtgacagcctgtcattctatgcttactgtgtcaaatgagcaagttaagctggtgagaacttaaacttggaaatcagaaggccactgggccccctggctgcagcggaagtggtgtagtgtcaaggtgtcaagatgatcacgtcattctggcctgaatttgacagcttcacattcttagtgaagcagaacaatcaagggtgctggcaaggatggtttgggatgcttaagagcgaaaagaaactatggccccctgggccccacagaaactctgagattccccacgtgaatcaaaaaccaatctaagaaaaacactgaaaattgggggctaggggtctctagttgctgtgtgttagacttggtgtgattagaaggcccattttgagtcatggcactgccactttctagctcttcattttctctaaactttgtatccatcacctgaaaattgaggataagtatattgtcttttcagatctgctgtggagaattcagtgagaaaggaaataaaaactgcttagtccatagttaggactctgaactcaacgctgccatccgtggaaactatttgggacttaacatgcacattaagaaaataaaaaataatggaaaggtgaaaaagcccttgagtgtatttcattaagatgattaagctttaaaggggatgagaatatttgcaaacccgaagttggtattttgagcctccattaaaaagaaaaaaatccctgtatgaaaggcaaattcatcttatcttttcctgttaagtgtttgagagggccttctgacagctttggcccatcaagtatattctgataacttcacttgcagtgttagataatgaattttaccgtcagagtggacatttaattaactatggtgccgtccttccatggagacagcggcagctactcaagggccagcatctccctgaccacggaatctgcagtgatatgtagggtgggaaagcctcgagctgggttttctttcaaaatggcatttaaatgtacaccagatccacatttatcactttaatctaaactctactgtaaatgaacatgtatggcctctgagatcatacactttgctagaaggaggttcatgtgctggcagctcctgcctgaaacatcatttgttccattcccccagcaaaagcaggcatctaacaagtcaaaactattttcactaacgagtcctggcctcttttaaagctggagttctcaatgtcttctctcctgcacccatttcattgggtcagaatcgcacccatcagatgggaaagcttccccattaggaatgctcagtcattggtcatttttcttaaaactgagtcatggcaatgagtgtctaagtgacttgtcattctcaaaactgttcctaaaaggcgtctggtccttggtactgcaacatgtaaaacatgtaaaactacctgtcagacaggtgacagccttgtaaataaaggaccagaggcatataagggtgcacctaggtggtgcgaatgaaaacgttgctcaaagaggcatccaggaatccagagccctggcctttttgctggtatcatttccttctccttcccctaccactatcttttcttctctctcctccctcctgtccttctgaccaatctattgagtgaaatctcaacatcgcatattccttgacatagtaatttttgaaagccaacaccaaaagttagaattagtttaaagaactgggactcccacaaaatagggaattctgccataggttgagcgtttacctacaatttaaagtgtgcaccagcatgttgtagccttggccctgtccctggaggaaagacactgtttagttcacaagtgatatctgcgtatggctgaacattggtaaagggaggatgtagataactttgcagacttctgagaattgccgtaagtagctgagagggaaggaacttgaaaaggacaccctcggtcttatgagaccataataagaggtctcttatgagacctcttattaaattatggcgtgttaaaagtgatggagctttagctgtctgtgtttatggatcctattagtgttttgatacattttgtgttaatattcctgaaaacatacagtaagatgacctctgtaactgaggcaaacctaatttgatttggagaatgctttggccatctccggtaaccaatgctgtgccctcgtgcatcagaggtggtctgtctggcaatttttaagttgttcatataataaaaacaaatggatagattttacgaatgggttgaaaacagatccccacgtatttagaaaggggatggaaagctttaattcttttttttttttttttctttttgcagatctaaaacttggacctgatcctctgggtattaatgaagcttttcagtttatttagtttattcacccagtttcaaagggccaaaatttctgaggataagtgttgtttatgggttgagcatcctgcttctcccctctgtttcctgggtgaattttacccagcatccacatttcatcacataaattaaatcacatgagctcgtgtgctgctgttcaaaacgcagaggtttttaactcagcacttaaatagggagctgtacctgaaggcgggtcccataaaactgctcttctccacgtttgaatttgaatttttcatacatgtgacatgtttgggacctggtggcttctgtcaagataggtcttgcagaaatgtgtgtctcatgaaaagggtttgttggtgtttccactctgttgcttggaaagggtttctgtctggtcttggtgttgcccaggctgctctgtgagctgatgatgccctccctgttcatttgaggtactttcttcctcaggacttctgagggaaaacccaagacaacccacaacaatctctattttggtcttatttttaatatagccgtgggtagtatgacagttgttaacacttgccaccaaccccaaattatataatgtgctatgaaaataaaaatctctatgccaactccttcccactctcagaggggataagaaatcacggagagcataaaactgactctgcatacctgtgaccaccttaaaataacctcactctcaaaagaaattttgtttctctttcccaagcaactaactgccccactgtgtccctgctgtgtgcaagtttggccctttgggagacaaaaactcttagttgtagggaaataggtgtaggacctcagtgttacagggcacttaatagcagcccgggggcctgacagagttaatgtaacatccacgtcacctgaactatcaggagtttggtagaaaagaagagatgaattatattggcttccattcagagattgaaaatctgtggtaatttgaagtttccgaaaatgtaggaaaatgggctgggcacggtgggtacacctgtaatctcagcactttgggaggccgaggtgggcaggtcacttaaggtcaggagttccagaccagcctggccaatatggtgaaaccctgtctctactaaaaatacaaaaactagctgggcatggtggcagggcgcctgtagtcccagctactcaggaggctgaggcaggagaatcgcttgaacctgggacatggaagttgcagtgagctgagatcacaccactgcactccaacctgggagacagagcgagactccgtctcaaaaaaaaaaaaaaaaaaaaaaagtaggaaaattatttggggccaacacaagaaaaaggtttacatttttgtctcctaccctttttttcccttttctctcttcttatttcttcactattgcaaatgctctgttatttttaaaattatgcctctcctggtcggtgcggtggctcaagcctgtaagctcaatattttgggaggctgaggcaggcacattgcctgaggtcaggagtttgagatcagcctggctaacatggtgaaaccccctctctactaaaaatacaaaaattagctgagtgtggtagtgcatgcctgtagtcccaactactcaggaggctgaggcaggagaatcgcttgaacctgggaggcggaggttgcagtgagccgagatcacaccactgcactccagcctgggtgacagggcaagactccatctcacaaaacaaacaaacaaacaaacaaaaaactctccccgacctgcacacacatacatacctacaccactagatttctggaagagttaatacaggtatatactggcaaggagccagttgaccttagggttcttggaacttcacagcacagtgcggatgtgtcacttagcagtgactgaaggacacatttctttttcctaagcctctttaccctaataaccaattcaatccttcacacacacctgctattgagaaagcacttctgtatttctttttttttttcccaagccaaaccgtacctagctttataaaagatatgttccataagcaatcatcgtatttcaggcaggacatgggtagacagtcgttaacagtatacaacaactttcaaactcccttcttctatggactaccaataatcagaaagccaagataaaacccaataagtcttcatctgatgctctgaacagggtaagtttagagtgagggttgacatttcgcatttagcatgttgtttaacaacttttcacaagctgaccctgactttcaggaagtggaatgaaaatggcagaatttatctgaagatccacaatctagaaacggaaccactgctcttttgaggggtgccatctcattgccatcactggaaagtccagattgtgtgacacactggtaaccaatgactggggatcatgtcccaacagatgtctggctttaagggagttaagcctatgctgaaaggtggaaagggagaagaggacataaaatcaaatttgtttttccctcccacaaggtttttgtgccaaggtggacatgtgtatcaaagtcagggagtcccccctcctcctgggagccaagaggaagtctctcagaactagaagggaaagggaaaggtgttttccccacatcagtccagcttcagagacattctattagggacatatatcctgtcctccaaaaacaacaatgaagtgttctgtgtgctaacaacatagcttaaagtaaaacaaaattctgcatttttataaaacttgataaaaaatagtatttcaaactgtacagtcatcagaagtacacagttatcaaaaatgcagacacttcacttggcatctccagcaccttcagctttctgggcctggtcttttttggcaactccattttctgtagggttattcccctccttgccagcatcagcttttccctttttccctttgggtaccttctcaggggcctttttaggcttgctctggctttggaggagcaggtttagcagacaactttgtggatcttctctgtggttcatccttcaccttggcttcatctccttcagcatccccctcagcctttctcttgggcatgctggcaacaacagcgacgggacgtaggtgctgggcacaggatgtggtggtgtgcgggctttggtcggtccgggggtcgttctcgcctcttcttcttcacactgctccgtacttctgtatttcttactcaccagagatgcagacatcatacgagcatccctggcattccttgggctttatttatttttgagacagagtctcgctctgtcgcccaggctggagtgcagtggtgtgatctcggctcactgcagcctccacctttcaggttcaagcagttctcctgcctcagcctcccgagtgagtagctgggattacaggctcctgccaccatgctcggctaatttttgtatttttagtagagacagggtttcaccatgttggccaggctggtctcgaactcctgacctcaagtgatccgcccacctcggcctcccaaagtgatgggattacagatgtgagccactacacccggccctatttatttatttatttttaactgaatgtctcctctctcttgggcaggctgggatgcatgatctcatgtgggcacagtctcctggtgcccagatatgcacctctacagtggggatggcagtggtaccttcttcatagggagaacacgtttctagcccatagattcttctgacattcagtaaatgtcaggcatccttatagttattagttgaaagaatgttggttgggattagaagtatattatatttaatttaaaaaattttaatgttaattgttatgggaaataatgggcatatatatttatgaagtacaagtgatgttttgatacaggcatgcaatatgtaataatcacatcagagtaattgaggtatccatctcaagtatttatcatttctttgtgttaggaacattctaattccacccttttcgttatttaaaatatataataagttattgttcactgtagtcaccctgttttgctatcaaatactagatcttattcattctatctagctgtgtttttgctcccataaccatagaactatattctgtggtcatataaccaaataaagctaagtaggtcactgaacagttgagcccaaatcttgttcctcatcaactgaagatacctggctggcttcctgcttataataacagtggacacagtcttctggggcccagatatgcacagtgaggcataatgcatttggagaaaaagcgttggtttccagaaagagtccatgatattatcatagacggcagatgaaattcctgtcatgcagtgaatagtggggtaaaatctcccctgtcattgtttgtgggagtcttcagcatctggcacacttttttgtccttcacaagctctgtgtctgtctttactggttccattttctattattcctcttcttgggctcctatttcctggatgtccagggctttacaccctggagctaagcactagggtggccactttctggatcttgctttaacattccccataccgggtgcactgctcacaatgggtcatctagtgtttttccagcttacccgcaatgctcatgatcacgttacagactgtgcaaacctaagccatcccacctggtttctgtgctccttttcctggactaaagagagcgagctgaggaaagaacagagctaggtgagctagctggtagaaaaggtgcttagcttcagggaagcttaagtgctctagaactttatttcttgttgctgtgtctcatgcacctgatattggctatttgaaacattttctaccttcctcaggcctgctctcctgcctttggcccatagaaaatgacacagtttcttgaagtatcacctccattctattcctggtgtcctgttcatgtctgggctgtggtaatggccttcagactttctgttctccagtctgtccttcatactgctgccttgttaatcttcttgaaatgcccccaagattaccttcctgctcagaccatagctactcactgacaacaccgtccagaccccttgatctgaccccttgagctaccttgcaacttggcacctatgagaacactctcacactgctgaacttgcctcacctgagcagatcttatgctgtagttcgctggtactcatatccgatcccagcactctgcatgcatgccttgccccttgttttcggcctcagtccagtctcactcttggcaggagactttctggcaaaacttagtgtggataagggttgatagactatgcaagttgttatttacttattatttatttcagccaaccctgtagtaagtccttaataatctttaatactgcttttcctactctggtagtaattatagaagaagattgaggcttacagaagatgaatagccttccagagtttgcatctctagtggtagagttgggattcaaacccaagtttgactggtttccaaagctcgtgctgttctggactcttgtcgttctcaaaccaccacaggctcatgtgccaccaaccagagctgggagccattttgcactgggtgtctactgtccttggggcagacaatcactgaataagttgatgttgcttttcaggaacccatttactaaaagaaacaaaatgtgtcggttccattatttattcatttaattgcaaatccctccttttccctctatcatttaaagttagtatgtgctctactttaattaaaaataatattttggaaataacttaaaaacagcttaagataattgcaacactgtggtattcacaaaaccaagtgttggcttcctgtgttttgtagatgctgtgcagggcatgtgtttttgacctctgttctgaattaccgggtttattatggctttctcttcacaccgtgggcttgtcctttcttggacttaccatggttttaaagtaggtgattgtatgtggaaataacgaatgtccacttccgttgcctgtgctgctgacacggcctcttgaatgcctagcatgatgcagacacataataggcatccaaccaatcagtatctgttgaagtttgaatgaatgaatgaatgaaaatatgaatgaatggagatgcacctttatttgggtatcctatgctggatttttagaaaagttggttgtaaaaggaatttttaaaattgaattctactataaaactgaaaattaatttatttgtatggagatactaacaataaattttggaaacatttgaagaaaggaataagacagaggttggttcctctgtctttttgttacacagaattttttgtgagattcttccacttactaccccattttttcttggcattatctgtggccgccttcaggcatcagtcatgattcttgctgttataataaaacaaagccttatataagaaagatatgcatattcctgacacttaattccattcacagaaaagtaatgcttggttttctataaaaaaagtatcctaaagaggtatagccagcatccgtagcaaagtaatccataacttactgttttcttggtcagtgttccttcctgtcaggcaaagttaaaatctttcttttgcaagtggaaaagccgacgttcataactgctgctgattgtgcccattttagagcaggatgtttccctctgccaggaagatgtccagttccagggtatggaatttgtctttgtcagtaggcgtctcttcatcttatttgttgattcttcattgttctgaaacctctcgtcccagaggttagcttcagttccgggaaaacaaggttttccaaataaagtccacttctgctctgccgtgtttcattcgttattttcactgtcagctcagaatgctcaactggaaaatgccagtgccctgctggtttttctgtagtcctctcactttctgattgtgtggcttcaagggcaggacattatgctctcattcattacagtctctaggccactttcctcccaaggctttctggtgcatatcagccaaaacatcagcaatatcttattatagcccatggggtttgtgtgggacttaaatttcctgaggtgccagacttccaggaattctactttccaaaacatggggttgcctgtcagtgaaagcaatgtctttctttatccagctcttggctgccctgtagtgactgtgatgaaccgcagatttgttcatggatgctggcagttaacttagttttgtaggaggggttggattaaagcaaggtgcctttatttagctgggaaaacaaaagattgtagggggccatggttaaatgtctaccagtacttaaagagctatcgcatagaaaagcaattacacttaatgtaggtggcgtcagaatgcagcgctaagatgcattgatgggctgggcaaaagttagagggaggccagtgtggtggggtggaggggacaggatttcttgtgcatagagcagtgtgaaaggagggtgatggcgtcagacttccagttctcagagacaggggtgggagggtgtttcaggttaggctggatgactgctggtggagggtgggatggggacgtcgtgcaaaggattcttgcaagggatggttgcaatagataaatagataatttaaaaagatgccttccagctctgaaatcccatggttttattatgctaaggtaagccattttagggcagcttcactcttttcctttccctttctctttctttttccctctgtaattgtggaatctatttgtgtgtgtggcttatgctaaagaagtcttaatcatgtattatttcctatcctcttactttgaaatggtcagacttctagctgagttgtgtttgggcactgtagagggaggcagggtgtctgtgtacagttgtgctgggtgtttactgcacaaaggacagaaataaggggctaaacttgaacacatactctgctcaccaagctacccagaggaagagtctatctttccagtttgcggaaagcgccatcagctcaccaagctgagtgccagaggggctaggtctccccagaagaggcatagttttctaatctgttagattagaggtttctagtctaatctgaagatgctggtcatgactctagagggaggcataacatatcatttttaatttatcaggattgacaaagttaagtctagacacatctgtgaattccgtggtgggctgtacaaacacagtgctaactattgctactaacggtgcaaagttccattaagcatccacgtatttctgcggactcaccaagcattcaggtccttggaagcatctggaggatttgctcaagttttcacttttcatctggatatttgacattgtgtgcacacagctctgtgcattctccttctagcccaggagattccttttgactcttccattcaccctcaatcctcaggggcaataaatttggttgaaaagcagttgaggatttatgaatgtgaggcacataaaacccctttggattctcagacttacactaaacaaacttgtgagtgtgccagtgaagaggaaaaagtttaaaaaatccagcacgccaccggcaaggttggttattttttaaaacaacaacaacagtaaacaaaatggaaacaaaacacaggtcgcgttgctgatagcaggcagcagttctttgagcaggcgtgaagagatgcagagattgctgtgcatttgtgaagtgtccccagagacagattccttaagcctttctccaccctctggccttgtcactgttcctccctcctctggaatgtggaggaaatactccccacccatccattcacaaaaaccctggaagagagccaccttccctccacttttctcatctgccagctcctgctctgttctctggcccctctgcatcgcctgccctcagtgccattctcagtcagcaagggcagaactctcgctgtcccctgccttcagtgtcagccctgtgactgttgtcctgcgacctgtttcttatgcccaaataccctcagtcgcctgagttgaatacactccgtgcttctgtgcaagttcatgagttggtgccatttctttttagctaccctgatgcttttgtgtttctgttttttgtttgtttgtttgtttgttttccctttgagacagggtcactgtcgcccaggctggagtgcagcggtgtgatctcggctcacgcagccccgacctcccgggctcaaggggtccttccacttcagcctcctgagtagctgggactacagacttgcaccttcacacctggctaattattttattttattttattttattttgagcagagacagggtcttgctgtgttgcccaggctggtctcaaactcctgggctcaagcagtttgccagcctcggcctcccaaaatgcgaggattacaggtgtgagccgccacacctgacacaattttgtgttccatttctctctttggaaatcttcacagtctttaattactacaaatcagtagttcccacattgttggcagtaagaaatggaaaaaatatccgccctccccaccgccccctcccctccaaaaaaatactgtggggcagataccaacatagggataccagatatttgtccaaatatgggcatggcagggctggggtaagttgggacactggaaaatagcaaacaattcccagagcattctctgctgtcattaccatttcacaacacaaaggctgttttcacaccacgaagtaggaagaacagattattgagcagaggacattctttgaaaatgagtaactttagctgtgtgaaacattcatcacttcaatccttcttgttctcattttgtgtctatttattccatataattatagatttccaaccagtatgtagaggccactgctgcaaatgattctaaaagaaggagctcttctgtccagcagcaaaacaaatacagagcccaccagggaggcccaccttacctgggcaggaagctaccagatgccttggcaggagcccgtccttgctcatgtggccataagatctgttgtgactagggttcctattgcagctggagggacacagagattaggagcaccttgcagcctagatttctgcaggagcaagaggggtgggcattggaccctgaggccttaggctggggacagcacagttctgagggccaggtgctgagtgggtgtctgtgagcatgctcagcctctgggctgtgctctcagaggacgtgcagatatcagacatttacagtgagcagcatggaaactgcgggctgcatgaggatgcctgttggacggtgaggccaggctgcccaattacggaacatgctggaactgctggggagatggaggccagaaaacacatgcttcttcctgcttgcccggctgctccacccctgcctcttttggcttttatactttccagcctgcttggccaaaaaccaaatgcaaaaaggatgagagaaacctttaggggctaaaaggaaggttcatcattgaggtatgtactgagaaatttgatttcctggtggggtgtctgggccccttggataagcggatgtacctcgggcgtgacctcacaccccgctcattaaaatcagtcttatgtgactgcagacgtggaggtgcttgtttacgagagacagagctgcctctttgcttgaggaaaattgatttccattcaacagatgtgtatggagagctggttcccccgaggctagcactggacacacacagtctattaaggcccagccctaagtgggaggattcacaccttgcagattctgctgtttgcttgatgaagtggaactaaagaatgctgtttttaaattcagatgtacatttcctgaaaagattttctatcatctgtgattaacttaagtacatattatcttctttttaaatctttccctgattttctttctccttccccacggcgtcatcctatctccccatctctcattttcctcttacttcctttcgcttctcgcttttctctctatgccagtgcattttctttttcatggagttttgcttttatttagagtaatttttataaatatttgaaactaaatttatgcttctcagaaacaagattctttctgaaaacatactttgggtgataaagatgtaatctgcttccaaatctttccaaatctgggtgtaaattatgaaacagaaaaaaaaagaagcagccatttagtacctgattatcagtccacatcaagccaagttcagtgtgccttcctgaatttgcccacttgaattcagggcacacagtagcaggcacatgtcagaccaggagttagaaacacacggcttcaggactggccatgaaggacccagggcagattatttattctgtttgaaccccagtttcctcacctgtaaaatgaaggcaatttcacagtgtttctttggataaattcagataataattatcaaagttcctggcagtatcacagtcttaatctgttcaggctgctgtaacaaaataccataaatggagtggcctataaacagtagaaatttatttctcacagttctggagactgagaagtctcagatcaaggtgccagcagatttgttgtctgatgaggacctgtcttctggttcatagatggccttcttctcactgtgtcctcacgtggtggaacggccaataggttctctggggcctctttaaaaggaaccccattcataagggctccacccttatgaacacctcccagttgccatactgccaaataccattacattggggattagagttcaatatgtgaattttagaagaatatattcagtctatagcaatgttgtaactttaaatgtttccctgaatcaatccatctttaaaccttttttaagccaagagtttgaatctcagaaatgtgtgtttattaaatgatgatttcataatctcacacccattacacatagtaatctcaggagtggttcattgattcagtaaatatttggaaatgcctactttatgccagattccttgctgtgtttatgggattcaaagattagtaagacatttttcccgccctgcctgtttacccactgtagagatgggaagtgggaaatgctagagcggatgtgtgaacaaggctggagggtgcagatgtcagggcgtcttcacaggagactgaactgggtactgaaggatgttgggtacgcagtatgtctaggtaggttttacgtgatgcattatcttcttttctgacaacatctttaatttagactaatgttgacttttggagaagtgaagttcaggattttactgaagatgatagattcctaactactggcctaactgtctggcaccattttatttttcaatgctttcatcttcttcaagtggagaccgtaagtatgctcatatacttgtacagggcaccaaacaaagcacatcgtcctcagagatacagtgaacagtcaaggaaagagatgcacagtgaatactagaaagtcagctggcccctcacgtgacacccacatgcctaacatcatcatcagcaccatcattactattgttctcacttcttttattaactctgttattatttatggttcatggtaatgcattatcagattgtagcacttttatttctaccttttcctcttttctgagtctcttcacatgccaatctacatctgaagcttgagagacagatttagggccccatcctgactccttatcttgggttatcttgggtgctcttggataggtgatttagtgtctttatgcctcagtgttcgcagctgagaaatgaggattcagatatctacgtcactggaatgtgaaaaggactgggtgaggtcatgtgtgttaagcatagcacttggccaaagtgtaatagctgaagaaatagttgcagagaggttccctaagtatcttggagaatcagttatcttggttccccaattacatagtgagctgctttcagaacttgaatcaaagccacagtcttttgcctcctagtcctgcttttttttttaataagatacatttgatctttgaatcatgtcactgtataaatcggagattggataaaaagttcagctatttatggcactgtggggggtttaaggacatgtgtacaagtttttgatactcctgccctcaggaggtgggacttccttcctctttccttaatgacttacttccagtgaagtgatgggatggcacttctaaaattagattacaaaaggactgtgactcaggtggctctcttgccctccctcttgaatccctcactctggggtggacagtggccatgccatgaggacactcagctggtggagaggctgtatggggaggagccaagtctggaaacatactctcccccagtcaggccttgaggtgactgcagcctcctgagagaccctcagccggagccactcagctaagccgcttccggattctctaccctccaaaagtgtgagttagtacatgttcactattttcacctgctacatggaaggtcaattgtgattaactcagcatctatctgcagaatggagttcaaagcgtcttaagctttgagtttgctgtatgttataatatgccacaattaggcatttctgcgccagtgtgaccggcgaactgagatggcactcccatatccttgtattcagggggttgttaaagacaaaagtttcaaatgaccctgcttgacttagggacaagccggagcaggattgctgttcacctgcagttcagctcaccatgtctgagccttagataatttacgtcttatagcagaaacatttagaatcataaatgttctaatcctaggcatgggaagagatttggtgtaacttgcctggtgaggcactgaagcccaagaagttaagtgcacacccagcctgtacagctgctcggtggctgggctgttgaggttttcctcctgcatcagccagggctattgggttacatgcaacagaaactgattccaacccttgcaccaacaggaattgctgggatgacatagaattgtcttaaaattgtcagaaaatctcgagaagcaggtgctgtagaggcataggaagcaggcgtgagagtctccctgggggaatgagctctgactgcttctccttcccccaactcaggctcaggactcaggctttcagcagaggccgtctgctatcagagccaggtaccctggctgtcttgggcagtgaggctcatggattttttaaaaaaatgattcctcagggatctagaactagaaataccatttgacccagccatcccattactgggtatatacccaaaggactataaatcatgctgctataaagacacatgcacacgtatgtttacagcggcattattcacaatagcaaagacttggaaccaacccaaatgtccaacaatgatagactggattaagaaaatgtggcacatatacaccatggtatactatgcagccataaaaaatgatgagttcatgtcctttgtagggacatggatgaaattggaaaccatcattctcagtaaactattgcaagaacaaaaaaccaaacaccgcatattctcactcataggtgggaattgaacaatgagatcacatggacacaggaaggggaacatcacactctggggactgttgtggggtgggagagggtggagggatagcattgggagatatacctaatgctagatgacgagttagtgggtgcagcacaccagcatggtacatgtatatgtatgtaactaacctgcacaatgtgcacatgtaccctaaaacttaaagtataataataataaaataaataaataaataaataaaaagatactagcaaacgaaattcagcagcatattaaagcaattatacatttaaaaaaaaaaattgagacagagtcttgctttgtcgcccaagctggactgcagtggtgccaacatggctcactgcagcctccacctcccgggctcaagcaatcctactgcctcagcctcatgagtagctggaaccagaggtgtatgccaccatacctggctaatttaaagaaaaaaaaaattgtagagaccaggtcttgacgtgttgtccagggtggtctcgaactcttggactcaagcagttctcccacctcagcctcccaaagtgctgggattacaggcgggagccaccacgccagtcctggattttttatttatcaccccagaatgcctaaatacagtaggagagaagttaattctgcaaaggaaatcagagttctgtgggaagaaggaatagatgcttcacagccagaaaatgacgatgggcatactgcacatgctttcctcttctcagctcttctgagggttgttaggttctttgtttcttgtcaatatttactgctactcctactcacaggagaagagaatgtagcctcttcaaaagtcactggtatagggcggccttcccaaaacaaaattgtaaggaaacccaggtgtgtatgtttgctagcactgccagaacaaggtaccacagactgggggctcaaaacaacagaaatttattatctgtcagttctggaagctgaaagtccaaaatcaaggtattggtagggccatcctccctctgaaatcttaagggaggatccttccttgcctcttccagcttctggaagccccaggcaattcttgtctcatggcagcatcactctctgcctctcttccatggctgtcttcctgtggtgtgtctgtgtacaaacccccaccccctcttctttttcttggaaagagtcttgctctgtcacccacactggagtgcagtggtgcaatctcagctcactgaaaccttcgccccctggcttcaagtgatcctgccacctcagcctcccaagtaggtgggactacaggcgtgcaccaccacacctggctatttttttttttttttatgtttgtagagacggggttttaccatgttgcagaggttagtctgaaactcctgagctcaatcgatctgcctagtttggcctcccaaagtgctgggattactggtgtgagccaccacgcccagccacagatcccctcttataaagacactaggagtattgatttagggcccatcctaatgacctcatctaacctgattgcttctgcaaagccctatttccaaatatggtcacatttacatataccagatgtgagggtttcaacatatcttttaaagggacacagttcaacccactgcaccaggcagctgtggcttcctccttccacagcatagaaggtggccacatgctgctggactttcacagtcacagtccctttatctgtgctttggctgcaccgggcagctcccaagtctttgttttcagctccgtgagaaaatactggggttgggagtgggagacactggtattgattgacttggcatgttaactacccacttgctatgagaaagctgcctgtgtttagacttgaagaggatgacacagactttataaacacattatccaatgagcagctcttcattacaaagacatgttgatgctggttacagagaaagagagtggattggcactaacgtgcccgtgatcctcatggagagaaaatactttggcatgtgcatgctgtcacagagacttctagaatgtcagactgtttcgaaagtgtgttttgtcttatatttaaaatatcatggccagatgcagtggatcatgcctgtaatcccagcactttgggaggccaatgtgggaggatcacttgaggccacaagtacgggaccagcctgggcaacatagcaagactctgtctctacaaataattttttttaaattagtgaggtgtggtgagtgcctgtcatcccagctactcaggagaatcacttgagttcgggaggtcgcagctgcagtgagctgtgatcgcacctctgcactccagcctgggcaacagagtgagaccctgtctctaaaaataactaactaaactaacatatctctaaaaataattaaataaatataatatgttcattgcacaaaaatttaaagttacagaaaaaaacaaatctagtaaattacaaatatgtttactgttaacgaaaaaagcctgttaagtatgctctatttcaattatttcatgtattgattgaatgagtcattggttggttggtggattgcttttcagttataaaaacaatgtgtatgggagatggtgtcgaattcaaaggaagtaatcactcaaagtgagcattattgggagaatgtgaaaccttggcttgcatatgtatttcctaacccgaagttttggccttaagctgatcaaacatgtcaagttactatcaatgtagcaactggttgctctgaaaatggcatgtccagggatccctatgtggatagtggggaagagggcggagcatgaagtccctgggcagaactcactcagccttggtaaattgtactccttgatatcaccaccctctccttggcacgggggagcaggcaggggatagagccactctcagggcagatgtatccctggatgaatggcgacagctcttccttttggatgccccactgttaggatcacccacaagggtcccctcttctacccacgcaagcttatgtatttcagcctcaaaacactctgagagaataaataggaattgggttgtgatatttgcgacctatcctctctgtacccaagcaggataaagagagttctatactgggcccattttatttccgttttctcttggggtagctgaaaaatctgacccaatggggaataagggacatttgtaattggggtgaaaagcattgctagaaatgaggcattgtggtagtcccaaatgatagggtggaagatagcctaaattgacacagcactttccagcttgtaaagcatatttataaacacgatcttattttggtttggattcctaaaatgaccagtaggtttatatggtaggttttacacctgagaaaatggatgttcagagatatggagtcatgtgtacaaggttattctggggaactgcctcagagccctctgctgtacatcgaataggagccccatgaaacagaaacacatcacctccctgatcctataggtgaggaaactgggactcaaaaacttcaagagggaaggcccctgaggtttttttttggaaatggctgacatggggctaaaatgtagagcatctttttccgttagcgtgggtcagtttttagtacattacacagagacagagagatggggataaaaacaaacttttctatggtctaataatgagaatttgttcagcgtgtgatgaggagggcatgtgcaagtacatccacattgattcctgccttcccacagccactgagcactcttcttcacgtgtcgtttctctctgtggtcatacctgcaggctgtggaaaataaatctgctttagggagtcaaggctgtggctttaggtcctcactcttccacttttcaactgtgagtcattgggcttattgcttaacctctctgagcataatctgatccgcaaagaggagataatatcatatgcctcctgggattgtcatgggatttgaataaggccagtaagttctcagaaatgggctaggcacacaggaagcagctggtagatgattttccctccctggtatgtctggtatagaacatataccctgacatctgtccactaggggtgtcgtagaaggacatggcctgagcagaactgaggcccttgaaggttgtcatggagaggaacgtaggctcataaagccaagttctgcagaattacacgtttactcacttcaggacagagaaaatggcatgataatttttaaaaagttattttttcttctttcaaaggacaaaggcttgagagagacattttgttaaattttagatcagtaaatgctgtttgccaagtaatgtctaagagaggggatcctggccatttccatggacacgagagcccctgctgggtcccgtgctcctggcaggctgctggtgtccaggggaaggggggctcccggggtaggccccaggcatcacctgcgtctccctccagcatctcccctcgtgcttaaccagagcctgggccagggcctgtgaggctgagaccgtctggggtctgatgcctgctgcttcctgtctcacatctcccgccccctgcccctccatcttccagggggagcgactgtctctaatagggtggctgtgacagatgctgtgggaattctgagtttgggataatgagctgtcatatgtcatttcacttaaacacaataatacaaatattttgatcaaacattttctccagctgttgaacgaaagcaataaaagcagcagggagtgccagtgaattctctgtttctgaaacgctttaccctttaaaagctgttgcctgttaactccttctatctctgtctgtctcctttccctctccttttcctggcctctctgatttcccactgcatgcctagtctggggctataaataaagaggctgaattcagggatgtgaagggggtgaaattgagcacagctttttattaaacatcccttaggctggccgcagagcaaccgcagctgctgtgaacttgtaaaacctggcttggcctggccactgcagcacagcctccaagtgtttccccaaccctcacaatcacatccaacttttaggcaacagtcttttgagataacctatctttgatggcaccaggcccttggagctctgtggctggagtctggtttcatggctgatttccatggcagagttctctgggcccttgctgcttactctccatgctctgacctggcttctggaatctcttccttccccctctccaggcagagagggatgtggctgctccaggcaaagtggagggtcaggagtctgaagggaccctgaacacccgctcttggaggatcttagcagttctccttgccagtgggcagcaaaggtgtgaccgctttgaatgcgtccttcaggctgaaactcccaagaggaatgccctgtaccctgctccccttttaaaccatgacctctgactcagcaatgctaccaagtttgaagtttctcccgtgagcctgctgtttaggggtgggaccagatcaggtgctttacttgacactggacactctttaaagccagcccgttcctgtactctcccatccctctcctttatttctggggaagcgagtttgagctaacctgcgtcctattctggattctagggaccctgactccatcggtactctcctttctcacttcattcttcctccacttcggtggctccagtgccttccacccataaacaaacagagtcaaaacatccacacagcacttctggccttgggtcttctctagctgctgccctgtcttctctatttgcagccgaacatcccggagtgcaccacagtgttcaccctggcttctccacccgtcagctccctgcagtgcacacaccctggctccggaagctgtgcatcttgcctgaaactgcctcctccctctggccccttggaggcccctgactggtggttgtcctgtgtctctcctatttcctccttgcacaactctgcttcctcccctcatcccttaactgccagcctccctccaggtttcctcttcctgtaccttccctggagatatcactaactctgatgtcaccatccactcctgtgatcgcctctcccgcctccatctccaggctagacgtggctctcaaatcccagatccacctccctccagacatctaccaggagcctggctgtggtggtcacctcaaaccccacctgtctcaggctgaatccatgctttctcctccctcctcttgtgtcctctcctgcttccttctctgttgctgccttggtcccaggaccatcattaacactcacctgggccagaaccttagagtcagcccaccttccatctttctcttctcacccatctcctgtgtcctttacttctgcttctcccagagcccctcctccatcccattcatttcccttccactgccctgccttggttttttgagtctttacatctcttgttctccaccttcatttcattccactccaacccattctccatgttaccaccaaagtaatacttccaaaagatgtgtttgatcattccagtctcctgctgagccttccgtgctctcttgcatggtgtaggagccctgaacaggcctggcctcatcttcttgcacgcttccgtggttcccggagggtctccagcagcagcagcctcatctgggagcttactaggaatgcaaattctcaggctccaccccaggcctactgagtcagaaactgctggggtggagcctagcagtcttcattgtaacaagctctgcaggaacttggaggcaaggtcaagttggaggaccgatgctggaaagcaacactgagctgcttaggagtcaccaagcacgcccttgcccccgagcaggctgtgcttgtctgtggtgtcttttctccacactcctggtcacctttctgagcaaggcttttcctcaaggagaggaggttcctctggccctcatccttcccctacctagtcctctgcccactgctccctcatgtgcggtctttggacctgggatgcttttgagctgttgtgcttgtgggtggctttgtgactcctcagtccacgtgcttccttcccctctggggctccttggagcaactggcttattaggcttttgggaatccgtggggcctggtacctggcagtgctgcttagatctgcagagtgaattgtctttttttttaattaattttttttttttgacacagagtctcactttgtcacccaggctggagtgcagtggcttaatcttggctcactgcaacctctgcctcccagattcaagcaattctcctgcctcagcctctcgggtagctgggattacaggtgcccaccaccatgccctatttttttgtatttttagtagagatggggtttcgacatgttggccaggctggtctcgaactcctgacctcaagtgatccacctgcctcagcctcccaaagtgctgggattacaggcgcccaccaccatgccctaattttttgtatttttagtagagacggggttttaccatgttgtccaggctggtcttgaactccggacctcaagtgatccacctgcctcagcctcccaaagtgctgggattacaggtgtgagccaccacaccctgtctagtgaattggttttgacttgttcctgtattcagcaactacttactgaatcctgaggtgttaggactgaagcagcacagaacagaattcgtggttctaattgtcctgtctaaactttaagagtcagcatcgttgaagagctaagaacagctgagtatcaacccagcaatgatttgaagggcgggcagtgcaagggagatagtgaccttgagggaaatactgtgactccttcctgaaacttcctttaaaccccaagacccttcttgggcactggcctctcctcatctcctgcttgacttttgcgcccttcctctctgtttccttagtaggataatgcagaatgaaagtcaatttttggtatcttttttctgcattgaagaagggagttggactttagcactcagtcctgagtttatttggggagtgtggccctttcctgattttcacttcctgaggacctctggctttggataaagaaacagtgtttattctttggggacaaagatttttctgaaagctcccatacaggagtgttctctagctcttaagattccccattaatgtgtttgtttttccttttgtaaatttgttacattagcatttaattactcttcatgacagtattaaatttcatgagtgatttatagtgatttatagttataatagagacttgtatgatttattacagttggcatttgaggtttaccaaattcttaagagccataagcactgaaattgcttaatctgaccctgtccagaacaaccacagcatgtgtgaaaacccaaatttaagtataataggaacagctgcaccacccaccccatttttatttgatgttactgtctacgattgtggtaaccgtatatatgggggacagtggtggtgagtatatgtgtttcttatgtagaaaagagaagggaaccttttttttttttttttttgagacattgttttgctgttgttgcccaggctggagtgcaatagggcgatctcagctcactgcaaccgccgcctcccgggttcaagtgattctcctgcctcagcctcccgactagctgggattacaggcatgtgccaccacacccggctaattttgtatttttagtagagacggggtttctccatgttggacaggctggtctcgaactcctgacctcaggtgatttgcccatgctgggcgcccttctgtttttaaaaacaagatcctggccaggcgcggtggctcatgcctgtaatcccagcactctgggaggccgaggcaggtggatcacctgaggtcagaagtttgaaaccagcctggtcaacatggtgaaacctcgtctctggtaaaaatgcaaaaattagccaggcgtggtggcgggtgtctgtaatcccagttactcaggaggctgaggcaggagaattgcttgaactccagagacggaggttgcagtgagctgagatcgcaccactgcactccagcctgggcaacagagcaagactccgtctctataaatacataaatacataaataaataaataaataaataaataaaatgaaataaaataaaagatgagccccaaatcctgtgccctggatggataggtataacctgtcatctgttggtcaactgaagagctgactctggtgcgttcctcctgtggttctgagataaaagccggggcagtgcggtgcccactggactgagagtcggggcttgcctgctgtgcgacagatggcttcaaacctcaatgggcagctgaccctgcctcagggtctctcgcaaagaagtgcccagactttaacctgctcatggtcagcccccacagtgttttcagtgtgccccaagtctttgttgggaacagcgttgtctccacttctgagctggaatcctgacagcacaccacgggctttgcgctcctgccctggttcttgtcttgaactttccatccctgtgtcctcttgctgctccagcctgtgtgtttttctcaggcacaacttccggctgttgcttaaattaataattatcttaatgaggtgttgcttcgttattattttcaccggggtaggggaggtgtagctgctcgctttggtgttttctcagatgactttatccacttgcatttgcagagaaaaaggtgtgctcttggactctgccttctcctgcacgggtggtgtggataatcctccagggtccttggccgcagggcagataatctcttcggggttatctgttaattaccagtgaatgtgtgaagtatttgtgcaaaggcttttgaagtgagctccacgcactgttgcctgggccgccactggccctgcttcccaggcagagggtttcgaggcccagcttggttcccctcaagtgctggtggtattctcttgctaaattgtttgcctttctaatgaagtgaactgtttgtttgactctgcggtagaaggtatttaactggggactaaagtaaacgttgaagacattcaaataagccatgcatatctgctttgtggagggaaggaaaacagtttggcctcactcacctccgggaagaatcgttaaggaactgtttaaataataaactgagccgagcgagcggatattgctgcagcccagtctggggcttttgtgctagtcctggctggcctgggaattcctctgtagcagccacgaggggagaagagagcggctggattcttgcagttagtaattgtgatttatatatgtgtagagggacttctgctgtgttcggtctaaacaagcccaattagccctcaggacagcaggccggtggatggcgactgtgttagcacagtgtgcgcaggccccagtggcagcaagagagcatcgtcgtggggttgatgtctggcccgtgttctgccagatctggcctggttaggggcctgctgcctgctaggctgggtccctggtgcctgggagaagtgtctgagcgactggggcaaggggaccaaagtgtaagcctgaggcagggcctgggtgaggtaggggacctgtacctgggcagtgaaggcaggatgtgtgcaatcacccagtgtacccatgacaatgtctgttagcagcttttagcttttgtcgttggcaagggtgaagcagagaaggttggaagtgggagtacttttgtgggaaatacaggtgtactcaggaccagctccatagtttgtgaggcccagtgtaaaaagaaaatggggagcccttgttgaaaaattactaagaatttcaagacggctactgcgcgtaacattaaaccatgctcgggcccttctgaccacaggcccaggggctgcacaggccccatgcctgggtagttggccctgctgtagcttacagagcactgtagtcaggcacatctggacttgaggccaagctttgtcagttcctaactgagcgactttaacttcttaccttctctatccctattttctcatttgcaaaatagcatatgaatacctacttccttagattgtcatgtggtataagcaagaaaatatatgaagagtgtttagggcagtccttagtacctgtgagtgctcagtaaatgatagttcttttttgagcgtatttgtagctgtaactttttttcttttccctgaaggttaagctgaggacagtgtctgtctagtgtgaagttcaggagacagagtgaggtccttgccacagaccttacttagggacagagatatggaggactcttcctgggtcttatgatcagagaatgcttgagggcaagagagaagcatgacctgaaccttcagattacttgcaaagctgaagacacccacataaagttgttgactctcatggtaacttgggtgtttatgttgaggaagaaggacttagaaggaacggtgacttcttaaacatgggtacagtcatgtgctgcctaaggatattcaggtcaaggactgaccacatgtaagacagtggtcccataagattataatggagctgaagaattcctatcacctagtgacattgtggctatcataacgtcatagtacagtcactttacttttcataaatttagtgcagcctaagtgtacagtgtttataaagtcaacagtactgtacagggatgtcctaggtcttcacattcattcaccactcactcactgactcacccagagcaatttccagtcctacaagctccattaatggtaagtgctctatataggtgtagcattttaaaaatattttaatactgtatttttgctgtaccttttctatgtttagatatgcttagatacaccaatatttatcattgtgttacggttgcctacaggattcagtatggggacatgctaccgtaccgttatagcctacgagtaataggctataccatacagcatgggcgtgtagtaggctccaccatctaggtgtgtgtaagtgcactccatgatgttcacacaatgacacaatcatctaaagacatatttcttagaatgcatcccattgttaagagatgcatgactgttattcagaatttatgaaccaccttcacttatgtcacctggggccttgtacaactttgtggagtcaacagagttaagtcttactagccttattttacggatgaaagaaaatttatattatggctgtagtgattattgtaatttgtttttatagaaatctagaaaatacgtctttaaatgggggagccttttcagctgccttgggcaaaatggagagcagataaattcccatgggaagggtgtacccagccaagggttgcagcatgcatcattcagtgtgctgagtatttggccttttcccgattttggagaaggtaaaactcagtagaaaggatggcttttctaaggattcatattgagggtgataaattctgtacaagtatatattggtgtcaagatgaccagtaggttgccatcaatttggtctgttgcctagtgtcagttattaaatccatgctttgtttcaaatgttttgtttaaatcccgtattatcatgcttcaagtcattagtaacagttggaaacagcaaagaagcatgagaagcagtcttgcactctcaaaatgagtgtaggccacaccctctgattagtggaaactcattgaggaagtgcagattggggtcatctttgtgtgagtgtgtccactattacgcatccatgtgttgaggctatagtccctagggctgtaggtgtggacctaggcgtacaaggtatagatgcagactccagaagcagaccatgttctctgtccttaggggcacttggagcacatggacatcattgacatcagatacctaccaagtatagtttatgaagactggtctagaagccaggggttactttgtagagagggaggagaggactcagatggagatcacattagagcctgagtcttgttagacaaggtaagcagctgctgagtccagatgaagggccagtgagatcaccactgaggctgcagaagcggaagtgcgcaagagagcttgaggcctcagggaagcacaggcagcagacagccagtggcctaggctcagtgaaaggagcctcaggaccactgcctccccagagaggagagtccccatcagagcccagctgaataggtttgttgacacccccaagcctatcatcctccccagtcctaaaacagaacgctggcaaactgaattcctctgggatgtgtctgagcacattagcttgtctggactgcaggaatcatggaggggaagagtgggcaatgagtggcctctgccttttatgggcatggtgggcttgcaggcccaggcaggatgcctcttgcctatagcataggttagacatccaaggcattaccataggagcaggtgctctaaggggtggacggtcagagatagtctgaaattcattcagcattccaactggaattaagctaagaatcaaaataggaagccagatgagattgcgaggaagggaagggtagccaacaagagaggaagccactagtgggaacttcagagagtggagcttggagtagttctgaaccagcctgcaggcagctgtggggctttttatctgcacatccagcaatgagtatgaggtagctgcaaagtggacggtggacttgagaaggcattctaaagaagaaaggtatttcggactccttcagatgataccatttgatagatgctcacatagccaatgtctttgaggtgtgtgtaaaatgtgcagcttgtggctaacatagggttgcagagaaaggagaaatagaagaaaaatggggaatgttttctacttgtactcccatgagccaagaaatgtgaagtggatttttttctttctaagcagcgggggattctctcccttttctatcatttccttgctcatcctttcaaggaagccatgtcgtgtgctttattgttttacagtcatggtgaaagaaacccttaaaacaaactctttgctttaaagctttatgtgtttctgcaaacaatgatgcttcttagacagtgagggttcagagtttaagggacacaagaaagtggagccttttaatgctcccagtgtgcagtaaacatgctggaatttcaatggattccaaagcgtaacaataatagcattaagtacatgccagagcctttgatgttattgatgaaaaaaaaaaaaaaagtaggtggtggtgggggcaaaggggcccctgtcatttctgtcatgagcttttaaacttttgacctccaaccttttgtgtctaagagctttttccatatgggtgttagcagcctgatcaagtatcctgaattcactggagccatcagtgtttctctgatgggaaagggcattctcagtcaaaaggtcccaaccaggattgtgattgctgagcgcccatcagtgtctgccctgtcttagaggtggtggcatggggtagggtggtgagtttactcactgaagttactcactgcccagcagaaggcaggcagcctggtcaggctggaagctgcctttcagagtgctaggatttggtccagggtgtgcatgcatctgctgggccttggccctgggctcactctgaacatgggaagcatgcagaaaactgcacagggaggattccaaagaggagacagcccatacctgtgggttcccctcattttgcctgttgttggaggccccttaggtagatggaagtgtcctgcagtttccaggagggatggctagcctggtccaccactgtcattgcgtggcctcagtttcctttcatgtctttcctcccccttttcacctttcctagaacatacatttattgagttcctgctgggtatacacggataagtgggcctcttctgccctcacaccccagacctcctgggagggaaagaagacagttctgacctgtgggtgtgtgcaccctggcagggactcatccccatactgcccagcaggaaaggcagtgtggtgtgctcacccccatggctgtgttggtataagctctgtattcagtaaatgtgtgcttgtctgaggaagcgcactgaggatgagcacagggccgtcagagggcaaggcagtggggaggacatgatgcgggtccaagtagaattcctcgggtcgtccctactggttctggccaacctgaattatggagaagggaggaaggagcactcgatcccatggagccccctgggaagcctgatggagggggtggtgtttgtattgagtcttgaagagggggtaagacttgggtaagagggaatttgtcctcaactgaggggacaccataagccatgaagtgcatggtgcctgagggggcactgactctcggatggggaggtgtcctggacagagcttggtggctggggcctcaaactcatggtgaagagcttgggctggagtggggaggctatcttgggctactatacattttgggagaagggagggatatggttcagacttggttttagggatgctggtgtggggagtatagtttagataagctatgataaaaagccttaactctgacattgttgtgtcaggaagtggaatgtctaagagccctggttctgaagtaagaaagacacacagctctactactgtctccccctgtaacactggagaaggtcagtttccccatccataagaatgggcgtatgaatagtacctgcttctcagggtcaggccccaggaagaaataaatgaggtgaatctaaaaggcattgcacattgcttgacctgcattaaagtattcagtgacttgcacttgtgctcatcaagattgttttattattttttattaattactatttatggggcaaaccttggaagacctttagttgttgattgacaggaactgcagatggagtggatggtccagataaaagaagcagagtcaataatccttcagagcttcttgcctggttttgagcaaaatgaatgtgcctcattcatttcttaattgctacaaagttgccaaccagcacactcttgaaatactgctggtcttccagagacttccaaatatttctggaagtgattctttatgattgatggcagcattctctcttgtgcaactgtgaagacaagggtaaacctcttgatatgctgagcctgagccccgacaatctctggcaggcttgcatttgtgctgcctgagagctcctcagggttgccgcctccaaagcaggattgacatttcatgaaggtacctgggtttccctgccctggcagggatcacgtttgaagtgccaagtcctgtgtgctctggtattggaatagaaagagcaccaaacttgcatcataaggccatagttttatgcaacactgggtagatcatttagcttttttgagtggataataaaattttcccttcttagttctcaggattgtcttgataatagaacttaagaagaaacaagacttaggagaataataataacgttttgggaatgcttattttatgtcaagaggattccttaagaagatatatactattatgaaatatactatcttattttgctttcacatttccctacctgcttctgctagttttgcaacactgaaagctctttttgcagcaggttaattttgaatagaatacaacttccaaacctcccctttgtggatcagttgttggtttcctaactaaaccaggcttagtttaaacttctgatcctattgactccagggtctccgtagttagatctgagataaccaaacagtttttatggaaacatttcctcttctgctttcatttcataaccattcgagaccagcctggctcacatggtgaatccttgtctctactaaaaatacaaaaattagccgggcgtggtggtgggcacctgtaatcccagctactcgggaggctgaggcacgagaatcgcttgaacccgggaggtggaggttgcagtgagctgagattgtgccactgcagtccagcctgggcaatagagtgagactcaatctaaaaaaaaaaaaaaaaaaaaaaaaaaaaagaatccaaatgcatatttttagagctataactgtgacttttgaattttgtgatacaaaaatacagtcattgatttaaaaatttgtcactggtaactaatttccatttttaatttccaagcttatttattgtcactgaaaatacaccattagcatatttcaaagtaaacagatttgtcacttttaagtgattccttatatgtttacatgtgatttccctgagagagttctgcagttcagctagaatggatgtaaacctttccttatttctctttgctgcctttccctctggttatttcttctctcttatcctggcaggaaagctgaaaacaacaaaaatgttggatgcatatatgtggaatcacaggcaagacacattccagagtctctgtttggaaggatatggctggtcagccagtacgtagatgtggttttctttccaccactgggcatccactggatgtgatcttgaagggagaaacatgcagacttacggacagaagaagttagaagtttccagaaaggggcgagatcagttgttggttcacgactgaggacatacctgaagcagtaaaggcagaggtttcttttgtcagttcacttgcagaggaacatttggcattttcttgtgggaaacacatgaccatgtttgttgaggagcacagaagggatctatctgactgtttaaaaaaaaggatgaattgtgggtgtggccagagtgtagtgatgggtagcatttaggtctaaaatactaattaatttaatagtctgcatgcttacacaaaagaaatgataaaaagcttgttatttgagtagtggagaatgtccgtggaagtttatagaccaggagtcaagactgtcaggtagttgccagaagtaaaagcttattgggttttagaaatagcttactttttattgttaattagcattttatgtaaatttgtatttgttttacttaatttataaggtaacttcaattttcaaatgcttagctactgctattattgctagatttatggttaatttcatccattatcttgaaatttgtctacttgttacgggttttgctaaaattagatgagatgtctattgattaatgattaatatgaacacttttactatattaagtcagtcacacaagttagcatatgaagaaagtgcattgaaaatacttgatgtacttagtgttatcgcttagacaacacaataaataaaaaattgatatttttttttctgaaatgtaataatttctgcaaattactttatcatggtacactggaatagggtttgtcaacctttttccataaaggataagataacaaatgtgttaggccatgggtttcctgtctcagctggtcagctctgttgttggcgtgggaaagcagccataggcaatatgtaaacaaataagtatggcagtattccaataaaactttatttacaaagcaacctaagtgtccatcaacagatgaatgggtaaagaaaatgtggtacatatacacagtggagtactattcagatgtaaagaagaatgaaatcctgtcatttgcaacaacatggatggaactgtaggtcatgatgttaagtgaaataagccaggtgcagaaagaacttgatctcacttatttgtgggacctaaacattaaaatgattgaactcagagggatagagaatagatggatggttaccagaggctaggaaggatagtgggggttgagcagggagtgggaatggttaatgggtacaaaaaaatagaaagattgaatgagacccaatgtttgttagcacagcatggtgactatagtcaaaagcaatgtaattgtacattttaaaataatgaagagagtataattggattgtttatagcacgcataataaatgcttgaggtgatggataccccatttgccctgatatgcttgttatgtgttgcatgcctgtgtcaaaatatctcatgtgacccataaatatgtacatctactatgtacctataaaaaattaaaaaattaaaacataactttatttacaaaaaccggcccacatgtgatagtttgcagtttcctcctatagcatatactcttcaagttaaggctcctgccattgtgtaaagtgacaaaataatagataatttaaaaaaaaagtttcagggcatttttacaggatttctagagtatgctagaaccacagcttctttaaacttgcattaccctatagaagatcatataaatacgatgtctcattctgatgattccggaggagtttctaaccccacataatatgcttgtgagaccagaaaaaagattcctagtgctccatgaggtgatgctgtggggattctgcccagcaagtcctcagcggggccctgtgggggtagcacttcttagattccgctcacggtagatcatggtgggccacagactgtcttgctcaaaacacgttgctctagactctccttgtcaggttacctggggtgtcctcagagggcggatcagctcatttctggtgccgtgtcatccataggcaggaattgcaaggttgtctgagttagtaagtcagtctgcatcttggagtcagtccaaatggcctcccacagtgcactgagccctggaaaaacgacttgcaggcacgaggatgatgactggagaagctccatggtgggaagagacagtgatgaggcctgggctgcctctctactatctcactagagtgagttccttggcagtcggatctctcattctgtctctcctcttctctccctctcctgcttgagacctttcattttatagaagctggatggtgattttggttgtagcatagcggatgctgtttaatgatatttctgctgatggcagatgattgaatgagtttgaggggactggccattcctacaggctggactaactctaatgacagaaaatcatccctagctgattgagatgattccaagctgattgagtaaattccaaggccagggtacagacgacttcagtatttaaatcacccatgaggacttctgcacttagcagtttactcttgcactgtttcccgggcactttcagaccattcaagtatcatttggtgaattactccttcagggcactaactgagagactttgatctctcttttttaatctgcaatttttgtatgtaaatttcaaaccttaaaagacagtttcccaggatggcatccaagagatcttatagcctgaggatactataactatttcttgggagaaggatgcaactagagataaatctccaagtgtctttctcggttattctctggctacaggttttatgatcaacccaggctgttgtgaagagacctaaaaatcaatgcctctcgttcctaatgagacccttaatgctcaacgtgatgacagccagtgtgaaatggaatactgacaactctacccagcacaaatatttttgctatgcatttcagtttaaacatgtgtcaagccagttacatatttatagggtttaaagaccattccactcaagcctgggagagtgcacactcttcaaatctctgtttagtgtaagaggactcgggtacaatagtcaaacctctcgcaggtctgtaataaatcatctttgcaaccataagcatgtacagttgactgcttaccactgctccacagacccgcccccacctggtagaattttaattccctcagtaaaattgattccaccagttctgcacattattctccctgtcttccatttagcccgttagtttgctgacagtagagtacacagcacttagcagctggtttgtggagccatcagtcaggaaattgtatgataaataggaggtagccaggtttcgtggcacttccttctgcttcagcagttttcgcctgactttggagaagtcatcatgtggtgttttgtcaaggggcagggcaggagatggctgcggtgcagtaacttattacatatacgcttgagttatgatgcgtcacagctgcactgctcatgtgtaaataataaactgcgagctgggtaattatggcggctctggcgacaagggcctgttctcgtcatgtgggttttcttggacagctttttgggccgatgatggaatatgccgctgagccacatagaaacgacaaaccaagacaccagcaaggcaagtactcaacgtttgaggattcaggagcatttttcaagaaatgtgttaggattaatgccatgagatgccacgtatgttacaggacatgcccatactgcttttcattcttcatttatcctgttaagctatagtcaagcacgtcttgaattggaagaggggagttccattgtattttcccagaaagtggcttaagaggtgtgatttctactaataaccaacacaaggtataattgtccacacagacttctgcaatccaggagaagttattttaaatttaatcaagaggggaaacgtagaaacagtgagacacttaaaccaaaatcagatgtctttggtcaaatcagatcatatccattaattttctgttctttatttaaacataattctcgaatgcagaattcataaattttcttgggacataaataagcattaagaatttggtgcagtgttaggagatgcatcacatattttcagtcagaattaacttttaaattcatagaatactgtggactcaacagtgagaaatgactacttagtgtcccagtaattgtgttttatattttcctctcaaatttattgttgcagtgctaggtcattttatcctttattctgaaagagggagagagggtgagagagagaaaatttaaaccctgaaagaataatttcttgaaaatgagaagatggcagtgtcttttaaatgtccttgatagcattgtaggttttccttgaggaagataattttatacttgttgggtacacgcttttgattttatgggattaactggttggtcttcactccatacacgtaatcactgcaacttcattataaacactcatataaaagattgtgactgttacttcggggatatatgaggcatatattaaatgtggaataaattcacacattttgagtgaaaaacgtggttttgtactttgtcataattcatagttgcacccacatagagaaaaccagatacagttgacacccacttacctggtggagagaatttcatcatgcagaacacagccaaaagccatgaaataaagaagtgaaaataccttccaactctgacatagttgtcagtatccctcaaaacagccgcataaactggtgcatgtgcgatgccctgaggagatgggtacgactttatgaatgctgaattcacaccctgttctagtaagtttatttctgtgattgccaagagcagatgatgtgtgttaagtaagaagtctgcagggggcatgcgtgtttgcattggcagtgatagctgaaaggtgtggaagagaaagaagagccacccccatatttcatggccatccaccctcacccggatttgaatctgattgatttgggtttgttttaaagtttaaaatcagtaaacataaactagtatatgtcaggctttcaaacgagtgcaaaagatgaccccacttaattttttgttgttttaagaagggtgcataatttcctttgaaaatggttaaatgagagagaatgtttggctctacagagggtggcttttaactgtcaagatggctgaactatgtgcagcaatgaaggtgccaacattgctgaataaacattcaacttaaactttcaaacttaccaaatcaactttcaatatttacattacaaataataatacctacaccctttcatattaagtactaagtggtaaacttaaaatataatcaatttttatatggactttacaaaatgtgtaaagtgtgataaatgaggccgggcgcggtggctgacgcctgtaatcccagcactttgggaggccgaggcgggcagatcacgaggtcaggagatcaagaccatcctggctaacacggtgaaagcctgtgtctactaaaaatacaaaaaattagccaggcgtggtggcgggcgcctgtagtcccagctacttgggaggctgaggcaggagaatggcgtgaacccgggaggtggagctcacagtgagccgagatcgagccactgcactccagtctgggtgactgagtgagactccgtctcaaaaaaaaaaaaaaaaaaaaactgtgataaatgatcaggtcattagtatatccctcacctgttgaattttcagcattgttgtatatcacgatactacagtgacagtgatacaagatcaaactgattccttcctctttccatgccccccactccctccctactcaatcttatgacagtcacaaagtacggtgagtcattgacatttcagtaaaatagtcctctgggaagttttctagattctagatctggtggtaaactgtagaattacagcctcgggtccttccctggtagaccacagagcttctatgaatgctatgctcatcgttttttttactcttactggatttttttcttcataaacagagtcttatattcttgaaggcagcagggacaaaatcaaaacaagggaagcaatgtactataactttaaaaacatgtttgttgtgcttatattctactagttgcttgttgaagaaaatttggaaaatagagaaatgggtagggaagaaaatcaaaaccacctgaattcaacattacacacatctaataatcatccatttccacccagttgggatggcggtgttgccgacctcgggggatgcagccgacttcagcggggggacgctctgtgcattcttaggtggtcgatcagaacctgtccgctgagagaaggccccattggaattgcctttagagactgctaccctcagcactagggtgaaataactggaagccattctgaggcttgtgggtgtacacaccaatcctcagcagtgttggctctaggcaggctcccagcatgaccagtgtggacccgtcacatttgaagaacatgtcctggcacattttgctgtcgtatttagtctcatagacatggagtcaaacctccaagttttggaccccttcattttgcttcttgaaacttgggaaaaccttgactcatcagtcatgcttctaagtataaaatctgttaaaactctcttcagtttttacagtgaatcacttttttttttttaataaaggtttattttcagtgacaatgggtgtgagttactaggagtaagtgggggtgggagagctatttttaaggaagagcacacacccagcagctcaggaacccggagcgttggactggggaaaggtggaagcaggagagggcctgggtccaaggtgaatgttaacactaccttgggaggaattccctgagtttggctctagatgtctgtgagtctgagtgggtcagcttatctcttcctggagggctgcacagtgtttccctggacagggcatagatttgctgcctttgtgtggggactatggaggcctagcccggccaagaaggaggggaatatgtatttaagttaaaaaaaaaaaaaagaagcacatgcatgcatgtgtatatcagccacagattctagcaagcctttcactcttaaaagtatggtgagcatgggagaaatgaaactggtatttgtattacagtgtctttgtctaaaacttaacttgacaatgtagttttatttttcaaataagtgtgttttaatctcttccccttggctttgtggctcccttcagcccttctcctctggtcagcctgtctttcaagatagggagcctgtgttgctcctctctttcttgctttcgtgtctgggtttgagttgcagtcagtcccaggctctgccttctcaggtaggtgcaggcactacttacttagtcacactgctgcagtacctcacagagcttcataactaaccttaaagagttcttttacaaattcttagattaagtgtaggtagtgaagatacaatagtatagcaatgttgctttgtgaatcggaatgctgtttgaaagtgttcatttgatatagattgggctctctcttcttttcagaccctcctcatcttttccctgccttccatcctcctgtaccaattgatgccagacatcatgagggccgttaccattacgatccatctccgattcctccattgcatatgtaagtattaacactttcttcattaatgaaatggaacgagatgctggcttttaccatctcaggactttttgttaatggcatgtccactgggctttgaagatgtgatagaagtgtaagatttacttttgaaatatagcaagcctatctgttcgtgggttcactgaagcaaatccctgctgcttcctgaggaatgcctgtcacactaggtcgccgacaagtatttcctatatattttgctgacgtgtgttctgtgggctgtaaatactaaattaaaaagtaaaagcctaatggaaagttaccactcagaatatgtatttggtcgacattaggtttgaagtttgttatgttcaaatttctgtaacatgaaagtcctgttctggggatcacaaggaattgtaatgaaatttttatggtaaattttcatagcccctatgtaagtacaccagaagtcacttgattgatgggaatgtcagccaaacaaaatggcaaatgtgatcgagcacatggtttacagaaagataaaaggaaagaatgctagtgataacatacattagaaaaggaaaaaggaaatctcttggaagtaaataccatcttccttggtttggaggaaataaaggatggtggagttgcaaagtaaaacagtatttttttgtagtactgtccaggaaactgtcatgtaccataataattggagccactctctgggatgggctgtcccttgctaacggccttgatatatacatttattcatatctaataatcaccctttattctgagacagtaaagttagaaaagcacaaataatactttgaagaataatgctggttattcagatggtagattgcatctccgtggctattagttacagctgtgtaattacatattatgccaaagaaaaatgaagttgttttaaaacaagtcctcctctgtgaacagaattaattgatattaacaatcctaactacatgcccaagtacacatataatattttaccaacagttttttggatccatctcccattactgaattgtaatttcagagcagatttgcctggaggtaagtaataaatctgtgttgcagacttctataagcattaaaggagaagtgggtatttatagagagagaatgcagaaacttgtgactgatcctttgagttttcactggaacacaagtaagtatttacagggttctgaagcctgctaaaaataccctctaataaaaccaggaggccaatttaaaattctctatacaaagggaaggaaattcctagttcagcctgaaacatgacatgtaattcaccccattatacagaggttttatgatacagatgtgaccacatgggtctcagatgaggatctgccccatggttcagagcatgcaagggccagatagacctcggagacatggatggctaattcctcccagactggagcctttgtgatgtacttaatttaagtcagattttctccggaattttggagttcttcattctttcagaaatgatgttctagagcaattttttaaaatgagtttatataataggctgaactatttcctctgcattcattatagtttgccttgtaattaaattcaaatatgaatttatcaataaaaaccccaagtcttggttctatggcggaatataacagcaagccctcctgtagcccccactgtgtgttctaggccctcattactgacctgcattggcccgtggtgataacatcacgagacaagatgcgtcacatctggaccatcctcgtaggcagagtcgggggagtcacatttcaggtgtgactgttgagctgggttttctttggattttagttcttcctgcttttttagccaggctttggatactttactagcatctgactaaatggttctctagcagcctaaatgtataattatcaaaaagattgatgatgtaaagctgatagataatcctgagcctcaaaagacaagtcctggaagattctgagagggaatatcattgctgcgggcacagagaatggtgagcttatgggtttgtggcctcctgggactgcctggttttagtgcatcctggcagggccctgggtggacgctatgcttatgaagtgggccccagcaagctggggcatgtcacgcccctgtgtctttgtgactgacattctgtctgcattggtctcagtggccttccctctctgcatggtgaactcctgcttatattcatcctcaaggcctaatttaagggccgtcccagagactcgcatgtagctttgttgtgatgcttttcctcttgcttggtgatttattgttaacggtcactgctcccttctagtttcaggggcagtgcccagcacttggtcaggcactttgtaaaaggtgctcagtggacactcacattggcccagtctgagagacagtggaggagcagtcagagagctcgaattcctgttcttgtgttgccactcacttgtgctgtgcactctggccactgacctttgcatgtgttggtttcgtaacgtggaaatgaagctgtctgctgtacccacctcttcagatcacagggagagttcaatgaaataatgttcatgtaagcactctgaaaagcacagagctctaaataaatgctgaaggttggcattccaggcagtggggggcatgaaaaatactgggagtttctattctgcccttgctcagttatgagaccctgggttgctcttgcaccttctgaggtatgataagtagacacctgtgatcaccttgaaagtggaggctaatcgaggcaaatgtggcttggttatagaaatcttaaaagcacgtatttgctaagggatgaatcagttacctgggaaagtaaaatcacttcatccaaaacttgaattccaaactgtttgctatataattgtcttatagaaaatgagatcaagtgaagagtactaagtttttgcaatatttttaattctaagaagacaaaatttggagatattatcattattttgtacacacaattgttcttctggtgccagctttaaaaactaaattacgagtctcctaaaaacaaggatttgtgttgatggaaatgccgacagatctctgtttagaagaagggcaggcgcttctataattatgctatcatatcctatcattaaagattctattgaaagaggtttataaattgctcctctttttagataaaccaccctatattaaggcatcaacgatatggtgcagaattaaattaaaatctcataaaatgaaatatgtttcgtattagctgtttgacacttaatttgcctctgaatgagtagaggaaatcacaaattaacctgcctttgtttttccaaccatggcttattaggtgttagaacaactgcaattacagactaataataaccactaagccttataaatatgtacggaaatacgtcagtttgtgttaaagaacccagtttgctaaacggaatgccttcagcttgccctgcttattcttacggtgttatccacagtttatggttaggcagtgtagaatgagtatagaaacttgaatggattcaaatacatcactagaaataatttataatttattggcattttgtttcttaaatcaaaattgtgaatttagactcagaacttctaagtaggacctggaatataagtagtattattctctgagttgtcacgtaaaggttgttataaaatgtacaattcctgcattgtatttgtttaattcaagtaatttgaaaattaagaaacactggatatgaggaatcttcccgtttcctcggaaagttattctccactgaattcaccaggtcttaggcccaataaacaaatggaatgttgctctctctccctctctctcaaatcctttgagagacttgttaagctagattgcaagaagtataatgttttagaaaaaatatcagagtgagtctactttattactgagattattttgtgcattaatgaaagaacctgaatctatacacacatactcttattttatgtgtatatttttacttcttggtctctgtatttcctgccttgcattgttgacatcagggctgttccttccctaactcgaggagacactactgtattctatgggaacaaatgatgcctgctaggctaaaaataagtactaatttttaaaatttcacttgggaatgtaggcaattggtatattacagcctactaccccagaatacaattgcattgtcaagtggctactttccacagtaataattaaagtactttctctcttgcattttgagtgtgtgttttttgttttttagtgttagaactcaattaagcatgcttcctttttaaaagtaggcatggtgtatttgtagaaacccaaattataaagtagctttaaattccaatttgatttcattcattttggatttttcttgggaaaaagaaatgtagcccttatgtacaatctttctgagccaaggttttctaatttatggaccagtattaattgaatttcgaactgtctttctgtttcatactgagatctgcaattcattttccaaagcagggtccttggttactaatccattgcaataattaagccccaccaatcttcttgccagtcgagctgtgagctgctcttgctttgtgctgtggatgtgaacagtactgcaccccaagccagctcacataaaggctgttgcatttcaccatccactttactaatccactttcgaaaaccagcttttctgtcttagggaaaatgagcactcatgttctgttctgtacgtcagccctttttttttctttgttgagtcaatgtgtctccttccaaggctgcctgacactctctggaatcattccacctaagtaaggagagctgttcttcccactaaaagtggccacctcccttcacctcagggagaggactcagtattatgaagatcattaatatcagctgtgagacagagtgcactggaaataggtaaggcctcgcccccgtaattatggctgcctgttagggatgagagcagggagatgagaggcaagtttggcatatgaataaatacatttcttcccagagagaaaaagctctaagaaaaggtatatcattatggtaaaagcttagagaaggaaatagtaagtagatgaccagggctactactgagttcccctcccctaaatttagcacgttgcttgtcctggtattatctttactgagagctcacatacttattccaaaggagcctcttcagtctagctgcttactgaaaacactatattgggcctgttcatgtaatagtgatttcattcgttgcattcttagggaagtttccggtaaaatatggagatttagtaaaaccttataattatatttggggtcaaaactagtttggaatattttaatagtgtaacttaaaattaacaaaggaaagtttccccccgcctcctccacccagtgtttgtgctttaccataacattattaagactggtaaagtgtaatgacatatcaaattgcaaagtctagcaaatactgtagcaaaccctaaaacactccccaccgcccccccaaaaaagaaaaagaaaacatgaactaaattataattacatctctcagggtgaagacgatctgtgtatttctttgcatttgctaggctgagcccatgctctacatatggtagctcctaaataaatattatttttaatgatgataaaaataatagggtcactgctatgaccatcatttttcttttgtttctgtttgagtgtgtcacctcgtgccaacaagctaggattcaaaaaataaaagctcagtgactacttttgatagaatagattctattaatagtagctattgccacatcagatgctctccactgtcaaactaatttcctgatattaaagcagttactggtccccttatatgactgagtgctatttaatgtattgctgctttccagagccgacacatggaaataaaatgaatgaaattagccatcttaaatgaacaatttaagaagaccatagcaatatcaaagataagggcaaaaaagagatgaatagataattcagatgaaaaagtatataatcatgaccatagctgacatttttgaatacttactataggctaagcacaatattaaagactttatgtagtcataatatttatgtgtgttaatatttataacaactctatgctggagttattagtctcattttaaagacatggaaaccttgacatagagaagttactcagcttacaagtaggtagtgcccttgagttaacccaggcatcagactccacacccttgctccggacttccatgccttgctagtgaaaatgaagaccacagacttggctgctctagtttctacttcctggatgagcacaactatttctaacagtacctgataggaagttttcagtgttactggctgtcattgtcttctgcaaattcccaaggtggaaatacagcagtgtgcgaagagccataaaaagccacgttcaggccttttgacctaatgtacctattgagtaacccaaaaatgagatgcttatcagtctttgctgctgtagaatgtatgacactatacaatagaacagtttacatattcagccactggagtggtttggtaaattgtgattcatcaactgggtggagtgttgaccaatacttaatcacatttgagaagactctgttagaacatgggtagataataattagtgattatagcggtaaacccaatagaagggaagccatgttagaacacaatgtgtatctgcgtagagccttcttccttcagatacctatggcttgctccctcccttcacacatttccctgctcagtttctgcttctcagagaggtcttctgtgaacaactacttaaaacagggattggcaaactgtggcctatgggccaaatacggttcatggcctgtttttgtcaataaagttttattggaacacagtgacattccttatttagtattatctgtggcagctttagcaatacaagggcagagttgagtaactgtgacagagaatatgacctggaatgcctgaaagataaaagtttgccaaccttggtctaaaataacaccccctctccatcttcactctgtacttctttctctgctttatttttctcttttttatgagcaatgccatgtgtcatgttttctacttttatgcttttctactgctattgttcacatttttcactgcatatcatgtcaaatcaaaaaataaatgtcttattatttggttatcatttctcgtgattaactgaaaaagtttaagtcctgcctaattttcaagaactatcttaggccacctacatacatagtttcctcatagttaggaaaagatggttgagtttcaattcctaaacttttaaaattctgatgagcgggcacataaatccagatccgccgatacacactttactttgcgttaagaaacaaccacaaaacagataaattgtactcaaagggtgtatactcctttctgttttgcagtatttctaatgactgaaatactgaattcggtcctcagttgcagagaaagcaggccctaattatagtgtatattcagagtctgagccccagcttcttggataaaattcctgtgttctttgtgctgcgctcagcagcacggtccaggagcagatattgactgaggtattcacgttcactgaaccggaagccgccgactctatagaggctgctgtcaaacctgttgcgggggcctgggaggtactgggctgtaacagacttttttctttgagtacaatgcttccactcatgttaagcctggcttcaaagaaaacagaaatttactgttgtcattttatttatttttttaagtatgtgtttgagaaaactgaactttaacagaatttgtcctgatgggaagacactttgaggttaggtttatatggtgaatactgcctaaactgaagctccctgcagcctttcctatgtggccgtctctccctcacttaggtaacagagccccacttttttcacctaaacaaagacatgccatttcctatagccacactgcaagctgagttcatttcagacctttcctcgggggaacaaaggccaatgacacagggctgcctgtcactcattgttgttattgttgcatccccatccctgccccggggaaaatcacacatcagaaaataaatgttagcagatatgtttccaggaacctgcttgctaactttttgagtatgaagtaacagattagccagattttggatcttcagtgacccaagcaagctaagcacactaaaaggaaataggaggagagaggtggattttgaaactcatccttggagctctgagaaaactagggatgttttggcagagagctatactgaaacaaatttgaaaaatacaatcttggccatttttagttttgatgtggactttgcaaaaggcagaccagagcagaaatgggcatgattgtgttgcagttcagtaaaaattaacaagttaaacggcttactggcctgtgtttacctcctgtgctgacttagctaatttggtgacattgcctcaatttttataactctgtgttgaaaaacatcaagtgcgatgctagaaatatactctgcctcttttctcttgtgtgtgtctacacacgtgtgcaggaagaaaataatgcagggagaatggtcagagtggcaggaactgccttagagcatgtgagtgcatttccaataaagataaaagtgagtgtctaacccaaagccataggtttttaaaaatcccatcacctaatattttggcatgtgcagcatcacacatgtttataagtgacagatatttaaaattttcttatgcaatacagggaggttacagattcactaaaagaaaaagttctcagttgggactcttacagggaatggaagcctggccccagactgaaaatctgaactaataccaaaatgaattgtgtgtacagttgcccttgaagacattctctttaaggctttttttttaaggttcccccatacagggtccctcattgcctggaagcacctgtaaattgttcctaaggagccctgtgcataccatggccaagtctagtatggcctaggtagccagcctaagggagttaggttaactgggcacagtaaatgattccctcaggcctgacaaggttaatatgtctttcaaaacctgggaacaagttacacatgaaacaggaaaactgccaatattcttctaaatacattcaaatagtatccaaatattgccaagttcaccataagtgaatagtatctctatcatctgatggggagtggggagagggaagctctagagttaaatgaattgcctcatttgcaaaacaaatcaccaaaccatgttgcttgaatatgctttacatttttaagacagcatggaaataaacatttccagtttactaaaatgcttcttgcctctgttcaaagtaatctctggttcccccacagagcaaaatccccatattcctagcacccattgtcgttaacatatactatgcacactaaggaaagttttcaggaacaaatttagaattgtaagtccataacgtaagcaatcagacctctgaaggggcctctgatttttcatatgttatttgccagggatataacaaattaatattagagttatgttggattatgttaatacttttattacctgccatgttgtattgatttatttaaagtaagtattttatgtttttttatatatcttcactatgttactgtatatgcgtatgtacccgtacagcactcacttctgtctgtgttccttgtagcactctaagcctgtccttgggattagtcagccaaagacagcatggtcttccatcttaaaggaagtagtcaagagggggaaaagaaggtcagcctcaagtattttaatcttgttttaatgaccaaagtcatttcagggctgcagtgatacacgtagtcattggattgagggaagaatagtccaagtcaagagtccactggaaatagaagagtgaggctggagctgtgagcagaggtgcagccttcttcagaaagccatgctaggctccattctcgcaattgaatagctgcacggttgtggatgttgtatactgtttgtgagagagaattttcaaagtttaaatccttgaacacttctggagtctctcttcatcctctggaatgtggggagcaggctgtggggatctgacccaggaggtgggtacacttccaaaggccttttcgtgatctgaagtgcgatccagagatgcactgcaccatatttaatttgtgttaacctccccacctttccccatcttttaacccagacagactggactttttagttacttaggttattattggtggtggtttctgtgtttgttggaggagggagttgagttggaagttgggagttgtggaagttgaattggaaggagtgaaaagtagagtccacccccttcccccgagtgtattggagagaaacatccttccttggtctgtttgctttgcaagggtgtcctttgatgaggtctttgtcctaggcacccactgaagtctcagtgtactcaagctttagaaaagcctattggcccttctttgttttctttgttgaactgtttattttgctttcttcccatgaggttccctggccttgctctgacaacgcttttctgcatgaattacattcctccgagccacaagtctcctaattcttccagtccatttgattccggcctgtgtgattagtccatggcttcgatccgctgtgggtctctgccaagcagagtgcttgctaagtgcccctaacgtggagacctaaagacattttttaacctcattagtgaggagagtagtgcttcattctagtttaataacatggctactcgaatcattactagccttaaaatcagtgaaagaggctactaagtcatttggttttctttcagtgtgaataaggctattgaaggagggtagttcaggtgttacactcaagcccaagttagtaacataaatcatcccgtgtagggtgagaggggagcccactagctccatttgagttaaatttacatatctaaagaatttcatcataatttgcataaaatggattgccttatgtatagaaataatgaacaacaaaaacaaaattattcgagtatcttactataaccactacattttcttgtacatatgctattttttgaagcatggtttatgactgggacagaaatgaacagctgataaacttatgaactatgtttttaactctattaacaaagagtaaatattttattctttaatgcattataccctcaatgtagatagtggtaaaacattgtgatatagcttgacaaaattcagctgtcttaaaagcaaaattcttatgaagggtacattcagttgtttttacttgcttttttgtgcatgagaatttctactcttaacaagcaggtggggtgcattgtagctaaccaggggtctgcatttattgataatgtacctgggagcagttttaataataatttaaaagtattaaataataatatttaattaatattaaaataataattttaataaattataaataaaatataatttttataaaataaaaataataaaaaagaggaccaaaaagtttgtcaggaatgattgaacacacagtctgtgatgaaaatgatacagtataaatacttatttttaacacagaagctcttccttaaagaactggggaagtaccaagcagtggggtcagggcctggtttcattggtatcctcttcttttcttgctgggcctggcttgaacgaggcttcttggggtctgacctctgtgagcccccaatatggctgtgcatcattggagcacagacgttattgtgaggctctctgcctgtgttccatttagcaaataaacacttcactgtacaggatcaagctgcttcttcacagagggaggatttatcaggaagatgggagttaaacctcttttggctagaaaaggcacttcctgcttggagtgggctctgcaaacagaacccccagtgagctgaattgcagcttccataatacttcctgcgtaacacagctaaacatccctcatgagtgtgactggattatggctttgctgaatagttcctttgagcacatcccttccccacccaataatatgttggttacattcacccatgacaatgctatttggttgggtttcaaagtgtaattccagcaaactcaaacatagtgctgttggcacatggcttctcatgatcatcttcgtaaaacaagttaatcatctgttttcataatacatgtggacctcagtgaggttccattctcaactctaccacaagttaaccggatccttgagcactttccgtcatctctgcaggccttgttttcatgtacaaaataaattaattaaatgatctttaagatcctttctagttcttaacatttcatgattatggaaaaatttaaatttgttcgttgttttttcctagagtgtggacacttacaaggggattccatgaaaatattgtggccctgacacatgcatgcccacatgccatttttctccctaagccataaagtttgttgcctgcactttccttatgtgaagctctgctgaaaagtcttgcctgaatggtggtcatacttccctcattactctttatactctgcaagtgacactttgtgtatactgcagccaccagtgtgacctgccatggcactacaatttgaacatcaatttaaatagattccctttggaagttaaggtagctagataaccataccatccttttctattaaaagcctcaataatgttaaaaatgtaagtgtaggcatacatgcacatgtgtatctggtttggggcagtttttctttgggtttaaaaacatagactttgaagcatagactgggtttgaattcagctcagatacttactgtcagattactgaatctgtctaagccagtttcaccattcaataccattttatatcaaggattcagcaaaggagcatatatatagcacttaacacagtgtctgtcacagcataggtatttgacgaatggcaggattgcctactacatatctatccccatatttaaatcatctattctaagtagtacatccctttttccatcttttaacatctctgaagttgggatgtattttacaatctatagtgttttacaattgcttattggtgaagtggcagtcatgaggaagttccaggtatcttttaataaaataattttgcttatatttcccttttttgtacatgtgctggaatgatacatgtttaaaaaatctatgtctgaataattctaaaagagctcttttaataagtaaagtaaaaaccaaaagtgatagggaaccattatctttttttagtggtatctaacacaattttgcacctttagatcagtaacatcttagagttgaggatatgtagtatgtcatatgtatttgtgtgtgtacgtatgtatttggtcaaaaaattgattcattgtcaagattttttcccctgagagcccagccacattttcctaaatgttacaataatggacctagttgcaagaatgtaaagttaaaaatgtaaagagaatgttttcaaaatgctatagctgcctaaaccttgcaaaatgaaaaacgagcacttcttcagcttggaacagtttataaaggaggcaagcatgtgttgtgtgatggttatgctggtgtatttgtgcagatgcatagcacaggctctgagagggtaagacttcatgattaatggtgtttattcttgacagaagcctcctttatttatctgcaatacagtttagcgattttatcaggcacctgaatgaaaaatattcagtcataccaatattgcagtgtaaattgaggagagtcactttttattatatctttctgccttatcatctgcacagtaattttctagcagaggtttgatatggaaaggctggatttagctgtacttgacacaaagcctcttcaatttctcctaaaagttcaggctgctcttagaaatgtgtgtgtgtgtgtgtgtgtgtctgtgtgtgtgtataatatataaaccttctctcttatccaagcaatttcaggatttgaaagaataaagataaaatgcacaaacctggatgggagaaatgttgttaatataaaaatagctgtgaactcactggtaaaagctcctttagtgttgaagcttgtggctcagtactgaaccttttgcaaggctacgtggtcccactttcttctaatcaatcaccatccaaatccagttagcataaagccagaccctatcgtttctcctgggagtagtatcaaagttgaagaccacagtggcccagagaggacataagttgctgcaatgattgtgatgctattctcgagaaaggaaaaagaaaagagttctcatttgtaggatactcaagtgatgggtcactaaattttaaacaaaagtgtattcaagcaacagactttataacatggtcaaagctaagcaatgacagacaggggaatatggtttgaatcatagaaagcactggattttaggaacaaatggggccttaaaccttgtgagtagaatggagatcatctactccaaagcttctcatttgacagatgaaacagtgaggctcaaaaagctgtttttgataagaccatggtcctgtgcacaggttttccaagggtaatatgaacaagtaattcttgcacatcatagacatttccaatcagatgaatctctcctcctttatggtactggaagacttgctttctctctgaagaaggaactgcagaaggagactttgtagctccttgttaagtagccagactcattttcagtcctccatgatgctgttctctacgtcttgagcaaagttcccgaaggccatgataacaagacccctaagaaaagtatccccttatgtagaagttgatgctgcttttctgttgaataatatagacaaattgttccccatcactacatacactctacagtacactacatatactccttttccatatgtaatttaattttgaaaagttaacaccctccaaggggataaagttctgaaatattgagaagtatgcttaggacataaagccttagtctcatatagtagtcctacaagctctacttccagttacatctaaagagcctgccacttcaaaagggctcacttttttcacctttatgggaccaatggccctagcaaaccttgaagattttattctggaggagagttattgaatcactaatgatagttccttgttggacatctctatataacttaaaataaaggtgattaaaagaatcaggggaagtaggagtgagatgtcaaggttcaagggataactcaaaaaacagactagttagtagttaacagtaataataattatgatgaggatgatgatgatactaatatggaaaaagtctttatactagctagaagatgagactactgttgataaaagattcattctgattcttgaggtagccttactgtcttcttggctcagaattctaggtgcttcctgtctttgttataaatatcctctataacacctgccaccagacccaagattaagcaaggattaaatagttggaacccaacttcctgttttcaattaattatatccacctagtacctgaagtcctctgaggggaaagttcttgcttgaataacagattctgccttagtgctgctgagacttttaaagtagctgtttaccttgaattgttgagatttccatgtaaatgatacaaacatgagctggtttgtttgtaaacagatctaactgagtctcttgtatgtatgttagagtcattttcccttacacttgatgtgtattatggctcagactcaaaagtttctgctaaaggaaatcatgatggataagtttctgcattgttggaaaatgtaacacctatacaaacaaatgtcacttatcccaggagttttctaggcacagttagttcatcatagagggacttagttgtttgaggagccattctttctacactattgggtgtcaatatttttctattttgccttgtattttcttttggaaaggatattattttgcctatttgagtattgtttttgagatggaattggtaattcatcaaattacagaaaataggattggtagaattaatggaaaatagagaggaaagtcacagaaatcaaactgattaaaaaatttttgttttctctatctctaaagacaaaagtttttattttttttcttcatggcaatgaagttgctgaactaaaactacagaattattatgctcttgaatttactttgaagaaaaaaaatccatcatcttaactaaggtaaatcaaatcgcttaatctatctgttaggagaaaacatgagatgggtgcgcctaagtaatgccgaagtgacatcatagctgaactcacccggccacaaacagctcactccctatcaggtccttgagggaaatcagtactcaacaaggcaacggaagccaggtgactttggccttaaccaacccagagctctaggaatggcagcagcagcaggaatgaaggtgttggttgtaggggccaacatttactgagaatttaccatgtgacagtcaccaggctacatgctttctgtatacttccctgttaaaaaggaaatggtacagtgctgccgcttctctgtctgggcttaagtagctggagagcaaagcaggcttttaaggatctagttcacccaacaggcaaacctaagcccaagaccttgcaactggtgtatagaacagcttactgaatgcacacttccaggtatagggagcaggagagtgagacagaaggaaagactcctttgatcctctgggcctggctggattggcctctgccgtggcctgctccactggaggaaaagggactacccaagggaaaaagcttggctgatcaaaggtaaccacttgttatcttaggggaagaggagaggaaaggacagcatctgtgtgctttcttaatgcagatcagttaggaaactgtctagaaaacagagccccatcagatgtcacagaatccaaccaatgagagcagctctccatcgcccattcaacatggcacctaggtggtaggaaaagaattgcaactggacatatgaatgtctcttttgacagcgacagctgtttcctcatcaaggtggtacttctgtggacattgtaaagatggacatagcatattagttcttctaataatgaattatatttatttttattatattaattaatttataatttgtaattaagaattataaatgaatattatattcatttatacttattaattccactttatatttatataatacatacattatataataaaacattttatataatagttactggttttatccttcttaccaactctagtaatcaggggaagaagataagaaaatgtctttcatttattagacattgcagaaacaaggatacctttgcgtgaactatttggactccatttggaggacaaaaaagtctgctaaaataataatttaatatataatgtgtattcatggaattaaaatatttaaaacatatgttatttaaaaacaagttgtcatctgccatttggttcaggtacgctcttttctccacttctttttctcttctgttcttaattctaaaatgtgagaaacatacattgagctctctttaaacaaaagttagtgggatagaacgcagtcccatgctatgagatgtggtcatttagctctcaagtacttatttgaaccagcagtatgttcattaagatctctttttaataacagtgcattgcatgttacagtggctggaatggactttctttttaattctttgaccttgaaattttaatttattaatgagttatatttacagtacagagtagagacaaatttggcacattgttctttgcagtctttcctggaaggaatgaaatcaattttagctataaacaattgcactgctcttgtacagtgatacttgtataacattgtttcagttgttggaagaacatgactaacatgtatttgtttggcttctctcttcacaagaagctcctttgattggcttagcggtagcccctgccccctccaaagttaatacacagatgtccaccttccatagcttaccttgaatttagactaatgtgtcagctagactatttttgttttatagcagtagatatgttattatttatgttacctttaaagcatcaatattttgtaagttttgagaaataaaaatgtgtatcaatttgattttctgaatttaattgaaatggttgaaaccactgtgggaaatctcgatgtatttggcatgtatccttttaaaaaattattgatgaataatacagagaaagttgcacaaaatgtacacatgtagctcagtaaatgatgatgaatgatcatggagtgaaaacttctaacttaacagttctagaaatagaacatccccacacctcataagcccttcttccatactctccacccacctgaaagtcaacattatcctgactatcctaacactgaagttgacttttgcctgttaaagaactttatataaatgggatcatacattatattcttttgtgccagttttcttctttttttagttaattttaatttttttctgatgaacttcccattttatttatcacatattttttatttttaaagcttttttattacatattttttatttcaatagcttttggggtacaagtggtttttggttacatggatgaagtgtatagtggtgaagtctaagattttagtgcacctgtgacaccagtagtgtacattgtacccaatatgtagtttttttatcctttattcccctccgctgacccctcgccccctgctgcctttcagtctctaaagttcattataccactctgtatgcctttgcatacccatagctcagctcccagttataagtgagaacatatggtatttggttttccattcttgagttacttcacctagaataatggcctctagctccatccgagtagtttcaaaagaaattatttcattatttttatgggtgctgggcttcttctatccatcattatgtttgtgagattttttatgttgtagtttgttcattttcatagctgtttactgtttcattgtatgcattatttgtccattctactgttgatagatattaggttgtttccaatttttaagtggatgactaatgctgctatgactctttgagtacatgtggcacatatgcacacgtgattgtctcatatattccaaagaaaaggattgctggaatatatggtaagaatttgtgcaagtacccaatgcctgattgttttccaaagaggtagttctagcttgcgctcatattgagagttcctgttggcctaaatcctcatcaacacttgtcactgtcagacttcttaattttagccactctagtgggtgtttaatgataactcattttggttttaatttgcactgcactataaatgatgtttatggagagttagttaaaagataatagaaaaaccttatcatactaagaaataaagtataattcaaaatacatgatttttatttttaatatgtaagaagtgcataatgcctgagaaaatgctggaagtaattatgttaaaatgttgacattggttagcttggatagagtgaatggctatttcttttcttaaataaccacttgtctttttcattcatggaatattaagtccttttatactcagaataagagactttttttttttttttttgagacggagtttcgctcttattgccctggctggagtgcaatggcgtgatctcagctcaccacaacctccgcctcctgggttcaagcgattctgcagcctcagccttgcaagtagctgggattacaggcatacaccaccatgcccggctaattttttatttatttatttatttatttatttatttttgtatttttagtagagacggggtttctccatgttggtcacactggtctcaaactctccacctcaggtgatccacccgactcagcctcccaaagtgctgggattataggcacgagccactatgcccggccaataaacttatttacaaaaatctcttgaagtaatgtttcatcattaaaacaaatatttcttttcccttctctgtctttaaaaaaatcagccttagcctttaaattctccatgtaagaaaatattcatcaccttagcattaatgcatacgttaagcaatattctagccctcacctttagtggccactttcattcaaatcatatttactttttgtgctggttcattgtccatatttttcatgacccacatgcttttgggagcctcctgtgaatgctttttagctgtgccaccactcattaggtcacatctactcatacacacttcttttgagtgtagccttttgcctcatttgactgtaggctctttcagagaagagaccatgcaaccatgtatcatgctccttgaaatctctcccaagtgcagaaatcatagcggattcttagggaatggattttcaataaaatgttatattagtccattttcatgctgctgataaagacatgcccgagactgggcaatttacaaaagaaagaagtttaatggacttacagttccacgtggctggggaggcctcacaatcatggtggaagatgaaaggcacttctcacatggtggcagacaagaggagagagcccgtgcagggaaactcccctctataaaaccatcagatctcatgagacccattcaacatcaggagaacagacccgcctccatgattcaaccacctcccacatgttccccccaacaacacatgggaattcaagatgagatttgggtagagacacagccaaatgatatcaaatgtatatccaatgaagagatcattgaaatgttcatctgtgtggttatacatgtagtttttaaaaattaaaatccaaatggtaaatttgtaaaaagcatatgccaattaagaattcatggaaaaatatttcatagctacaaagatgatgaaaataggattggaaatggaaccattttatcaactaggggcctgggggctgatggagtgggtatgtacagaggtgtgggtagggttaaggggacaaacaagtaatagtaaagcccctaatacagtcaaagttggaatgaaaaagtgattcagtgagggctggagcagcagaggagggctcgcccaccaggaacagtggccttgggggagcaatgccataccacagagccacagctagcagagagggaggaggggacttgttttcccttcctgccatctcctgccttgcttcccttaagtggaaaccggagggaaggcgagccagctgattcagaccttaaagacgagactccccacacaggctgtggccttggggaggaggaagagcagatggaaagtaaccaccataaccatctgcacctctcagggtcacgtggtgtttctagggcagaggttatctgaaagcttaccttgcatagagggaaaaaaaagtataggattgtgcagatttatgacagtgtctactgttttactcttgaacattttagatatttgttttctttagtgtatggaaaggaagaaaaacatatatgtgtatatatatgtgtatatatacatatatgtgtatatatgtatatatacatatatatgtatacatatatgtgtgtgtatatatatatgtatacatatatgtgtatatgtatataggtatacatatatatatttgaggcaaggtctcactctcttgcccaggctggagtgcagtggtgcactcatggcccactgcagcctcaacctcccaggctcaagtgatcctcctgcctcagcctcccgagtagctgggactgggactgtaggagtgtgccaccatgccagtctaatttttttatttttatttttctagagatgaggtctccccatgttgctcagattgatcttgaactcctaggcttgagtgatccttctgcttcagcctcccaaagtgctgatattaaaggcaggagccactgcactgggacaaaagcaaattttttcttacaaattttgatttattaaaatggtatttattgaataattaattaattggttaaaaatgcattaaaaagaacaactaccctctgttctctatcagaccactgcttgaatatgaagaaggatgtctacttgttatatttaaaaaaacaaaaaataagcttatgtaaaaaaccaacatatttcagtcttccagtagttggagcagtcatgcagagatgcaggagatatgtgtacatttccagtatcccaagcaatgtgcgagcaaattgtaataatctggcatgtaaaccttgtttaatgctctcataatgggtaatgcaagtgattaaatactgtgattttaatcttggcattttagtaacctagtaagatagatgaaaaggcagtaatgaattagattatataataatatttcattctaactcagaagtccagttattctctgcaacatgttttaagtttctcatggtgtactgttaaaaatgctctgataagaatcttctactctttcattgtaatctattttcatgaccatataaaaaatattctgaaatcaagttacctacaccaacaaacagtttccactgggcaatacggaaacaaaatgccagtgactcattaggtctccaatgtcttggaagacagaggggtagaaacagcataaagggccttatccctgagaggacacagaggcattgcatacaggagccaagacacagggataatggggcgaggcacatcttcccagctgtgccctgtagtcccaacaacactctacagtttgggaatctctggtgcccagacagcagtttgtcagatttagtttggagggccacaggcatatttctatactcttttgctgcaacataaatagcatggaatgtctgttcttggaccagttctgaatttcagtgtttttctcagaatgtttgtttgttgttctttcctccctggtttgtgtctccctccaatgactgagccacagacagtcccaggacagagagaaggtggactgccacaaagaccgaaagcggtgatcctcagttcatttctgtgtgtatctactaaaaatgtgcatcaagcagacaccacagtttttttcctggcactacttttaatcttcaaatgaagatttttaacaagctcgacaaatatttaccaggccaagttgatgatagtttgtaggaaaatatatgtcatttctatgggaaattttgtggccgccttctccatacctcccctgtcctcttccttcagtggaattcagccctcctctggtcataatcctgagtgcccctcacatagcagtgaacacacgtctgcctgataaatttaaggagcttaaccttctctcccagatttgctttccagttaaaaacacaataattgggccgggagccatggctcacgcctgtaatcccagcactttgggaggccgaggcgggcggatcatctgagatcaggagttcaagactggcctaatcaacatggtgaaaccttgtctctactaaaaagacaaaaacttagctgggcatggtggcacatgcctgtaatcccagctactcgggaggctgagacaggagaatcgcttgaaccctggagggcggaggttgcagtgagccgagattgcgccactgcactccagcccgggcaacaagagtgaaactctgtctcgaaaacaaaaaacaaagccacaataactgacaaatgatctagctgccaagaatttgaagatggctccgttaggtaaggttaaaaacacctttatttaaagactatttacatgtcaggaggctgtttggctatggtagttgaagtttggatgctcagctttgtttgcttagaaactcatttttgtcacactttagcattagagaaatatgctaacccagctcacgagagcctaatgtggaaacaattaataagtgaccacattttaatgagaaactgaataccagccactgctccgctagggaacaaatcgccatttggacttttttttttctgagtttagaatcagaagaaaagaagtgttgttggctggttctacaagaatatcaacaaccacagcacttaggcactgtgttcctacctttacacacaggatttcagccctcacggcagctcctggagggagctgtgattgttccaattttgtgtataaggaaactgatgcttgagtgagggaataagtgaagaaaccttcaaatcccattccttcaaagcccttgcatttaattactgacttcattttcttaaccacctcatgtgactttatgattttactaagggaggtcctggaaaatccaaggaggtgcctccaaggtgctgtcagggagaggagcaaagccgactggtgtgatcagatttgctatggaaaggggattcttccacacaaaaaacctggacacagatgtttatagcagctttattcataattgccaaaacttcgaaataaccaagttttccttcagtaagtgaaagagtaaataagctattccatacaatggaatattattcagtgctaaaaggaaatgaactttgaaaaaatatggaggaaacttaaatgcatattacgaagtaaaagaggccaatctggaaagtctacatactgcctgacattctggaaaaggcaaaactatggcgagggcaaaaagatgagtggtttcctggggttgggggctgggagaaggaagaagggaagaattggtgaaagaggatttttaaggcagtgagactgctctgtatgatactgtaacggtagatacatttgcccaaacccgtagaaaggataacaccaagagtgaaccctaaactatggactttgggtgacgatgatgtgtgagtgtaggctcatcactcgtaacaaatgcaccactctggtagaagatgttgataatgacaggaggctatttatatgtagaggctgggggtgggggttatatgggaaatctctgtactacagctcaattttgctatgaatttaaattgctctaaacaaagtctgctaacaaaaagaatgtcttaatatttcaatatttgaaatcacacagtatgttgcatttgctacccctactatgcatgtatatatgtttatatgtgtgcatatatctgtgtacatatacacatgtgtatataaatatgtttgtgtatatgtgtattatgggtggaatatgttagcacagtatgtgatgtatatgtcacatatgattttacatatggatgtatgtgtatatttgtatatatgtgtgtgtgtgtatgtgttgagcattcagtatatactaggctcagtacatgagactttactcttgtcaacttcctaagactcccacgaggttatcttccccattggacctttaaggaagaggagaaggtgagtatcaaggctgaggtccacgcacattgagtcccactgcttggatacatctgtatctagaattcctgatgacccccttatgactgcctgatgcacctgtatctttatcttcaaatcctggaggaaccctcctttccactgttgcttctcagcagtatgtaaaaggaccgtagagcccagtgctcctgccagagaagatatgaccaggtcttggagcctcactcgtgggaagctggtttagtaggtaccttcagtgtcctggtgggaaaggcttgaatccaagtgaagcagtgacagggacatcagacttgatagacttttgtgaggagaaaacagcttcctaggctttctttgggattgatgaccaccctagcctggccgctataatttttgtgtttttctagatgctgattggttttcctgtgcataattctccaaaatagaatttggacctctagggatattcttaccactcttctcaactctggaattttggagaaataataggtttcaatctttgggtaaatcaagaaaagccagtaagaaatgtcactgcccaccctgatgtttagttcatgttgctcagaccaagttattcctggattgcaaaagctggcccaggaggcgtcatctcatggctttcttgaaacagctcttctgcattcggtggcaccagtccctcagtggaaatctataaacaagtctgtgtttagaatcagattggaaggattgcttgtcctttcttgtgaagaataaatgaatgaattagagcatcccctgtaccttctaaggtagcaaacacatctaaatacggtgtaagatttaaccaatggcggacacgtctaaatggagcttaggggctgagttaacaaagaacagaaagccaacttgttttgtagtaaagagctaaaataggaaagactaataggttatgttgatttctatttaaacaagccattttactaatttctgattgggtgtgaaagcctcaagctgttttgaaaagaaatagctatttgctggtggtgatttcttactcttcccatgtgtaaatttagaaaactttggatttttattttgctttcccaaagtagcatctaagtaacaaataaaaagcctcattttttttttagttcaaaatgaaaaaagagtcagaaggagaaagtgagaaaatccacccccaccaccatatttcaacttctttcattttctactgagagaaaattcattatctgatctctgatttcatttatttcagtgtctgcgctgtgcacttagtggagctggcttttaccaagattatattctgacagggtgatgggggccgggctgtgcgtgagcatttgctttgcaaggagaaaatgtgtttccccctccctttcatttcactcctaaagccagtggtggaagaggaatttgctgttctcagttgatctctctctatcagggcctccccttcctatggccgcaccctctgtgaatgaggaaaagcggggagcacaactgtttaacctgtcagagccagttccctgattatccatgccaaatgttttccgttagagaaggaacttggtggtccaggaggttatgcagactggccattctagaagtggctgtctcagggtgtggctgtggctatggggcagcaggtgtgaggggattttgaggaatctctctccagaagcagatcaggatatcgtggtagcaaggtgtgttttagaatttatttttattaaccaaaagcctacattctaccttagctcattataaccgacgcaagggcttgattgaaaatgcattcttccccaactttctaacccgggagcacttagttgctactgctcactgaacgtggctcatcgggatgcctcatggaaaagggcttgagcagaaagctgattccaggtgctgctgcacaaaggggaggagttgccttccaagcactcacacctggatccataaaagtcattttacttaccactgcgaggccctgggaagttaaacagacatgtgcctggatctttagagtgaccgatttcccatttctaagcagacttttgcaatgggtcttcttccttacggacagctctgccatgtgcatgatcaggcttccagaccagacaaatttgggattgtattctttcattctgttctgttctgttcttttctttccctttcttttttcttttcttttctttcttatttttatgcaacaccatgctagtaagaggtaagttttaaatggtaacattaatatttgggtcaagtggaaaatacaattgtagcaaccactttaagcccagttgcctgttatttagaatttcttctcatggaagaagccataggttgacctttattttactattttggagtgcaatgaagtttctcagagatcaatttattttcccaaacaattgcatagcgatgctctgcctgcattatatcatgctgattttaaaataatagtactaatatgtatttgcctgcagttttttccacaaggctcctttgaattcacttaaaatcttacttattttctttcagagacagcctctgcctgtggagatatttgtctcatgcataccccttgtatctggttttctttgtacccaggacttccgccttatctagtagccctacgtatccggacctgcccttcattaggatctccccacaccggaaccccactgctgcttccgagtctcccttcagccctccacatccctacattaatccctacatggactatatccgctccttgcacagcagcccatcgctctccatgatctcagcaacccgtgggctgagccctacagatggtaagtccaggatggattctgcttctggagatcatgcagcctcctccccgctcctcactcgggacgtgtataaagtagacctgatgtttagtgagtgtttcccatgtgccaggcgctgtgctctgtgccttacatgcatgattgcgtttcagttttgtaacacctcattggcagtggtgttattatctccattttcatgtcagaatagcagcgtgcagtggggtttacttgcaacgcagtcaatcccatggctagtaaggggcagaggtggaattcattgaaaatgtttctgattcccaaatccctgctggtaactagggttctgttctgctgcttcacatatgattagactggtcctgtagccattcacacacgtgcatgtgtaacatgagtgttttactcaccttctgatgaacacttttctgttctgtgtgtctgagcacatttatacagatgcgtctgttagaggagggcttcccaaactctagtgtgtctatgaatcacctggggagcctgataaaacgtgattctgcatcaggtgggatcaggtggggcctgagattctgtgctcctcaaaagccgatgatgtcagtgctgttggtgcctggaccacactctgagtggcaaggtcttagaaaacatcatggtccagggctgttgcctgtgctttctattcttgaccatgccacatgaaaatccgaagaagtatgtactgggaaaggaaatgagcttagactttcttatacttgttgctcattttaggctcttaaggatcgaattcctgttggttctgttagtccccccattactttccacatgactcttcttaattggagctgtgtattctcctggtgtcaacttataaactggtcctttgattcaggaaaagtattttccatatcacgcacacataggaattcacttgcccaataatcactggaatctgaatcaaggtccagaattgcatcacctattaattacaggtagcaggctctgaattctttgcaagagatcgcaaatcaccactgcctgttccacatcagagaaacaccaggcatttcatttcactgagcagtgcttgatgcgacttccatgccctatccacattctctaggtagacgccttcctgaggctgggtgtgcatggtgagaagctgcatgaagtgtctcaggaaacatccactcacttgggttttcagaaatagctttccttcagtaacagccacttttttcttttttgattcagtgcattgaatttactggttaataatagtaatacaggtagctaaagaataagttttgccctttgggcaggattaacattttattttattttgagaaagggtctcactttgttccccaggctggagtgccttggtgcaatctcagctcactgtaccccagacctgctgggttcaagtcatcttcctgtctcagccccctaagtagctgggaccactggtgtgcaccaccacgcctagctaatttttatattttttgtagagacagcgtttcgccatgttgcccatgctggtctcaaactcctgagctcaagcgatctacccacctctacctcccaaagtgctgggattacaggcatgagccactgtgcctggccaagattcacattttaaaaataaaaatcaaatatgaattagattttctgcttcagattttattttgcacttgaagaactggagaatcatctccttcaagtccttgggagttggtggaaatgactaacaaggagaatagactgagggagagagggaggctagctgacaatggacttggaattatgcctggcctgcagaaatttattcgggctagtggaaagtcataccacgagttaaactactgaaagcactcttatcatctgctttgtgtagcatttgatgacgagtatatatatcacattctttgactggttcatttgccttccttttcttgcctctcaagaatccagttaatataatcaaataaagtaacatgataaatatttcccttgtggcctaaagtttttttccttaaatctctatctttaccatgtatcatggataaaaagtatatgaaacaaatataaaatacccacaaacctatcactagagtgctggtatttctagataataatcgtaaaacttttattgattgaatgctatgtgctaagtgtgctacatacataatttaatttttgctcctgacgacctcatggagccagtttaaatccagatctctatgagtctggaggccaccctcagaactgctacaatgtcttgctgcttttgcacgaaaattggcaggtggaaaccgactattatcctgttagaaagctgagtcttggcagtaaattgctccagattgataggtatattttctttttgattttgtaatgaagaaaaggaaaagagagcttttaaattatggaatgtaaaattgtagcttatcattcagttgtgttattaaagctgtgctgccttttttcatactggtaaaccctgacttttcatgtgagtgagagttaactcagacactcttgtcagaaagcttagaaaagtattttaagtatgtctggaaagatatcatagtcttctaagttgtctactattgtaagaaatgcaaacatacagtgatttgatataaaaatgattttatttggggggcaaatgtggttatgtacatatatacattttaatcattctgatttgttgataatttcttagaccaacaacaaaaacttagtaatgcatttcacttttttctattcctttccttcagttttattttcaaataaaagatgtttcatggaagtaagagcacaatttgagttaaaggagctttactctaataagccataaaaggaattgctgatgtgggttgtgtaatggactctgagatgcctcaagagaaacttctagttgaccttctttcgctagtaaccatacatctcttgtctcctcctagcgccccatgcaggagtcagcccagcagaatactatcatcagatggccctgctaactggccagcgcagcccctatgcagacattattccctcagctgccaccgccggcacgggggccatccacatggaatatcttcatgctatggatagtaagtgacggggctggtttctagagtcttgggaaatggcaaaggcaactttatgaaacagagaagaagatacaaagattaggtgattgtgtaactttttgatctggaggagaaagtggaaccaccactatctggtgctctggttcccttcgttttctagaagcttccacagatttggacatcctgagaccccctgtttagctcaaggataccagtgaactgacagatgcaggcaattgtaattgacagcgatatataaatattagctggttaaaaaaaatcccagcccaggtgacatagcgagatctatctctacaaaaaattaaaaattagctgggtgtagtggcatgtacctgtagtccctgctactcaggaggctgaggctgaaggatcacttgagcccaggaggtcggtgttgcagtgagtcttggtcacgccactgcactccagcctgggtgacagagtgagaccctgtctccccaaaccaaaaaaattttttcctgtcgtgattgtcttgataacaaaataagggggaatggatttgatatatggatggactttgcctccccactccttggtttcatggattttatgctttaaaaattaattttaaaaaatacctgttttaacaggttttacatttttgccttaaatgattgtttgccccatatgttttctttacattaaaaaaattgtattccactaagacagtttgtagctgctgaatatatgaaaggatcagaatagttatcaagttatcaatagttgccaaatagcttatttggaaaaaataaaaactttttccaaatcagaagggactacttttagtacctagcagtggaataaggtgagattacttgatgcatgttgtatcacttattttggggtcccttaggtgtgtaatgatttttgtgggtcacttatgtagacgcatagacaagtaagcctataattacctctcatcagagcattccagagcgctcatctcttcagatcctttaaggacacatccgtttgcaaggcgctctgaagtgatcctaaagcatcatccaagtcatacatcagcaaaagccactacctttgaataggacaacagtatgactttgagtagggcctttgcttagcgttttgtttgtttttcctagtagcagcaattaacttacacttttccatttacaatctatttggattcttctgtgacagagggcgagcatatgtcctctagttatttagtcctgagtctcggactagaaagaaggtgattatttcatacaggggtaaaaactctacagccttagtctgcttaccatcaagagctacctttgtgtgtttcattggaacacaagattctgttggtttccactgggaagctcattactacatggaaagtaaaagaaatgtgttacgtcttcttcaggcgttctgttgtttggctttttagcatagagagcttacatttcagattcatcataaccacatttcaattagcgattgttgaaaaaaaagttgtgttattatgcaaatcagttatttaaaatctgcaaataaagaattaaaataagagagaatccttggaaggtcagcccgcattactttccctatttgatgagaatgtgtttagtcaggcagtggcggtttttatctaaataaaggatgaagctacccttttactttgtaaaaactaattaaaggaattttaatttgcctgagtatatggtaaattgattgtcattaagtaggaatttagatgtcctatcattcatcacataaaaataaacctcttttttctttgtcagaatttcttattagaatagggaaacaaaataattaacagaaagccagatcggagatatctgtgttagaacaataagaattctctggcttatatttaagaaggaagtggtatgatcagtgaagaactgggctacttctcttttggctgttctgaaaatgcttaccttgtattttagcagctcccttcaacagagtatcccaaatcactgtccccaaatgctgactttctcttcttttgcttgtttattaaggagttgggaagaacatattaaagggctggaaagttcttaaggcactatattcttttcctctaaagtaattgaagtagcatttattaatagttatttagttagaatataagaagattgcccagaaatttccaccataggagattttttccaacaaagaagcgaaacattaatcctaaatttttatagtggttgtccatctgcagtggtagatcgaaacctgggatctatctggtcactcttcatcccttgttacagatatttaggacttcttaattaacacaaccctcaataaactgggttcaggtaagcacctgacttttaaatagtgggcacgtctaggtttcagcaagatgtaggacagagtgtttatatgtagcttgttaggataaactagtctgtttatggtcccaattctacctctcagtgttggagtgaccttaaaagatgagaacaaatactccctataaggaacattctagagatgagggcccctgaagaccactatttatattggtggaaatagacttaaataagagccagtcttggagggaaaaacacagagaggaaaggttccagccaggctatgagcaagccaaagggtttcatggaaagggtgaaaaggtcttgagaggcccctcaccctctttggaggatgtgagagtgatctaaggctcctagggtttgagagcatcaaatgggcttcttccttttgcatcacaattagtgatctaaaacattagagattttctagggatatatccacgtcctgtctagcatgtgctgtcacttctaactttgccagtgatcactgagtaccattgagaagggcaattattgtccaggattatatggaagttgataacaaatctggtttgtcacttggaagtgacatgtatttcctcattgaaaaacttccatgatgaaattagcctctcatggtgagtaaatgtgaaggagttgtgtttaataaggcagatgccattataaaagtaagatgctgatttaaatgccttaaaaatatgcacaggtgggcgcagtggctcacccctgtaatcccagcactttgggaggccgagactggcggatcacaaggtcaagagatcgagaccatcctggccaacacagtgaaacccccgtctctgctaaaaataaaaaaaaattatccgggcgtggtggtgtgtgtctgtagtcccagctactcgggaggctaaggcagaagaatcgcttgaactcgggagacagagttgcagtgagccgagatcgtgccactgcactccagcctggcaacagagcaagaccacatctcaaaaaaaaaaaaaaaaaaaggaaatcgttgggattgctattttgtgctaacatgctctaaatcaggctggtaatgaaactattctaaatgaaggaactcgttttagttgtgcctgaaagaaaaatttgagtaggtaccacatttatcattcaagttggtttttaagttttatacgtggatggcactaacttagtaaatttcagtttgtggattttttttcattatttctatagtattgacaatgaagtcattcatatttatctatcccatttaattaaatgatctctaagcatgttggattgttatcttgtatcaagaaccatctttattgaataaaatattcccaaagaattttctggagaccaagagcctggacatttttttttaaataaagaaagattacctgctacttcagttgttctgggtaccgcaaaattgccattttcctataaactggtatactcattctatgaggtgttagaaactcttcattttacttaaaactaatcatgttttgtttgcctcctacgtggtgagattatgttctcattcgttcattaaactttagtttgatgactctgtaatgtaaatatgaccttcaaaaaggcagaatggacctgtgggccacattcatctctgtgtcttgaagctcacatctctaatatctaccaaatttgaatgcaaattggcatttaattttgaactcttcaggaagaaaccattgtattaagttggcatgcatttaagtttgagttactcacctccggatttggactccaggttaagactccatcagtggaatcttcttgaaggttaaaaattctaataaatttattaccccttattgggtctgactagagaaacaaggtccagagaagagctaaaatgccctataggttcattgtacctcgttatcatgctcgtaagggtttctcctctgccttggaaaatctgtaaacaagcaacatccccaccttttaaatgtttcttgggatttatcctcttatatggggaatgtaaggcagaggtcctcaacctcggtgacatttgggccagataattctttattgtggggagggtgaccctgaacattatagggtgttctgcagcattcttagactctaccctctagattccagtagcatctgctgagtcccgaaaaccagaatgtcttcagatgttgtcaggtgtcccttggggggcaaaattgctctcagttgagaagcactgattcagggtaattatgtagaagttgttttagtaatgctttaagtataccatagagcaggtaactctagaaatcactgggcactgagggcataactgagctgaatttttaatcttaggatactttaattcatttccttcctttggctcatgacttaaaatggtgtgtgttggggtggggagggtggtatgttgccattgtgggaaccactgtctttgtcgcttgtggtgaattaatgatgggaatatctaagcagccgtcagattcataaatcaccagaaatgaaagggataacacataaaaatctctcccttttgtttagcaatttatcattttccctgcacattaataaacagagctcccccgaggtaagcccctggaagacaaatatttctccctagtttcctcaactgtagctagtagatcacatgggggaggagaggtgcttgtcaccgcaagttgccagcttcttatccttcacttcttccacgtaggcaagtagcaataaatagctggtatagagtccaactgcaggtaattaggttcttttttgtttatataacaggcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcaggtatgtattttcctgaatccattatgtgttttttaaatgtaatgtcagcacttgtttgcacctgtagtgatgcattttcagtaccaactgcctatgaggaagaataaaagtgcatgatgctgtgcctataccaagaggcaggtcaaatatcacaatgaattgcaaaaccagttattgggccccagattattttgtgtttgcagacattagtcaatagcccctatatagaaatagcagttattgagttatgatgaaatccacttcgtagagacagtaagtagggcaaatctttttatccagccttttccttgtaataatgttctctagaggaaaactgacttcatacctggttgtatgacacatgtacagaacatgaacaaaaataaaaagaccagtcatggcagaagtcttgtcctacaactctgaagagaaaggagtccatgggagggagagagaaacagcaggacttttcgtctgatggaaaataagtgcagatgacattggaaagcatagatatcagaggaaatctggcaaaagaatatttctttgtttttccattaagtatttttagcttaatctgaaagatccctattttgaccatacacctttgttaaccgtggatagttccttgcttgacagaaagtgttttgacacttccttccatgaagcacctcatgtctgtttttgcatgtgaaggtacaagcacagacttttgtaaacatgattaacataaaatatttcttactgctaatgatcaacttggactgatgtcagtaagtagggaataaaagtaagccaacatatgaattttaggtgaattacctgatcatttattgtttgaactaagccagctcacaaatggttgagacatagaattagatagtactctaattaattaatttagcaatcctggttataaactttaaactctcatttcccctaaattttttgccaataatttaagaattcagttactagcaatctttttgaattgtagttttgttaattgtgaataattccttgcttgaaaagtacatactaacggatgttttcactagcctttgttttaataagtgaggttttgtttgtttctatgaatgagcggtagcgttagttgttcattgataggtcttccatggtagattacaattagggaaacttcatcagttcagaaaaaaaagtgtttgcagtagcaagatacccacatttagtaaaaataatgaatactgttgtctttccctaatgttctccattacagttttaattcttgttcaattatcagcaatgttcttcagtaggcaagttaatatttaaatgtggtaaatcctaattttaatatgatgtcattttccgctgcttttctttgttcttttcatatggtcactgaagtgtggaaacgtggatagctgcaagcaactgtgatagcagtcagtgcacagggaggggtcctggggcactttccagattaaccactgtagttacaaatataggctttagagttggatatgtctatggtcagattccagctttgccaccaaccagctatacaaacctaacttacctctcagctctttgaagtttagtcttcacatctgtaaactacagataagacaccctctatacaggaagaatgcacattttactaaagctggtgtggatctgcaatggcaggatgagattcctacctggggtgaagtttcagggggagctgagctgggatggttcatccaggagaggagccatcctgtgatggctgtctatgctacactgctctccatcccagtctggccccgaggaagcatgccagtctcagaaccctggcctggctgctcctgcactcctggcgaatattcctgggtcatagactgacatggactggaggcgactttactgcaattgtgcaattattacatggcatgactaaagtcatagcatccaagtagcagaaatgtggcacacagtgatagtcagaaagataacacacaaaatcacttcatgaacattcacttctcttgtttctctttactttttctttcctcttgctctctgcccaggtctcttgactttttacagcatctaaaggacatagattagaatatggtatagaaatggtcatgatgctatctttatttattcctaccccagcctccttagtccttacggtctcctggtctcctcatcttcacccaggtaagctagtgacagtacttaacagactgtcaatctgctgacttgaaatcatcattgcccatttcgtctccaaggagctataccacaactctttatatcattagagatggaagaagagattcacttaaagaccagtcaggtccttggaggctgtgacagttgggtgcctgggcccattgtgtcctcattttctttcttgcctttgagactttcgattgcatcttttctctctcagtgcaatctctccttctttagtacacatttgctgtattttaggactatatgtctattcttacacagagcaggtaatgcagataacccaagatgagatcagcttcccatataatgatgataataattgttatcattggcaccacttgccagttctttagctggaggagtgctagtgccttgcttactcctgctgtaagtttcattttctgagatctaaaaactgacttcaggaataatcagttagtggtagcaccagaggatctgggaaaggaaagaagcaaggagacatctagaaaaggtaactaactttctcaacagcgaaaggtacaggagagaaagtcgacttcaggtgcgtttagcctctgcgacatgctgactaacagggcaggtgcacggctcatgctcactcaccgttctcacgtcacagctatttggcaaagcaagtggtgttattattattattatttttttttgagacagagtttcactcttttgcccaggctggagtgaagtggcacgatctcggctcactgtaacctctgcctgccaggttcaagcgattcttctgcctcagcctcccgatagctgggattatagtggcccaccactgtgcccagctaatttttgtatttttagtagagactgggtttcaccatgttggccagcctggtctcgaactcctgaactcaggcaacccacccgccttggcatcccaaagtgttaagattacaggtgtgagccaccacacctggccttattcttgttttacacataagcccagtgggtctttgcaagatgaagttagcaaagttccgtgcctggtgggcatcagcactagcactccagtttcctgcttgttaatttactctaaacacacttgactttcacacttacatgttttctaatacctaatttgctgttggtattggcagtgcatcagtaatgatgtttacatttctaaacatgtcattaaatgtttaaagatactcattcagtttctaagaaatgccatagctgtctccttcacatctatgccctagtgcaaatgtggttaaagacgcctgtaatagcatttaccactatttgacgtttccatattttctttctcctttagtagtctgctatccatttctctccaatagaacacaagcaccaaaaagccaatcactgtgtacctcttgtttcaacccctgtgacacctgcattctctcatattgatgccattcagtaaatatttcttgagtaaataaattaaggagctctctcatgagtaattagaattctcatcatccccttattaaagtaagtttctacatggtggatgaataattctggctttctgaaagttgcaatctgtatgagtgttatattattacatggccagagattgatagatacagagccagaggggtgaatagaaaataaaggattaaaaaagcaaatgtctattttaagtttgtgtgtggttcttttgtttatatatttacttaataatccagactactataaaaataccatataaaactaatatttattcacaaaagcccattgacatattataacagtacttgattatgtcagattttttaaaatgcattgtctagacgtacctgacaagtcttttaaaatctcataattaaatagctttcaaaaataactccatgcacattggaaagtatgttataaaatattgcatgtttcaagaagttgtggcttctccatcacctggaagactccccatctaagactagataatttatatttatcaaatacagccagtaacccccactctacatagttaaggctaacgttgtaaatagccagtgaatcacagtaggttaaaatagtgtacctttgctaaaacccttctctctaggaaattgggccaccactggaagagaaggtgtttaaaatgacccccttcttctgtagtcttccggcaaatgtaaatgggatgaagaaatgagtactctacgcatttctaacccactgggtatcactttctcactttctatttaatggctacaatgaaagtggttttatattcttagtggttttaattctggtgtgaccaggaaagagatctcagtgaaaatgacattcccattttgcacatcacccctctgagtgccaagatctccagcgtcacaaaacagtgcaatgtttttctgttgccaacactgatgagctcagcctgatgatgagagggcaagttgtgctttctgtttcgtggatcatcagccctgtctgacactaggaccctggagtaagggtgcatctggcaggtccactgatgctgcctgaggcagggtggaagtcagctcggcctccatagctccttggctctgtgcttagtaaacaccttgcttatgtcagagaaataacacacaaatgaattgagaaacatactgacaaacagataaatacagtgccaaattaccgacgtctttaaaattctcattctgtcttctaaaaatttggagatgacattcccttccccgattttcagtaaagtagttaatactaccttaaaaagatagctctcatttacttccttaaaagtaattaatattacctgaagtggtagttagttttatatagtatttcatttaatcagttattaattccccaaatatttagctgagcttaactctgtgctagtcgctgtactgggggaatgggggctacacaaatgcctgagagagacacgacccccaccttcatggaacttacagaagggaaaagcctctaagcatattaataaacgaatgaatgagcaaaagagctagtgagggaacaaatgaatgaacaaaggagcaaaggagctggtaagggttctggtcagtgctgtaaaggaaatgacccagatgttaagaaagaatagcaccacgggcctaattcagcggattggccattgacttataggatgatgacaagataccctggaaagctttctacaagtttctaagaaggaggccaagcaggtgaaggccctgaggtgggaggagtaaggcattgggggaactgtcagcagatgacagttaaacacggggcaggttagccaaagcacaaggttggcgacacaggcagggtccaagttataccacagcatcttggaccacatatctaaggacaataggaagggcctaagatctggggccttagatctggaagagcagaaatctaagggccttccctggaggccccccacaaggctgtttaattttacagataaggaaactgatgttaagagaggttagcagactgaatcaaaggcactcagttactcacatggcagaaccacaaattcaacctggtgggtcgaactctgagtgttcaccagacacacttctttctctcttagaaatcctcaaatgagaggcatggtgaaaagcattggcgggaaatgctatttataatagaaataataatacctgatgatattttgaagaaacggattatgcatatattaacatgatttttctaaccacatctaacatacctgatgagccagatctcatgtaagagtgtgttattgccattcacgttcattgaggtcatatctatttggctgcttaatggcaagtagctttttagctttttagatcagtttcataatgtaaaacctaatgtatttttctccaaagcattattcagagagcatatgcctaaatgtaaatgttgagatacttaagagcatgtgggtctttgtgtactctacttctgaggctgggctgggtttccaataaacttgccctggaaacttttatagatggaagtggaagctttatttttttccctctcaaatagaagcacatgtgtgcatgtgtgtccctacacatatacaagtaatgatagctgttggcccattctctgcaaaactggaaaaaaaaaatggttctttggatggcagctgttgtgcagtgaattccacagctgtaaccagagtgaggatgacctcttagtgcaacagtcacaaagtagccaggaagtttggcttggctttgaatgtgtctctctcccctctcttttcttgaagtcagtttctcacattctggtaccatgtcatctcagtggttcctgttgcctgactttacttccaatcttgatttcatgagcaaaagaattaggagaggtgggatactcattggattcttcttcggcctgtagtaaactaggtttgttgtagcatgaagtttcttaattccagtgccctgacctaaaggaatacatcctgatactatcacatgagtttcttttaaggatgttgaaaaaattcaaacctgaatgaaatttaacaaccaaagcaattggaagaagtgttttataggtggcgggtagacagagttgattttacatttacaagacatttcccaagaatccagaagtgccacatattcattactcttcacattggactgagagctggcgcctttgtgatggagtgtgattaccactcacgccagggcttgcctgtggcttagttctctaatgcatcacctacctgcccagctctgtgcacaccgcgctgggtcattgagagatttcagagatgaacctggaaactgaagagccttcctttctgctcagcttcctacatcctcctgtgccctttccccacatatatcgtgtgctggtgcagaaaccctggcactgtgattacatgggagtgagatattccatggcaactctaggaaaagctgttatgttagggaagggttaagaatgtcctgtggattgaaatcatcaaacaataaaatagtagcttttacctttaagtgtgtggtggctggatgatacggcctcttgacatttttcgtactttcctctattgttttctttatttttatataaaaacaaatttcttgaatattgtaatcagctcttacttaccattccaatttaaagggctacagcaagccatattatgctgctttatttatagtaccattgttaaggaatccagtatatccccagcgctctgaccctcctgccttatatagaattcctgaagcatttaaaaaacataggcttttctcatatactgttttaattgggttttatccatttgatttgaatattaatgactttgaagtgcctatatgtatagtagggtaaataaatgtttaatgattgattttctacaatatgaactctgtgtttccattttatatattattttgggaataaatataaattgtattagcagaatggatcacaagggtttctgtacaaatgttgacttacatcacttccttggtgtgaaaaaaataaatatttattgtgaaagccaaacatgattatgtatttccaggtttaatgtattaattataaattatatgtaactttctggttacaaataattttttttttctttggcaatataaatgggatttgtataaagtactcagttaaaacttgctgaattaatgaatgagatgcagtgtgtagactttaggacatttattttggttgcttagcagttttccttttacctgtactctgtttagccctattgggtatagtttttgagattcccagaagggagacttccatgtaagtgaggtgttactgtgctgtttactgtaatgctaagaaacaagaaccagtttgcaaactttgatcacactttttaagagtattgacaaaactttatatgtctgatttctgatgtatatctacatcagaactttcttaaagattcagactttgataattttattttgaagtcttcgtaaaatagaaaaaatggttcccagtcagacaacggtttgttaatcacttttaactgagctcagagctgaatatggagatgaaactgactgagaaattatccttatttagaccctgcatccagtggaatgccctttcaaactaacaatccagtgaccatacacctgctctggttagtaagctatctaacaaccacatttttctccttgtctgctcttcagtaaaataaagggcaaattaacttttaaattaatttattctggctttataattgttgccctagaagaatgtttctcaaagtgtattgtgaggaacactggtctctggaagctcctccacatcctgctgccacctgtatctggggtggacattaggaatgcacagagaaacaggcctgggctgtattcctaagagtttgatgaccttggtacttctttctctttctctccattacacttactcacctcaggaggcctctgactgtgttagcacgttgcttgggaagatctgggccatctaacactttctttctactgatcttattgactaaatatagattaacagttacaggtcacatttttataaatgtttgttgttattgtcttaaattaccccatctttcatatagttatttagaaacaaaagctataaaagtaattttagaaataataacagattaattgttgaatgcagagaattcagaatcagaatgtaaaattaatttctggtgactcattggaaagagtggggtgaacagaaacatggaggctatgaggatgggaagcacaggtaccaaggtttagactgtagattatgtcctgctctagagaaggtataagagattattaacaatttcaactatgcctgggtgtggtggctcatgcctgtaatcccagcaccttgggaggccgaggcggccggatcacttgaggtcaggagttcaagactagcctggccaacatggtgaaaccccatctctactaaaaatacaaaaattagctgggcatggtggtgcatgcctgtaatcccagctgctcgggaggctgaggcaggagaatcgcttgaacctgggaggcggaggtttcagtgagctgagatcgtgccactgcactccagcctgggagacagaacgagtctccatctcaaaaaaaaaacaagaaacaaaaaaacaaaaaaaaaaaaaacaaatcaacaatagtaataatttctatttgtaggaaattgtggaatgaatacatgaactatttaggaaggttcttattcagggcccctaaaaatagaatttaccttctgtttttaattctgatatctttaatcagcaaagtctgtcctgtgccattgaagtgctgcagaaagaaatggatgtagacactagcttcgtttgtgtaatactgctttacagacatgttgtcaaattgtagttttcagaggaaaacatagttttctttgaggtgactcttttgagtgtggtaggcaggataacggccccaaagatgtccacatcctaatccccaggacctgtgaataggttaccttccatgccagaacgacttttgcaggtgtgattaagctaaggatcttgagatgagaagatgatcctcgattatccgggtggcagtgatgtaatcacagggtcccctgtgagagggaagcaggagaggcaagttagggtcagaggaggaggaggaggaggcctgagtgatgtggacccctgagccaaggaatgtgggcagcctccaggtaatggaacaggcagggagcctagaccgtctggaataatgcagccccgccggcctattgcagacttctgacttccagaactgtaaggtaataaacagtgtctgtttttttaagccactcagtttgggctgtttgttgcagcagcaacagggaactaatagacactgaagaatggattcagtcactcattgactcagtactgcgtgtctgctctgccaggcacactgcccggcccagctggaccttgcctcctagacagagagacagaaagagttttagagagtactgcgtgctgccatgagaatagaattgtcacgcagtagaaaacgatggggcaaggaggtgcagaggggcctcgttttgatggggcatgagtctaagaaggcccctctgaggaggtgacatttaagctggaacgtgaatgtaaaaaaggaagtggccattgtgagctctggaagccaagggttccaggcaggggacactgtgagtgctgaagatgcagagggactcatgctgtgacaggaggcaaaaggatgcaggactcccctcctccacggccctccccaccttgatttaaaggaggaggctgtggtggctcaggttttcttatccccctagtgggaaaacctcaggagaatcttttcataccttgatcttgcccaagagagttgagggtatgcgtgggaggcatcctttctcatgggcattttgtctgcgactcttgacatccgtttgctgtgcccagtcatcgcccgtcctctgccccagcactctgatggcagtgttctgagagcagaggagccttgactcccaaatctgttaagtgatactgtgtcagagctgagaactttctacttttgtcatcaaattctaaattggctttgtcatctggagtggagcagccttcctgcgcacagtccctggcaggagcagcagcagaaggtcgagggccagcccttctgggtccagacaagctgtcccataccctgccctggcccaggtctgtgcacgaggaggaggagaatgtttctgttgctggcttcttatgaataagcactgaaggctcaggatcaccgtccactgtgtgttccctcatagcccttgcagtctaattgttgatgtggattttagagaacatttattcccgtcacctggttttaccagcaaaaaggtggaggccctgaatggggatatggccaaagtatgtgaagagctttcagaacccctacccctgctccccgaggacaaggaggatcgtagacctaggaaactgcggtgggaatgctgagtcttatcttttgtaaggatatctcctacatctttttatttctttatttttatttattattattattattattattattatttatttttgagacggagtcttgctctgtcacccaggctggagtgcagtggcgcgatcttggctcaccgcaacctccgcctctccagttcaagtgattctcctgcctcagactctcgagcagctgggattacaggtgcatgccatcacgcctggctaatttttgtatttttagtagaaacgaggtttcgccatgttggtcaggcttgtctcgaactcctgacctcaggtgacccacccgcctcaacctcccaaagtgctgggattacaggcgtgagccaccgcgcccggcctcctacatcttttttaaaatgcacttcccttatccgtctgtgaatgcttttgagttgcttttgtataaaatcaagggcatgttttctgaatggtctctatttttaattaagtactgattttttaagcccccaaatgtcgtgtctcccagaattagaagtataaatgaccttcagggaccctctttcaactctgccagatagtctaggctcctagaaccctggaaaggtgtttggagatacatgcaaagtcggtgtgccatggtaattatatgtgaagtgggttattttggtttttgtttatttaatgaatagaataacgtagttacacttagtaatactcattcacccaaaggaaggggggctgttaaatcattgtgttttttgatgaatggcttgtacactgaaaaataaattggacaaactggcatagagctcagtgaacatgaaatcagctattagaagaaagcttgtgaacaaattctgaggcagatatgcatcttttgattaatgccctatcaatcatccacacagctaccttagctaagtcttgccataatcattcatgcttgcttttggaaacactggcagtaactataacgctgcagaaacggaatattattactgatttctccctaacttactgtgaacaatgactgttttcaccacgtttctgctttcctttattaaggaaatacaatgtagaatgaaaggagagtttctcaaagcctggtgaaattctcctagggtattcttaatgatattcagtcttaaatgggcaagctattgtaatgtaaggttctctgcaggaatgatagtaatgtaatcccattgaagctgcctgttatggattgtagtcaaataggcaaaatgtagagtcacattaatgaacagagtatatctttggaattattacttaaagttgttgaaatggtttgaattttgctattgtaattattttattctcctttaatgcgcttaatagccatagtaattaacccaccagattggaaatttgcatgagttctaactttgacattacaagaaaccctgattctttctgggtattacacagcaggacagggagaaatacatacatatatatatataaatatttttttcactgattatttttttaaaaagaaatttccatgaatgcaattattagtttttcatgcatttttaagccattggcaaattccttaagaacactccattcttttaagaggatttgattccagaaccacactggcacaaagaatgatttggcattgcctgctagtcgagaaatctttaggtattatcactgcttcctcaggacttactgtagcctgggaaatagtgtggcataataaagtggtgacagtcattagcatgcataatgggctttaatagacattaaatgctgtttagctagaagagggagcagtgctctcccactggaatattcctccatcgaagcccattgatcactgatttcagcggggagaggttaatccatcagcttctgtaaccagacggcactgatggaaattctttaggtggcattctggatgaaccaagctttccatctttacaaacaaatgagtgatatgacaagcatggtgttcaaaacacatttaaccaattgattttctttcctcttgtaataagatctggagacatatgaaagcgtgcagtgtgagctaagattaaaggaattgctccatgcacaggaacatacggaactaagagccaataaaagtcctataaagcatgtagtcacccattctctttttatataaagtttgttattgcaataaatagttattattgaactgatgccttttatttccgtttttgcagaatcttgttttaggtctgcgtgtatgtgtgcacacacatgtgtgtctcatctcagtgttcatctttctcttagaagttttcaagatgcttggcaataatcctaccttctcatttaaacaaatttgatttgggatggtaaaattatagatagaaagctgcagatcttgtgtacttgtctgagctcagcgtttaagtgatgatcgtctttttttatctcccccgtgcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacaggtgagagggacaggtcgatgcacccggccgtgctggtcagccgagggtgggggcaggccaccacgtcagctgttaatcaacacggcacctctgtgttctcacagcctctgtactagcatcctgtcttcttaatgctgaggtctagtcttcagttttggtggacgtgttgtgtaaatgcttctcatcaaacagttttttcccccagggtcattttcccatgggcatagcagcaggctgcttgataaggcttcactgtgacctggtgccatctgtaacctgcatcccatgtcagtgcagcatgtggatgcattgctctcatttggtcactgttcactccctccgctagaaccacagttgcgacttaccaccaggtggtactttagagtaagactaaaactgtgctttgccctgcgttaactgttgccactttgatattgtttggagaagaatctggttgctctaattaaagaacttcacaaatggaacgtgttggtcttctaccctcctcacaactttgttcttttgaaataccctgttggagcttgttaaagcctagggcctcagctccattcttctagcttttaaaagccatagggagtttatactcacgagttaaaaatgaagagctgccgcatgaacgtattttctagctttgaacatactatctgaactctgcttacactgggattggagaattatcagagtcattgctttatagccaaataagaccgcttgtcccgagttggcaaggttttaattatggtactgctccttgttgatgaaaatctttttgtctctggctctgcaaatgtgaccagcagaacaagcccacgagtgagtctgcagtgagcagcactggtgacccgatgcacaacaagaggtccaagatcaaacccgatgaagacctccccagcccaggggctcgggggcagcaggtaggacaccgaggccgcacaggccagcgcccactcctcccaagactggtgtctttgggtcagctcccgcttcctccccagacctggtgtctttttcacggcagttccttgtccactgcattgttgaccttggccgtactctacatgttgtacaaaaggctagatatggagtgactaaatcatttttctagctcagaagcaaacacaggcagtgcaggaagccatgcgggacataccttcttgatagtttaggcagcttgggagtattggcaactgtagttcgtagaggaaatggttgcattaatttgttgctggccacaggtgcgaccaggcctcagtcctcatctgtgattttgggcctgaattattgagctcctggacccaagcctgagctgtggcggatctactgatggctcctatatcattttttcttattttgctacttcccactttctaggagagcctggcgaaccagaagggatgaaaacataactaacctaaggctagttggattctggcactcagcctaaaattctgaaaggaagagtgtaggatttcaatccggactccgcctctagtcacttaaattctctgggcctcagtttaaggatgtgtaggttatacccataatatcatctcatagggctctcagcctgatgcaggaaggagctctatgaatgctaattccccaccatagagattggacaagagtccagatgtccacagaatctggaccttgctgtcatcaggctgcttcagcccaaacctcagactgcttgcccaaatttccttttcagcaagaacgtggaggctggagtaaattgtgtcacgggctctgaaatggatctttcctcttgcatatcgccagacagcaacaaccttgctggttacacttcaatgcctgcatatggcttttatcatctagccctggattgggacctgaatctacacaagatgaattctcaaaatgacttgtattggcattgctgtgaagctgccacaggggtttaggaaggactgtgcccctgagctttgatgctgtggcccctgggccctgggtagtgagcatatccttagagatcagaggttgaatcgagagggcattatccctataaagtctacaaaagtgtctcacacagtctccaacagcagcgaaaacagcattagaagtactagtaaaccatttccctggattacaaaatataagaataaacaaagtaacagaccaaaaataattaaaacaactaaacaaaatagaagtaccaatcttttgggtaaagacctgatttgatttattctcttatgagctttgttttgttttttgtttgtttgttttacgttttgttttgggtttttttttagatgacatttgggtttattttcagctttgtaatcagggcagcaaagtttgacctcaacttttaattcataattttgacaggctgttgccttgaatcagacgtttaaaactctcagagtgtatttggtaaatctgaaaatatgcacagatatgattttattgtttgacttcttcacttcacaaaaccctagacccaaatctaaattgggtttttactttctcttcttgtcttccctcctgttgtgtctgattcttcccccttctctgttccctgccccccaccctcttctttcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcacgtaagtggatggtattcaggaaccgagctttacagctctgtgacactttccagggaggtcagcctctctgaccctgagctgagtcaagtttcttaggagccgcattgcgaactggagagggctttatgactttctgagaataaagaaaactcggagccacggtgcttgacctgttcagtcagctaaagctgagtgtaaaattcaataaagtcttcaatagagagtgtaatgactctgatcctgtaagccagaaaacactattttgagttagcgactttgatggttattgagtaatagtaagctggacatgaattatgattaaccttttaaacaagtttgattccccttccaagacccggtaacaatggaaaaaatgtggagatgagggatttcttttttcctctcccaaactctcaaagcctaaggaagctcccgttcttttaagctgcagttagtactctatatgagctaggtagcataatttcttggtttgaggccagcccttgtggggttagtagtttcatggaaaaagttgtaagtgtttttaaatgtatttagtgatggatgttttggaaactgcagcatggtcagattgagaaccacacctcctctcccaaaccaggttcagaaatttttacacactctcctgcatatcatttcaaaaaatgcagtgtgcacaaagccttctccccaccccatgcctgatttgtgatacccccttcccagtgcttcactgttcttggcactttcttgaaggccagtggagttttccctggaaaatgggaccaggattggctgacgtggagggcatttagatgatcgagaataaaaagatgcaggtgctacaactcctggcagaagcacagggtcttgttgaggcattaagtgtggcagttttttaaacttttaatatgaaaaattggacaaagtagcatttgttgcgattcccctcctcctgctctctctctttttctctttctctctccactttctctttcgtggtacattcttttttttacagtaactgtatttttaggcaattcatgtttcttgataaccctcctccatttagattaaacactaaaattatgaagtccctcttacatcccacacgtttcataggcagtgtgaacttttaatgtgtgtctcttgcaactcggcgcatcccatgtaatgtattccacgcattgcagttacattatagtgttaagcacgcaggttgccagattttgagctctgttctatacagaatgttttgaggattttacatgacatcgccagggtccctcccctccatttctttttaaatcatgtctcctggtaattgtatgggaagaattatagatttctgagcacagaaaaaaaaagtcaaatgtttttaattaaggtatatttccagaatttttccatgaacttaattcgattctttctctttaatttaatgcaagtgttattttgaagccaagcctgacttaatggccgtttattcttgctgactgttttaatggaaatcacaaaaacattggaatatcaaaggggaaaagtttggaatttttgttttattatggggaaatactcccaaagagtagcatatgctatgtgtatccttagtgatataacgaatgaccaacaaacatgaagagaattgtttgtgtaaaagctgccattatagaacagatgttggcagggtgtcttggtttttaaaatatcctgaaggtgacagtctcatggtgccgttttggaggataagtcattgtagtttgcaaggaatgttggatactggttcagtcattaccaaatcaggaatgaaataagagcttattctaagtctacatttaaaatgaattgtgctcctcataagaggcagggtttgaagtaatattttttggagtgcggtagtagcttaaccctttcacaacctaaatacagtaatgtgaaagcttttaaaagatggtgaaattgcaggtatttgaatttaatttcagtggccgatggtctcgatgttttaatagagagatctgagtagttttaaaggaaggctgcttaaaactaccaactaaatgaccaccatattgtctgttttatcgaaatggtctttaaaaaatatgaatgcgcacatatacagtggactattttaatttcagattaaccagaagaaattcatgtcaggattagaagaaaatctaatatcttacctttatgatattaattttagtctgagataaattatatgagtaaataaacttaattaaatgaattaagaattataatttacaacaacataaataagaatactagtttatgtcacttattttccacctttttacttactgtctgaggtgcaggaaccccaagtttgcatgtttaaattgattctacattgcatgacatgcgtgtactttcttacccatgagtatatctggcagcagtaatggtggcctgttatagaataggtaggtgctttgtattatgttgattgaaggaatagctacttcaagtccacctaattactttggtggtagaataaataccagttgcaaaaactactttttttttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggaaaaaactacttttttacagagggaagcattaacagtttccattcctgtgactttccttggagagaggacattttgtgaattagttgaattttcatgccacatacaaccaagaggcaaggtgttaaaccattctgatgctctgccttatttatagccgtgacccattctttttccccctcttacagttaatagaaagattcatgattcttcatggttgtctatctagtgtctgacagtcccgactgcctgctaaagcaagtcactatctataattgatatccttccggggaatagggtgctggctgcaattgaagggctttgctgaaagctcttaaatcctgacaagttctccccttgttctggttcagtcgttgagctgcacggttggaattccagagttatttgaacttgagacatgtgtttcacattagcaaatcacaatttgatttgaagaagagaattagaaacttggctgactttgcccgccaggtagtctgatttccactgtaatgcactccatgtactcttgaaaagattacctcgttcattactatctgaacagatgggctaaacattcgcctttcctttctcttctcctttatttcaagcccctcttcttcaccaattatgtgtttattctaggtttgctgctgggtctttatcacagggatgtttaattaatttctctttccagcagtataattacaactgggcttagttactctcaagctagtattaaatttgtcataaatttacttctgtgaccagaagctaagaagataggtgtgtatttttgttagctttgttcttgtacttcatccctttcttggtgtcggttaaaactgaaggaaacaaaaaagcaagaggagtatatagaaagaaaattaattccaagtacattgaagactgaatttattattgatttgccaagatgcaagtattttctcttgccatttgaaaggcacacattctaacatctcaaaatgagttgaaagtccatatttttcttcaattttaaattaaccagacctttttttttgttgagcattatattataaaagacgtgaatcataacttcaaatgtgtttctgagagttgtagtgtatccactctcaaagtgtcgtttggttttgctttctgtttatgctatttggtttgtgctgatgttatttggtttagcttatgtttattatgtaaaacagctcagcccaacttcttccaaggaggaaggatgctttctgtctacacggagatccatttccctcatgttttaattttgtccgagaagtaagttccatctttgggtctttgatgtttgaggtgtctgaaatatgcacagcctgcagcacacgttagtctcaggttctctgaaacctgcacactttggttgtgcatgacattgtatataccaactatgttttgagaggctttctaagaggaggaataggaataaacataaagaacttccatctcagtgtggagtcattactgctgagtggctggttatgcttgaaaacatcagtgctgagatcgaaagaataatagtatcatcaccatacttcatgtccacctgtttgctgtaactctgcaactcttcaccctcaatttcaacaatccaaccccgtatttctgtgtaagaaataacacatgtaatattatccccaagggtctttaaaaagtcaaatgattttaaaagttttattccccagcccaatccccagcagcataaccctgcagggcccttggcaatcgcactgggggatgttgtcttctacctgtggggcagaaccgcagagaaagtgagatgtatttctgttagcacccagcttcaactgggtggcgttcaagtctctgtaatcctccatttgtctccgtgaagcattgtgtcaaaaattcatctttttgtagagtgattaaccacctacttggattttaaaatgctttcatatgctgcgaattttgatctctaaaagcatgctgaagtttcctttatcagaagaacacagtcataatcacctttgctgccatttggaaacaaattctatacatcagcagcatgaaaatgaggggctttctttttaatatagagatttagatataaagaaaacacatctaatttgtgaagaattgatgtgtctgtagaaacgcaaggaagagttaggatgtgaagacattcttttcacattaataccgtgatcctaaatttgcattttaaatgtttcccatataatttcgatccctttgctaaagttgcattgtctatccttacctaagagaaaattgagtttaagatgcgataggggtctcagatatgaggcagaaattagttttgtgtgcacataaaacataaaacaaatgagtggagattttgatcttattttccctacatggagttgctagttaattcggttactctaattatttggaaacacggcatataaaatatagactaagaactacaaacttcaaagccatcttttgacaattttgccttaagggtcacgttctctttaaagttgctgactaaattgcacctgcagaaattgttcccataaagagacactcaggagatcagattgattgcgagggtgtgtgagggctgtgtggtccaccggccagagccccccaggcccagctaggattctgagtggcagccccatctctgccctgactcttgggatgacctccttagaaccatttgaccccttagaacgttattttctcacttatcatactgtgaaacagccatgaaaataaacgctgtccccaacgtccaaggccaagcacagatcacatgcagtaggtctaatgagaaacagacagagggtctcgaagaggtcactcagtctctcattgttttatgtgtgtgtttcgctgggttgagtgggggaggagaatgcggtggcactgtcggtttctgtggcttattttatattaattgttgctaaactgggatgtacgctagactgaagccaagagacttcctttttcttccgcattgtgtgtctgctgaataagacctggccttgcctcgttcaaccttggtttcagtcaaagaaagcaaaaagtttgaattggatagtccttaggacagggatggtaaacagattctccctcaagtgcgagctagctggctggcagccaccaggagtactgtgcagagtccccctcccctttcagcctgggagggagtttggggtgggctgggagtggcggggggctgtgaacagttatgggtgactgcccccaggtggagtttaagaggcggccatgtattagttactttcttaattcattcatccgttgtatactccctgaaatatttcatcaaaatcttcctccgagtaactgtttctgacatctggggaacattttcctattgaaagctttttagctggttctcaatgatactttaggtgagattctagattctgccaatagttagtgccctggaatattctgtatggatccactccagacaagtgggaatggtggtcactttgggctgggctgcatacctcatttgaatatgcttgcctatagcagatgttgctggcataatgtattctcctgtttattaggaaaagtacaagccaacattagtggatcagccatttgctcaacagctcttgatgagatgtgcagagccctggcaggtgctacatgggctggggacagcccatgtggtacccacagccccagctttgtggtggacacatgatttacaccctcaaagactggacagtctgactgggaggaggagataaggaaacataaaagcatagtgaacaacaagaggtgaaacataaagaagccataattgtgtattgcgactctatgggctgagagagggaggagtacagaggaatactggaaaagactcctaggaaacaggtggaaaatatggttagggtcaaagtaaatcatgcaggtaaacttttgaggcctgatgaaatgatgatggtggtgatgatgatgatgatgatgatggtggtgatgatgatgatttgagaagaattagcacctgatttgaaggaataattttgtttcccatcattacccagtggcagtacagtgtgaatgtgtttcaaagcagacagacctgggttcacggcctgctctgctcccaaggaaaatagtgacttttaccacataaaacggtgagggaattagctaaaaaagttatactcaataaaatgttagtgattctgcttacgagagaaaaatgtcaagatatttagaggctgctgtgtccatgcatgtcacgtataaaagcaggggttaggttaatattcaggcagtgttggggttggtatgtcagcatgaaattagtaattgcagaaagatgtcgataggcccccagttcatgaaacactgcaagagaagaactggagcggcgctctgggttcatttcttccattgcaggttcttccttgtgcttttctgcagtgcggagattccatctctcctgttcatgtgtcctgacatccttctggaaattttcttcggtggttacaccaaaccaaggtttctccactgtagcacataagggcagatcattctctggcgttgggggttgtcctgggcattgtagggtgttaagcagcatcccaggcctctccccatgagatgccagttctttatagtgggaggctgtcctgcgcattccctccctcgtcatgacaaccaaaactgtttccagacattgtcagatgtccctgggagacagtattgcccccagttctgccctaaatatttcctcttgtcgcgtagtgtggagaaagaaaaacacacgtaagaaaaacaaaaaaaaattgtgattaaagaaaaagtttctcctgtttaaatgttctttagaatgttcagattagaaataagagatgatctcattaaaatgtctctagtaagaagctacttaaatatacctatgtgtgggggggtgggtgtgtgtgtgtgcgtgtgtaaactggcagagcttaatttaaaaaccacatttgctaaggttaggcacacagtagttctcagtaaggcccataaccagccaagcccgttttcttggtggagaaactccatcactattttttttttcaggcctagggaagtcacacagactccaacttctgagatcatagcaagcagagttggagatcaggctcctgctttgacataaaacagagctccgggaacagaaagcagttttctaatgcgaggactttttttttaagatttggggatatttaggcttctctgggattagccaaatactaccatggaggcatttttattttttctagaacaattaatgttgcaagagaagagaactgtaaatgggatatcctcaggagacaatgtgtaagccaaggccttaaacttaaaccaactccacccgaccccacccagttaccagtaaaaccagcattaatcagtgagtgggggatgggaagaacaccagataatgtgttggagatctgtctttcattcctacatctgccagaaactgtttctgaatttaagtaagtcaccctgcagtaaatcctccgtgtctcatctgtaaagtggagataataatatccattctaggttcttcactgggttttttaatttgttttttgtttatgaggatagaatgagatcctataatggaagtactttgtaaactcaaaagctttattcaaacataaggaaaaatccatagcaagtagtactaataaactcactcaactgaagaatggagagattaagtgcacttttatgaacatttaaaaatagtcataagtataccattgatttcagttgcacaggctcgcctatgcaggctgctgttcatcttacctgtttactcatctgctgttgatccatcgtcaccacctggtggccactacagaaattgcaggcatagcagctagaagaaaacgcttcatgcatgtccgatctagggtgctggggttgggggctatccctttgagtaaggggagcatacagggcaggctgttatgagtactatcgatgtacaagcaggacagtgggaaaatgagtaaggtgaaggcacagaagaaggaatgaaagatacatctcatggagattggatatgagcatggtatggaataaactggtggatgtaaacacagaaagaccattgcagaaaggcattggggattctatgtggagaagacagcaggaagaagttaaagggtacagaaagtatgggaaaattttatctatgattatagctaatataataaaagactgaggtttttggcatctctttgaattagaaatataattacaaatgatttgttttatgctttttggttgaagagtggtatgataagtaatgcagttagagcagaaccaaagtatgtccggaaggcagaagggtagtgggtagtaagattaaagagccgagtagcaccatgtcatgggagatgtgattgctagactaggagtctgacttttattccaggtggagtaaggataattaaatgcttttgatgagaggaatggcttgagccagcatcagctttagaaagatggggctgagccttgcaaaacctggcaagttgcaagtacagtgtattaaagagggcaaggttagactggggtagggccagaagtgagactctgcagtggaagttatttgaaattattttttaaaatttgggaggatagtttggagatgttttacgagtacagtttgagcagctgatgtggatgttctgcatgatatccagagagaagtcagaagcttcagggctgctggctgagtgctgggaggagacgttacccatggaacctctgtgtcttgcctgtgtggcatcaggctctttaccaaagggtactaagattctgctatctttctttaaaacaggattatcagggtcgttgggataattatctctgatagtttatgggagatacctactacagtgctagtcaagtttttagagccagttagcttttattgtgattgttatcatttttcctttgtcattattttgctttgtgcaaaataagatgtgccaggccaagcgagtggcacatgcctataatcccagcactttgggaggccgtggtgggagaatcacttgaacttaggagttcaagaccatcctgggcaacatagcaagaccctatctctacaaaataacaataataatactaatttagccgaacatggtgaggcacacctgtagtcccagctacttgagaggctgaggtggctgcaatgagctatgattgcaccactgtactccagcctgggcaacagagtgagactgtctcaaaaaaaaaaaataaggtgtgtcttattttctagttatgaatatataatcctgtggcacacaggcatcacctggcaaatagttccatacatctacagtggccacttttcttccaatcagggcaggattgttttggacgaatacagagaatgaatattcaaagcattaggtctggtgggcttagacaaataaaatagacaggtaggtcaaccacattttatttctaagtggtgattcagatgaatgggatgtagttcctgatctgtttggcaggaatgaaaatgtctttctaatcaggaaaacaaaactgcaccagctgtcttctgttagattcacaggactctctccggtcaaccatgtctctaacataaccggcccaatcttatctcggctgctctacctgcctaaagggacatggtgtttctttaggctctcccttgtgcttcagcacatgtgacctgtcccaaggagctctctaggacatgcgggagagcccagtttgtgaagaggaggtcttcctggtggcctttcctgggggcagggagagtttgcacaggttcctctggtgcagtttctaccacaagataaagcagtcaagctgcaagtgaaacacagccctcactgtattcctcctcgtgtttagcagagataaacttcactggaatctcagtactgagccatttggcttctggctgtagctttaattgatataatgcagattttttttttcttgatcaagaggggattattcttgttatcagtccagagcatcttattttaagatgaaaagcctttacggaattacagatgccagcacttgtacaaagctttttggcgattgacaactcaaagagaaagtatgatttattagcctataatggctaaccctgagcaatggtctaggtcctactgatttgtgaaattgcttaacgtgaactgcctttttatgctacacaagccccaggttactcaagtaaatgtagtgtctgcattacatgaaatgttacaggagagagaagaagaaaagggaggggggagaggagcaaggtggattctaaaatccatcttggtggtgccttttacagtagtttggctgataagccggcagaggaaagattaataacgaggcttgtcgctatcagtacctgcttgtcgattctctgtaacagggctgtctgttcagcatggaaattattgattaaataaaaatggctattagattgtgacgtgatccataatcacaaacaatggtggacattcctctcttagatcctcggccatgcatcaagtcgtttcttttttcccctggccgtaatttatattgcgctgacacttgggctcattaggtttatcctttctgctcagaggcacgagcggtgaggaccagcaggaagtcggggaggaagagaggagagatgatggccccggccagggatctggccagtgtactcactgggctagcataaacatgttgcagtaaaatacatatcacatagcagttaccattttgtccattttgaagtttgcagttctgtgtggcattgagcgcagtcacagtgttgtgtaaccgccaacactgtccacttccaggacattttgatcaccccacaaggcagctctgtatgcatgaagcggttacctcccattccccctccccgccagcccctgaaaaccaccaacctgccttctgtctctatggatttgtttattctggatatttcttataaatgaaatcatacaaaatgtgaccttttgtacgatgtctgccttttttgcacttaccatgttttcaaagttcattgatgctgtggcaggtatcagtgctttgttcttttttatggctgaataatattctcttggatggctggctataccacactttgtttatccgtgcatccgttgatggatatttgagtttctactttctggctattgtgttactatgaacattcatttacaagttcatgcttgaacacctgttttcagttcttttgggtatatccctagaagtgggattgctgggccatatggtgattctctttgctttatttcagaaactgctaaagctatggcagggtttaagctgtaggctctgcctttttcaggtggtctcacctttaacttcattctgcttccctcagtaccaccccttcttgcctgagtgctgcctaagctcccctgggctggggactcagtctggctgtggagtgctctatgacactgctatctgtgggtacacaggcattacccagcaaataactccatacatctacagtggccacatctacagtggccacatttcccctaaacaaagtgggactgaatagtcaaagcattaggctaggtggactcagacaaataaaatagactggtagattgaccacattttatttctaaatggtgattcagaggaatggggtgtaggttctgttctgttctgtaggaatgaacataatcctcttttagtagctggtttgtgtcctccttcctggacattattgctgtggtccctcctagttgtggaatcttaaaaatgacctaaccaactacaaggaggtctagcaaggctaaaaaacatattgaaggccactaaactcattagtgagtggtttgctactgattaatcagtttcctcatacacaaatcatattgttttaatggctgcttggtgcatataaggaaggtttggcctttagatgttcttaactattaaatgtatgcattttattatctcacacttcaccccaacaaagacagtccccttcccctgtccacttcagtcaagttgcctcaagtttgatattttcccacatgtttatggccagttagataccattgaaagcgaatataacacttcatcagaaacttcagactctttgatcaaaacacaggtgaaaatcacatgctcatctataactgaatatttccactcaggctgaaacccatgaactcatccagaagaggcatctgtctattgatgtggtcaggtgtgctatcgattatcctaaacttaaagctggaagcaacacttagaagaagcataacttcttaacttgaacctccaagctcccagtgcactcccctacccagccctgtgttatttaccgtcccactttaagccgcagcctcacatggagagaggcagagatgaggcttctccagagggaaacagctctcagggcagcctctggagcctcgtgcaggcacaggagcaggtgcccaggagcagctccgagtgtcaatcctggcttccctgggggccttgttgaatagcaagagactttggagaaagtgctgcaagtcagttgaggatcattccagaaagccactgtaagcattcatggattatctaagaaagaaaagaccaagtttgaagaatatagatctcaatggaattctttgataaagttagatacatacaaaagattgaaagaaagtaaatatgtggaaataagaaagaactagtgacatagacttacctgaacatatccagtccactggggctactgtgggtcctgatggccacagagaggatgctgtgggatccaggaacggggaggcacatcccttggaatgaatggtttacaatcaacgaatggcagtgaaagcaagcagctcacttcctcgtttgctcatcttctgtgttggtccaagtgaatgttcatttgttcattttgttatttgtttggaacgagaactgagaggacagtgatgacgccgatgagacccgttctcctggggcttcccattgggaacagagacagcaggaaaaggaagcatgcgtgcccagctgacacaagagtaagatcgttgattggtaagggagtcagaggccagttgagtggcaacgtcaggactgcaattccttacaaatggcacgatgaaccaatatcagaaatttttgatcaattacaaaaaaaaaaaaaaaaaaaagaacaatttgctgggggagatagaaagtggtgactatcgttctgtactttcaaaggggacaagaaaatgaattcagaaagttccaagggtagggtcaagtcaattctagagaaaactctatttttattatcataaacgtgttgtcctgttataagataaaatggtgatcattgataccctctgggttcactaagaaaactgtcacactagaccgggctgatattttctttcacaatatcattagactggttgttcaggaaaatacagtaaatatgattgacgggacttcagcaaaacctttaataagaaactacggccaaggcagaggaagatggttgtgttaaacagcagttaggagatgtagttgttgggtggatgataagggcatggcttggcatcagtcaagggagctgtttctagaatcgtgctgctgggctgggctcccagccctggtctgcataacaatttggtgtacctgtttccaggatgaagttgtggagtgcaattatcatcagagttgtttgtgaggaatatttatatccagttagtgactgaatcaggatcctcagagatcttgaaaaataaaaaacatgaaatagctctaaggagattaaaaattatgataacaacataggacctttaatcaactataagttcactattacaagacaaagatagtttccaccaagcctagctaatgtgattctcaactatagaaatagaagtatgttattagaattacactcaaagtatctctggaaaagagcaccttagtctggcactccactttctaaagatacactgatgtataggcattggatcaggtagagaaagaaccagacttgcctcgtgtagagtggttgacagaaccagataagaaggtgtggtttgcgcctatagtcccagctacttgggaggctgaggctggaggattacctgagcctaggagttcaaggctgcagtgagcacttgtgaatagccactatgctccaacctgtgcaacatagggagaccccatctctgaaaaaataaagaagaaccaaggaagagaagttttgcaagttgaaggtgggcagaaagtgccaagggacatgataactgctttcaaatatttgttggtggttggctgtcctgtgggagctgcatccagcttgtcctcaatgtatggatcaaaggtccaatgcatggaaaccatagggagacagatttaggcttggtataaggaaaaccgaattgtcctctgagacccgtccaaaatgtttacccaggggaaagggagctcctgtactgcaatgtgaggttgtttaaattgtacaccatgggtgtggggtattatagaggtaatacagagcatccagtgggttgctggactagatttacttagtcccactcgaacctgagtgaaattctttataccgcagaagtttcttgcaagccagttacatgcctatgtttaaagtagggactcattttcatttgttctcaacaaagaacaatatcatctcagttttataacactccagcagtttttcctctccatctaggtcaagacttttccttctttattttaatttttttattataaaacatattactacttagtaaaacaaactaggccgacatactgtttgaaagggtgaacctctgagttcctcaggtaactgacatggggtaagaatgtgggtactgtgaggcctcagtttttccttgtataccagagccacctctattgtaaaaacttcttagatttttttagtttttctcacttcattttgatgtaaccattcctgctatgggtattacatatgaaaattcccatataattttctttagaaattagtcttgtgctgtgagtgcttttgtatcacatacattttattctgagatcctttgagataaaaacattagtgccgagcttattgagaggtaaataatcaagtactttgagaataccaggaaaggcgtttttttcctcaataagtacttctttttctcttgggtttgcactgtggaaatgtgtgccctaactcttaacctgaaggatataaaacttggtgtgatcattgagtttttaaaatcactttttttaaactgcagtccttagcagagtgcatctcaatcttgtttttatttcaagcacataagagatgacataagaacttttaacttggctgagctctttctcattctgtctgttgcgtagcaatatcttgctgttgggttcttttttcttccttcctttttttttttttttttttaaatttcctccttagcatcattatcttggtaattcacttcactctattcccctgtgttctgggtggagctaagatatctttggtggtgttggtcaactggcccttcattttccttctctccttcaagaatttcgagttaagaatgaacgtttccttttgagagattgttggctctaagctgaggctgagctaaaaacacctgggagagcctcacctgctgcctgtggaacccagccacatttctgttgcctgagaaatgacccaaccctgttatcacttccacttcctaatgcttttattgtcaggaactcctgaaatgtattaagaaatttagaaactaagaaatgaataaaaagaaccaaatagaaatgaactggtctttaagtcctaagaaagtgctctgtgaaatgcacttaccagggcctccctggcaattcctgttagggatcctgtaagtgtcagaaatgtctccccctgagaaacttgggctctacctggctgggtcacttgaagttatccatgtttccctggaatagcacattcctgacttgggaataaaccttactgtccctagcccccaaaattaggagttgtagtccttgtcagagccttttgggcctgtcccctgataggatatctgtagcctcatacacatgcaggttcacacactgtatatctcaatatttagaagctgtaagccaagctcacaagctgataaatgaatgaaatgtttcatactttgtctaatacacctgcattgtgactagggagggcaggtttcatagagaattcttggactcctcagagttctctgccagcacgtggtggcccagggacagttgtctcccagcccaccctcttctcctcccactcttggagatgtctgttcctgagcctcactccagagctgaggaataattcctgtgcatacagagatctgagaaccactgcccccactaactctgcattgagggaagcaccaggcagcctgtgccccattggagcctgaagtctggcagacaacagacagccttgttctgggcaatgttgcccttcgagctcgggtatcccttatacttttttaagtacagggggatccatattctagtttagaatttgttctctgtgtcatttgctaaacttattttatcttttgagggatgatatattcaaattagggataagtggcaaagcaacaagatcctttatggtagaaacatgcatttggttggttctaagagttgtaacatcatttcgcttatggagaccatgctgaacttgggactatttctagagaataatgtgagatacccatccctcacgccctgaaaacagcctcatccctctccccttcctcaactcctctcactaactagtgtcctccagaggactccaaggggaaccctgtctttggtctttagaactcgagaggaacaaaacaaggaaagagaaattgaacaggaagttagagagatagtaaaataatatcctttgtcttcatacgcttccctcccttcccacgtcgggcagtggttaatgctgcagcagagcccaatgggtcggtgtctgaacagtggacaggagacctggggaggcgagcacctgggctgtattctagggaggcaggtatcagctgctccctgccaagggtacaaaaggcagcaccgtgttcactcaatggaccccaaaatttagaggaggtccatccagacatgactctgaatctgtgtgtgtgtgtgtgtgtgtgtgtgtgtgtgtgtgtgtatgtgaattcaggataaaaaatgttttttagcagttaagcactttgcaccacatccatccatctatccatccatccgttcttaaattttgacgttctaaaatatggcaaacattatagtcacatacggtagagagcccttaaagagaccacgctcaccaaagcattcaataaggggaacataatgaggcttactaaagcaacagggaaacggtaaggttcagataactatttttttaaagcccaaatccataattccttcaaaagcagttaaaaccagaggcaacttttattaaaatattaatattttaaaatatttttgtcttcatgtatttctaaaaattgagtctgtacttcatgtgttggttctgtgagtttctattttgtgtcttgctttcatcatatgtatgtgccatcatcactgaatcgttgtgtgtaatttacggtttttctcaccactctttttgccatcagaaataataaacctctttgtgtaaaattctttgttcctaatttggattgttcctttcagatataatttttaaaaccaaataactgagttaaacagatgaattttagaatgatttgaactaaatttaaaagaatataccattcggattttgcctggaatgttactaaagccttgaattgaaaagaatatcattctctaaaatccagtttcctggcccagcacggtggtttatgcctggaatcccaacactttgggagacccaggtgggtgcatcgcttgagcccaggacttcaagaccagcctggcaacatagtgagaccctgtctctattttaaataattttcctttaaattcagtttccccagataataatggagtatatatttttttcattttctgagctttctaccttgatttacctcatatttcatttctggcctattcctaggtaggaagtttttttctgtatgcatttttcctttcctggtcattgcttttaatagcaaaggtatactgggtttttgtttctttttattttatgtgcaatcaacttattgaatactcttgatatttcctcatgcctctgtattttatgtcttgggttttctaataatacactcctgtgatctgtaagtaagaataattttatcttgttaaatatcagatacatatttatctaaaatatcagatacatatttcatttatgtctcattgcattggatagatttcttggcattgtgttagataattgtgttggttgtataacaccagttttgtatctggtattaaagggaataatgcctttggggttcaacctttattattctctttactgttcagttaacatagataatgtttgggcatgtgaatgaagtgcccttctttctcctcctaaattttctaagacttttatctcaagtgattgtagttactttactgactgtttgccacatagagattactgtgtggtatgatatatttctatgtcttaaatcatctttgcatcccttgagtgtgccaggtgagttactcttttgatatgttgctagatacaggtttcctgtttatttataagtttcacattgttatgactgagatttatatctttgtttcattttttgtgctgctttgataccagagacatggctagatgtacaaaaatatatattctacgtcatatctatcatttccgtctcttgagtgccttacgtagcataataatttgctcctggaatttctgaaataacattctggtaaagctgtttggatctacagccttttgagaataaaatcctttaataatgatttttaaaatttctttttatgacttgggtcatatttgaatgaatgagttatttctattttctccagaagaatctcgggttttgatgagattttcaactttaatattatcaaactgtggttatttaaactaaatgcctgctgtacactttattaaatcaccttcattattttatttctctgtcatttgtactttcactcatttgtttagttattatcagtggtttcttttttatttgtttcattttttttccaggaatgagtttctgaaattagttatttatgctgctatgttaaattttaattgtgtcttttaggaaatatttttctctagcatcattttcttgggctgagttttgcttttccctccataatttctagtgtgaaatgctgctttcatttctttctttctttttaaataatacatgcacttcgagattataacattcactttaatttacctttgacttccatgaattttgactgtcttctttcttttgatatttcaaaatagtctgtaattatatttgtgtgatttattcagtcattaattccttattgctcaacaaatgtttttggatctactgctatcagtcagacactgttctggattctggagatacatcagtgaatgaaacagtcaaagatgcctgtcctcatggtgcttgcattcctgtaacaatacaggctctgaaactaatattaggcaactagtgcttggtttgtcaccacgtgttacatgccaggcactattctaagagcatgcactaacttaatccactcagtaacctaatgaggtggatattatcattagcctcattttccagatgatggaaacaagtcactgtgagtctgagcagcttgtctcttgtcacattgccagtaagtgggagagccaagttggcttcttacaaactgtgccaataagtatgctatgatttcttatagcccctggacatgagattttgcttattagtgtttcagcttgtggtacaattttataattttatcttgacgatagagatttaaatattttattgaggttattttcatgatgtgatatatatgatattctgtggtcaagtgaaaatagattctcaggcaatactgattgttatgtgtctgttctttcaggattcctaatgatgttcaaattcattttgtctctacttgtttctttgtctacgtattttattataaattggtactggtatattaaatctcaggtgattatggttctagccatattcctcctattttaacaggttttactttatgttttgatgctctgttatttggtggagaaaagtgttgcttttctttaatgattatgttagagaacaactacagctgttgtcgctatttaaactttttgtcataagtctaatttgtttaatatcaagattattatcactaatatattcatctgtttattttttaacaattctctataatttttagtgactttcttatgagcattatagctgcgttcatcaccctctgagaaactttgccttaaagtgggtggcaatgagtcatttattttgaatgtgaatttttgtgtgccctctcaattcttccctttatttgcacacgtgtgtgtgtgtgcgtgtgtgtgtgtgtgtgtgtgtcttgccatgttttccttatttttaccatggtcaatttggaagtaaacacagtgttttaaaaatagtgtttttgcttatacatttaatgaacacataattaaatgcatgatttctaattgtggaaaaataaatatcactccttgccccccaaacacacatacatgattttgcaagacaatttataatttaaaaatttttttaccttctgtcttttcttttctttctgcttttatcaattaatgcagtagactcagttattattgtaaaatgattaattattccattattgtcccccttgcttattattttatatgtttatttttataacagtcttcaactttgtttcatattttgccctgtgtgttagttgacttcaacgctgggttccctcatgcaatggcttcttctttcctgaaatatttttgttgccatccctttgttccttagtaacaattcaagaatttggcagagaaaattttattttctcttatatgcatttattaataatattttctaaaatggattgcagcacactagttctgcaggatgtcgacaagtatcaggtgaaaatgaaagctaggataaatagagttaaccatacctggctgtgagacttatccaagcctttcttatgccactatgtcttgcagctcttcaagaggagaatatggtcaggttggcctcctaacaccattgatcatagaatcctattcctgattagtatatggcaaaattatgttaacttgtgctttcctctttgggaggatacttctgtgtttgtttcccctttttttttttaacttttttttttttttttttgagacatagtctcacactgtcgcccaggctggagtgtgatctcggctcactgcaaccttcacctcccacagtcaaatgattctcctgcctcagcctcctgcgtagctgggattacagacgctcaccaccacgcccagctaatttttgtatttttagtagagacagggtttcaccatgttagccaggctggtctcaaactcctgacctcatgattcacccaccttggcctcccaaagtgctgggattacaggcatgagccaccgctcccggccctcctcctttttttttcttaaaatgttttaatggtgccaaatatacctaggtcttatacgtgaagttcaggtctggtttattccaagaatgtttaattctgttgtgacttaatttatctcagtttcctttattccactttcttctctcaggacatgtgtgggtccatgagttgatctgatttggtttccttggtcttcaatcagctccttgctgcctccactgtgggttttgtcctgctgttgtatgtttagactgcttcctatccccctcagccttctagccacatgcttctccacttgaatgctttctttttttataggcatcattgctttttttatttggggacagaaagcagacatttctaatttttttctgattgtttttcaattctttgtttacaagcttgcttttaccgagtctttagtggtcctcccccttgtcctcagcaagaaaagaatgttcgtggacctcctatgactgtgggggcttttggcctgtgtgcaaggtgtacaaaaataatcccattccatattggaacatttcctatctcaactcgcaaacatttttaggttgttaaaaatttgtttgctttttctgatttattttacattgtttctagagctttgaattagaatgcattcatgtacttaaaaaaccagcaagtcgtaaagtttatattgaaaaatcttcctctttcttttgtcctggatctgcctaattctcactctactctacaaatcaactacccttaatttctgcatatttctggaattcctttgtagatacataagcaaacacagtatacattttctttctccatccccttctaagatagaaagttcccgccgtgcttcctgtgtgtaatacggtcaacagatgagcgtgcttggctcagcctgaaccagttctgtgattgacgggcattcagccctgcaggacgaaggtgggatgttccctctccctgtctgggtaagacattgccactggttcttctctagttagtacagcatgtcatagtgtgggtctctggatgtgtggctttcagttcccctgctggtctgaggccctatccatgaggctgctgcaggtgctctctttttttctgattctgtagagccttggggctcaaaatgtgcttcatgggcagagaatggatagtatgcatttagaaactttgatggcattttgacattgccaaaaagtgtgggatttaaaggttcttttcaccaaacagaggatagactcatttggatgttatcaaattcaaggtcgccaaggagtggcccccacttgttctagtcatgtgtagcaggaccacatatccatcggcgacagatgagagaggccagaatggtccttcaccacagagagcttcagggcccctgatgcagggcgttggagatgtggtgtctgaaaggtgtaaaagaggagtggatgagggcaagaataaccaccctggatgactttgacgtacttgtggtttatgggaagatgtttgcctaattttgtggccagtgaagccccagtagcccagagccaatgaaaagcaatagtatcaatcagaacctttttctgtctttgtggacagtattgagttctgattcagaagatgtgtccaaaggccacattgcataagtcaagactacgctgctctgtgagggtgcagcagtctgtggggtgagttttcagtgctgctgttgtgcatacagtgatgaaggcaggtgtcctaggtcactttcatttttcccccatgttaatccagatggtctcattttttttcttagtagtttttgccatctaaggtccagcatttattgatgataacttcctatcatggcgtaatgtcctgtggaaaatgatatgctaccctctcttcaacaggaaactccattcatctgaataatccatttttcatactaagcaaacttccaacttctcaagtcacttgataccaaatgtggaaaaccctggacacatttgaacaaaatctcagtgcacgtgcccatcacactccatagagggtgaaaggctgtgtgggggaaaacacagaagattaaataggacattgaagtaggttggggtgaaaactaatatttttagcagaagagaaagatgcaaaataattgcaggtgttagtttatatttacatcatagatttgcataacacaaaaaagtgctttgattgttgatgtccaaagttgacgaataatttggtgagtaatgtagaggtgaaaatatccatagcttgtgcattaagttggctgtggagtgtaatttgtactgagccaatgttaacaccattcagagtctctgccaataaaatcaagcactctattgaaatgttctaatttattattttactttcttactaggagtaatggattttgtacttcatagtctgatgagaggtgttaaaagttagaggtgaaatttatttttgaggcatttaagaagggaaaaattatataagtgagggccatggaataggtcccattaatgaatgcataattagcaatttgtttgacatatcccgtgtcctgccatggtgggaagcagctgtttgcagcatattttgggcttcttttgaatggtttttacaggctttctggacacttcagataagaagcagtaaaagagctatttttttaatatgtataaagaaaatacagtgttctctgtcacatgcttggaatttgagcctgtggtgtgaataccttagaagaggtgccatatattgattacttcagccatctcagtttacttgtaaaataaatgaagtcagcccctggctcctctaagtccctagtgaccatttccatcctttaccgcctctttccaagcattaccttagaatgacctggtggagccagcttaatgacaacatgtgaaccaaaaagaattcctaattcttgccctttgcaaaaaataaattaaaatttaaattaaaaaattttaagtgtgcagccggcatataggagatgtcttctgccctagagcagaagcttccctcctctgacgtagagcaagaaaacatcaatattagagctaaattgagaaaatcttttcagtgcatctggattggtgaacggcttaactgcagctacaatgaaatatgaggaaacagattattggttcaagttatatatttatgttgcaccaagcaccagttcctgagcacctgcgtgtggaagtcagggtgaaggcctgtggggtaccaggatgaatgtgatacagttcctctactcaggaagcagtccagaaggggtcaaagccatgctcacgcaaaataaacccagctagaaagcaaagcagaaggtatcatttgagggattttgatgttcaggagaattaggacacacacaacgtccagccagaacaccagctctttctctctttatttttaaatttctattacttggacacttttttcttttgctcatctaatcatatgaccgcaaagagcaatagtggatctgatactcagtattctggaatgatcattggcatctgccagaattgtcagtagcgttcactttagtaaaatgtgaacactgcaaaactcctaggtcccagccatgcctagtgtaaaaatgtcagcctgcaaagttggtaaagtccagccaccacatagtgacttttaagggtgttgtaaaattctttccataaataatgttaaagaagaaaaaaaaaagctggacttctcaaaatgtcaggtttctttatcagccttccaaccaatcactcagggatgcctttccttcctgggagatggtaccataggcttacattatatcatgtatggaaacatctgggggaaaaactcaactcccattaaaaaatatattttatatagccctgaaaggaaaacagtgaacgcccacaccactcacagctgagattacgggagtgtctctcccagcagctttcccatatgaagaaataaaaatcccaattcttctgcccattgttttatggccacatgggcttgcacaggaaatcaaggaggaattgtaaaacactgcattcacagagcttagtttcactttaccacacttgccacatacagatgcatcaaatcaaatcagaacaagatgtgatcttactgagaaagaatccttataatatcacgttacctccccctgaaaattcccccaagcatgcataaaatccagaagaccttaagtagaatattgaagagagcctttaaggctgaaaagcaagctgcatttaccttccttgtatcatattatatatacatattacaattatgtcagcgattaaaagcattgtcatgctgcattatgaactgtttttacgtttaggattagataattctttccccataccccctcagattccttttatgtcctaagggcaaatcctttctcttgggtcaggaatgtaataaggtaggttttcctctctctgggatattgtgtctgtctcactgtgtttaaattgattcagaaagctcttcagagcaaaatacagtattttctttgtatatgagccagcggttgactaacccttggggaattctctgtgttgagcatttgaaaggtacaggttgggtatgtttgaactgctgatgctcagtgaagaccactgggaaagtggattggccgtggctctgagagaggccttttctctaatgtggactcgaggaaaaaaaaaataattgttccaacaaataatttttaatggtacaataatttaggaaaattagccagttcattttaataagaatggatcaagaccaaaataaagagggaattatagtttatacaaatgtatgaacatacagtttaaaggcatttagccaccaaaaataaattttctaaaaacagcagttttctctccatccactgtatgaagtgttaacacatccctcctgagagttgaaccacaggccctgggatcaaaacagagcaaatttaccatttacactgaaggggactttcacttagatttggtatctccttccagaccaccagttagcagaggtcagacccattgccaaccaaggataactaatttaacccttgtaatgttggttactggttttgacagtgccccagagtctaggatcttggaatatgtatcaagtatagtcagagtatcaggagtacactgtgtgtgtttgtgtctgcatgtctgcatggatgctttcggttttctccctccctcccttcttgcctttcttctttcttttcttcatctcatttattttaatgggtacacagcaccccttctcttctgtgcattttctgtagcatttaattaaaaggcatttgggaaatgttctcttctgtcgaggcctttgactctctcacaaatgagcaaacttttagaccttgaaattgccacttttttcctcagctacatctacatagtgggtagaaagtttagccctgaattttgttcttatctatgccacaaactcatggtgcactattaggtaagcttctgaacccctctgaacatcaggaaaaccctcctgtgggagatgaggtgtgaggaggaggcagccaagtagaaagacatcggacaagcaggccaggcagaagagttggcatgagccaaagcccagtgtgtgcagcctacacaccaggttcctgcaaacagatgagagaagataaaccaggaaggagcataacgcaagcagccatgttcccacatctatgacggatggattcacatccatcatgggtggcaaggaccttaatacctatagcctgggaccaggggacacatcttgactttttgctaaacaaactatgctcctgatacttgtactgcagttgtgttacctgacaaatgaaatatacagacatcattttgcatgtactttagataaaataactaacaggacacttttactttaaaaatccaggtggcaaaatttggccgaacattgagtttcagttagtttcagtctggtttattttgcaagcgcattcattatttattccccagagagtgctgaaattcataaacttttaaccagttgctctggtataaccacactaaattaatattctgttcacatgcaatgtggagatcattatgaaagccacgtatatgtcacaggcatgtgcctgaagtgtcaaatgaaagattttaaagacttgaatgattatgcaatatacaccggccaaatactcccaagaaaatctgcttataaaaataagttttatggaataaaagtaccaaattaaaaacatattttgaggaataaattagcacttcttgaggaatgaaattcttactttggtggggaggtaaaagacaaagcaagaaaacaaaattgcagaaatggctcaaattcaagaaaagtcaccctcccccaggagtgatttcaccatgtgaagaatggtgcttagcacaaggcaggctttcttcccagttcccctttggaaggaccacagaattttgcacacacacacacccttatttatttattttaaattgccaagtttaaacctgtgtttctaggtaaagtgccttctttattgctccaatgaaaattctgtaggaccaaccttacttcccttttttgactcttcaaacatgttagtcatgatagggggcaagatttctattccgtgaatgagatttccacaagcagattaaggaggaaatatgccctttagttttctattcgttgacagcattgcattgggaagaaatctctgtgcaaactgtccacaagaacaatagctaggggcccaaattccagtgagatagagtgcagcttaatcttgtcaaggataacttggtctttgtttttcctccttcatctgatgctttaatgaattatttcaagagaaacctacgataaagcatcagattatttttttctacagccagtgggacataacattgaaagttagggttaccatttaaatgccagaacccttaccccacagttatgtcaacattgtcatggtgggcaaaaataaattttaaaattcttttcatttataacaaataggagccaactaagataactctgaattatgtcatgactaactcagaaccccagtctaaaattatagtctgaaaggaggccctccttggtggaccctacaggcatctgtgatgctgaggtttatcagattgtggggaatagagcaatcacaggaaattgcttccgtttcctgtggcttctgattctcaaagcacaaatctaaggcaggcagccggttgggagtatattgaggcctgggaccacattggctccaaagcttgttgttttcaataacacatttctaataacacattcctccagcaagtatttactgagttcctactataggctgggcattgttccaggcacttggaacatatcattgaacaaaactgataaaaatccctggctgtgtggaattcacattctggtgggcggagcagacaataaatattaaacaatgtcagtcagtaaattatagtgtgttggaagtgataagggccacgggaaaaaagggagagcagcagggtagggcttggagagttcaaggatggggaggttggacagtaagtggggtcatcaggaccaggatcgagcggggcgatgagtctctgtaaggaggtggcatttgaagaaggactgccagaggtcaagttatcctcgctcagtgaccccatcctagacgtgaccacacgtctccagctgtggatctctatgttgccagcctctggagggcattttcctctaaaaccctggctctgctctgtctcccttgtttcaggggtggtcaggtgtgcctccaggtcagtgtggtcctcgggtttcctctcactccaccttttttcttgccggacactttgtcacacatccagctgacttctggtgaccactcatctgtattctgggatgaggtcacagtctcacttttccagcaggcctccttgataaaaggctgttgcacagaactgaattttgcaggcagcatgggagaaacaaaaggttcaaaacaacaaactgcttaaaactcgagtgctatattgatttctatttgcaactccttagccccttccagcacagtaatttcaaatgaaccagttttcctgcttaagcccacactccaacatattgctagacattttctgtctttcctgtctgatccccccaaacttactggggctggcaagctaccactggcaaagaacttaatacttccttgccttaatcgcttcttttggggtcctccaaagacaccccacatgatgacatgctctgtcccctgccatttactgtgtcctttgttctctcctttactttctttttttgtttccctatctcttaaaataccggtctcgtcattgttttcaatttcttcctttttcatcctctgtacagtctccattggtcaggggttttcaaattgggctttgtgaaatctttaaaatactgtgtaggtgttttttagtttaccaaagataacatggggtagggaaggggcccacattcctgcatcagctgcagtctttcttagattctcaaatctttatgtccaggattgtcttctctgtgggatctctctaccagagatgtcctggaggcatctccactatgatatgttccacacagaagggtaatcgtcaccaaatctcctggccctccaatactgttattgtctcagatctttcaagctggagacttcggtatcacctgttactcctctctctaattcatcacccacaaattattccataatgtctttcacatctagccccttactattcatcctcctggctactgctgtagttcaaggtcacagctttcttggatgattatagcaactcctagatggattcattgcccagtctttgcttagtgcctctatgatgctgccagagttaccttttataagaacaaatctgatcattgccctgcttaaaacctgctcttggttgcctgggatctggttgccttagggcactcaactccccttataatttttccccaggctgcctctgcagcactcatcctacagccactcaccagcatgtgcacacatacacatgcatacacacacatatgcacagacacgcacacacattccccaatcctatacttggcaccattttccaacacattgtgtttttcttaacactgggcctctgtatctctcttcccttcttcctcaattcactttttcctgtgtcagcctccctttcttccttctgaattcagctcagttaccctgtttatgaaaccttcccttcttcactattttattagtgcctatcccattgtttcccattcaccttatttagactcaggcacaatgcctatgtctcatatatgttttgcccatggcacacaaatgaatgaatccctatagcctactgtctgggcttatgctctttctctaaactctatgccttctactaataagctaaagaaaattacaatctaggtatagaacatgtagtggatactcatattgcgtgtatggagattttgcttttatatacttagatgtactgttaatagggggtcaagatgtttaggagggtactgcacaccagggtggcttgtgaataaaagttgattgaaaaatgatagagttgatacttctacaggttgaaaagcatgccgaagcggaggggcttgctttccaccttggtttggtaggacaaacctggaaaagccctgggcaatgggcctgctagttttctatgatgtggggagcatgagtgaagcaaaagaatcatgcattcttctgagtagcttacttttaattgccaagcaaatgtgtccgtgcattgaaggctaatttttagacagtattcgtttctgcattcccgcagccaaccttggataagatccaatggacatgtcttattctgtcttgccttttcagtgttgagcacagtaactgtcatatcataaataagctttgagtgaatagtgaatgaatgcgtcagctcagcagggactgtgggcagatttccaaagggataattttgcctacttgcctgcctccttcctttcttccagtagttcttgagacgtgcctgtgcttctgtgatcagcaatcaccatccatctctacacacacacacacacacacacacacacacacacacttgccttaatctatttttaattgccaatggaaagttctcccagcacttaccgtgtaagaccctcccttagcaatgtgacgagcagtaggccttcagggagagccatgaccgtggatgtagtttggactgtggctggtaccaaaaacacttctctacctcccatcttcaaaagatttcattaaaacgaattgtcaacttttctcccaatattaaaaatactctctccaaatctacttgaaattcaaatacattttattgtaactatgattattttaacctatattttagtgatcaaaattatatcagaatttctaaacttgaaggccagttcaagagctgattgttctaatgttcagaatcagacttcagtgatgtggagggagtatggttgctttcgtagggcattgaagacagagaccacccattcaaattggatctcgtttttcatttacgttttttattttattcttaacttttgaattttcttggaatcacactgcatgttcagatcctttactagtaatacctatatgcttaggcttcatgtggattgctgaaatcataaaaattaggaaataaaggctaatgttctgtgtacttctagatactggtgctcctagtagcttgattttccaacaggaaaactttgtgcctacctttgtaatcaaggagactaaaaattaaatcttctctgttcttcttagggatagtcattgtgtgtgtgtgtgtgtgtgtgtgtgtgtaagcaagcattaatcaccctacagttaaaagtgcaaatgtactattataaatattattatacctattcgtcctacctttcaaagttttaataggaaaataagcattatgtttcctttttttttttttttttttttggagacagagtcttgctctgtcacccaggctggcgtgcagtggtgcaatctcagctcactacagcctctcaggtagctgggactacaggcgtgtgctaatttttatttttattttttgttagaaatgaggtcttactatgttgcccaggctggtgttgaacgcctgggctcaagcaatcctcccgcctcagcctcctaaagtattgggattacaggtgtgagccactgcacccagcccaaaataagcattattttgacaacaggttgaatagtaaaattgctattagtgtagagagaaactatccattaactctcttttctgaatctggcagaaaaccaagcccataggtgagggaattttaatgttctgggatacaatctggcttctgaaatccttaacttggatataaatgcaattgcaatggatggtaatgctttctccgtatgctggacttgtaggaatgatcgtgcataagagtgacaaattcatttgatccttcggagaggttgcatttatagccactttcttagctcctctggcctttctattttcctcatctaggagccagttgtggaacaggaaattgggatttaactgcacctcctttggggctagagctcaaatcagaaaccttggctcttaccatgtttgctggatttgttcattacagagatgaaatagaaggtgcctctttggagaatggttttccaaataatttcgttccatgactacacagttaaaataattttgcctatctgtgtttaatagtcttttttaaaagtatctctagaatagatactactgaatccttacttgcttaactctatatctttctttttggtaattaagcccctaatcaatttgcttaagaagagtttactggttttgttgtcatttggctgaaacaaagtcgatatttaaaaggatatggtataaaattaaatctgctcagtaacttgtagaaacgatgtgcacagagtcttagaatagtttacacacgtcactttacttctccatgtaaaatcacaataggacttaaatacaggccactccaggaaagaaactctgagaagctctttaacaaaaggcaacttactggatggtaagagaagcctcttaagagacaacagttacattttcgttttagtaaaataacttagaactcagaaaacaaaattttaagagaaggagcacttttatagtttctagaaggaattaggggcctgtcttagcctgtttctgttgcgataacaaaatatcttaacactgggtaatttataaataagagaagttgatttctcactgttctggaagctgggaagtctaaggtcaagacgtcagaagattcagtgtctggtgagggctcattctatgccttatagctggagcctctggctgtgtcctcacacagaaagggagagggctccctccagtccctttataaggtcactaatccctttcatgagggctctgccctcttaatcacctccttaaggccccaccccccccccctttttttttttgagatggagtttcattcttattgcccaggctggagtgcaatggagtgatcttggctcactgcaacctcctcctcctgggttcaagtgattctcctgcctcagcctcccgagtagctgggattacaggcacctgctacaatgtccagctaattttttgcatttttagtagagacagggtttcaccacgttggccaggctggtctcaaactcctgacctcaggtgatccacccgccttggcctcctaaagtgctaggattacaggcgtgagccaccgtgcctggccaaggccccatctcttaatacacccacactggtgattaagtttcaacatatggatttcaggggtgacacattcagaccatagcagggcccttaaggcactttgaagaatgaggatgtttccttttgacctaaataatataaataacatcaaccaatattatgaatatttacttcttagaaactcttctcaaaaactcacatttccttcagtttttaggtcacgttaatattaagtcactactgtgattctatttatatgagtttgagcctgcgacatgtgcattccttagggtagggtggagggtcagctagataaattatgtcacaaattttacatttatacctagttattatataatccaaggtaacagcaaaactgaaaagatagagattctgaattaacagtgcgtcaatttttcaagcatctttagtaaattttagaatatatcatggattagaaactatctgctttttcaaatcatgcactattttgcatacttgaactgatgttagcgtatgatgttttttggctttgttctgttaacaactctgcacaaagttcaggtttctccatctttccactcatctctacaacttggacgatgaggacagaggaatacagagaagtcgtcatttatgtgaggttcccaggttattaactgaggccagtaagaaacccactggaaaatactgtatcataaaaatatgttccacagccgggcgcagtggctcacgcctgtaatcccagtactttgggaggccgaggcaggtggatcatgaggtcaggagctcaagaccagcctggccaatacagtgaaaccccgtctctactaaaaatacaaaaattagctgggagtggtggcgcatgcctgtagtcccagttgctcaggaggctgaggcagaagaatcacttgaactcgggaggtggaggttgtagtgagctgagatcataccactgcactccagcctgggcaacagagcaagactctgtctcactctgtctcaaaaaaataaaataggttccactttgactcaacccatctgtgtgtgtgtgtgtgtgtgtgtgtgtgtgtgtgtgtctgtgtctgtgtctgtgtatgttgtagcagaagttgtgattaagatgcagtcttgtgcttccatggaaaaacacttgtcgggccctaccccagtcagtctgaaggagaggtgtagctctggggaagtcagattccattctacctggctgttccttcaaccttcttcctattctcccacaatttcctggtaccagacttcatcaccaagtatacttttgtgagtttttctttggaggcgtggggtgggggtggggggtaatatctttattgagatataatttatctaccatgtaattcatccatttaaagtatacagcaattcgtatgttttgatatattctcaaagctgtgcaaccaataccacatgaattttagaacattttccttaccctacaaagaaaccccatacccttttgctgtcatccccaatttctctattcacccaccttttttaatatatagatttacctattctggatactcatataaatggaatcatgcagtatttatcttttcttggactggcttctttcatttagcatgctgtcaaagttcaaccatgttgtaatgtgtatgcgtatttcattccttttaatagacttttgtttttaaatgtgaaatgatagtgttctgctgcagtgaagcatagtccagctttccttggggaggtctggggaggtgatggggtggggtggggtgggggtcatattttaggttagttcatttctcttcttcagatccaacattataaagccctttgttcagataaaacatctaccttgttaaagaactttgcctttcttacacataagaaaaaataattttgttacacatttgtacctaaaagcaggattcaaataacagccaggaagaagtccatttatttattcatttttaaccaagaagcgtatttttttatctcgtcctaattcttaatattcacaaatcagaaataagaaattgctttatttttataaagagaatgctggtttgtacccaaagtcttgagtcctctgggtattttctggtataattttatagttatgtcagaaactgaaagatgccttgatatttatattaaccagtttgaattgaaacaggcattttgtgaagtctcagggagatccctcccacagcagaggctgtttcaggtttttaaataatctgttaggaaggaagattgatgggtgccaccaaaacaatttaaattattttatttatctaaaattaaagtgcacattgatatataaggcctatttcagtcctgatagtctgtgattcatgtttttttctatgtctgcctagtgaagcatttaggaatccaattacaaggtatccccaatataatccacatcatgacagttgtaaaactttcaaaaatgttgcatttatcaagtaatacacaaaactggagggtatagaccttatttcaggcaggaagttttgagggattcttgtggaaagtgtttttttaggcaaaacatttcagtctttcttgcaaatcagttttaatataaattaaattttaatagattctaaattattttcccatttttttcttttcagaaatatttctggactactacctaaagagtaatactacctaaagagtaataggcttataacataaagtcaagaaacactgaaaattgagcttacttgaaatagtttacttctttatatcccatcttatgtcaaagtagaagactttcttaatatctttccccagcaaatcccacagaagtttcaaattatcgaatcctgttcagtgtattaattaactcaagctgcatttatgagctcacctggtagactaacataaaaagattttgaaactatcaaacatttccagtttgacattctgagaagagaatgtttcagttttattttctgccttttaaaaatataatcaccgcaacaaatggtggcatcttaatggttcaagagagagaaatgtagcaaaggcatgaattggaaatacaactgggggtggagcaagtgtgctcagccttccaccagtgactcaccagtgaacccagtgaactaccagccagaaaggctgttccattttcttagatgtttatatatggaacacactgctttctaagcccttattctattttctatgaaggccataacaccacctgtgtgtgcacatgggtgtttgtgtgtatgtgagagagatcatatgtatttgaaaactatgaacatatattttgcttttacatgtagcttgtgttgtgatgaacttggcgtcgtaccttgtagaaatcttttaaattgataaagcagttctgtgggatttgagaaacattagatactgacagaaagactggcgtgaaaagtacatgcgcaggggagctgtctggaaactggtgagggttgagcctgaagcttcgcgtttcccccctccactgtttttagcaatgcttaaaggtaatatttttattacaacagtggaattcaccttcttgatgttaagaaactggctgatgtaaagagtggacagacttttgaggcagccaggtgtgtatctatggattagtgattccctcgggcagggtttgaatggggatgtgcagatcttgcacacacacatttgagccttgtggtagcattctgaagaagtcacttagaagggaggacacttatcgatccagagaactgtgtttctgagtgggaattggtggagaggagactgaaggaaagcagaagtgtacttcccagcctcatgagctgcgtgaacggcggctttatttggagagctgcgagccatggactgcatgtgtcctttcatctggagggttaggaacagaccaagggaaaactgcctgctctgagctaatagtgaaataacaaagtgagaagaaaggaccctgattagctcagtaaagtccattgtggcatctattttgctgctagtgaaagaaaagcttcactttcccatttcttcctgtagctctccaagcctccttggtggacatccagggctcggcttcccaaagaaactccgttaaaagaaagaagcaccttctgcctccttgattgctaaaccagcttgtgatttctcccacctttctatgggctcccggagccccaaaggagtggaagaaacagtggaagaaatactgagtcgtggctcattttgctcccattcgatgacagttaaaaaaacatcatttcattggtttgctatgggctcatgaggtgttcacttcctcagtcaccagttccctaaggctaatgcttggagccccaattggaaaactgaagacatggacccatcgggaagctcagtgtcgggacttggcttttctggggaaatttcctggtcctgatgtcctggccctgtttattcagacagggagagttcagagtggctgcgccgagagagttggcatgccacattgtaatttacaccatctatctctttctgactctcgggcctctggcaaattgcatgtctatgtgttggattagtttggaatttaatcatgcattattttccctccaattaaattatttatatatttgattaacgttttcactgctgggaagtcaaattttcaatgaaaccacaaataaactcgtgcccattgaatttcaggccagcttcatatggggtcaattcgtccatcgaatgttaagaattcattgcctatcacttttcttatctaccttggattttggtgagaaaaagaatgtgtttttttttcttagtcctaggaatatgatacaaacagtgaagtttggcctaatgtatggccctcccttcgttggggtaccttttatagcgcaggatcctgattttcagtccttcctactgccttttcttttctctggcactagaacgtacctccttctaattttgctttctcaggcttgagggctcacctgtcagatgttagtacgagaaggaaacagagctcatccactttggggattagcagtcaatggcccataggccaaatccagctgcttgtttctgtgcagcctatgagctaagaatggtttttagactttttaaaagttgaaaaaaaagtcaaagaatattttgtgacacgtgaaagttttccacattcataaatgaacagataacccattcatttaaatgttgtctgtggctgcttacagccctgtaaagcctaaaatatttactatctagcttttacagaaaatgtttgccaacacctgatctaattcattactctaattttacagatgagaaaagtaagggccaaataggtgaattggtctgtccaaaggtacacaactcatcagaaattgtctggaatgcttcctccattgccctccagtgctctgcctactgtgatataggccctcagatgaacactcactgcagagggcaatgtacaatgtattttcttttttttttttttttttgagacaagttcttgctctcccaggctggagtgcagtagtgcaaacctggctcactactgccttgacctcctgggctcaagtgaccctcctgcctcagcctcacaagtggctgagactacaagcctataccaccacaccctgattttttttttagacatggggtctcgctgtgttgctcaggctggtcttggagctcaagtgatcctcctgactcagcctcccaaaatatggggattacaggtgtgagccaccatgcctggcccaatgcagctttttaaaggaaagtaaatatttagaacacatgcacatgttaagtctgtgagttcttagaattttaattttcacttgaaatctagttctaggaaatatgttaagcttaaaatacatttgaactgcttaaacaggcagagagatgcctccctttttccttatagcaattgattacatcctctgtgcagcatttaagcagtaaagaagaggaagattgacttggttccccagcctcctaggtgtagaatttcatttaaagaaaaataactgtggtctcaatgcaagtttgaacttaagagcagttccagaaaattgcaaaaatatattagttgggactcgggtctaagggattggaaagggaacattcccaagatgctaaccttatgaaaatgaggttgctttaagtgcccaacataagtttcccccacccctccccacatggagacaacagcaagggtgttcatgcttgctgactggtgtgggatttcctgccactcaaatttccacacattgtctcagtggcaaaggtagaagaagctgggtgcggtataaataggaaatgattgggatttttccaggcactgccctcctccgctggttgccagttctcccttctctgctcagtgccggatccctcaacaccattgtaggcagattctataccttccccgtcactttggataactaaagtgtccaatttaaacgtccaatctcaggtccaatccagagccttcccttccctgtcagcagcgaggcacaggcctcaagggaactggcaggctgtttgccctccctttgccacctcacctaaaggagctggggcctgggagtgctgccaggagatgccttccctttctttctagggtccagctcctccagtgtgttggatgagacaggaaaggaaaatatgagagtccctttttttactggccactgttggcacctccttcttagccacccctgctcccttgagtagcaccaggtttccctgatgccctcctcttcaggggcagacatgcaagcctggctttcccctggggtgtatgtgagttttatgcaggggtatttcccacatcctcactgctggagacatgactgagcacacagcattttaggtgagccctggcaagctaacccaagcttacctacgtcatggatgtccacttgacccacagaaaactcatgccttctcgccatgccaagtggtggcagtctctccctggccagttctctcctgccatgcgtggccctcacgctgttcctcaaaggcaccaggctctgttcttctgcaggtacttctgtgtcatcggtccgctgtagtgtcccattctcctaccccatccttccctgcacacctgatgtgtctactcatccttcaggtcctgctctaaatgctgcttcattggagaagcggaccctgattcctgatgctgcacactgacttatgatcccattacatgtttttataaaaccctgttatctcccttcataatgcctatcacaactgtaattgtatagtaatttaagccatgacctgtttccctctggtagacttaattccttggggcaagaatcatgtctgtcatgttctccagcacagggcctggtgtgagtggcacccagcacatcctcataaaagcatgagagagaacagggaactaataagacatggatccaaccttaagcagttggctcagcacaaattataattcagtttcccaattttaccttttcctttctccctcctgtgttccttccttattcttccctttccttctgtctccctcactctctgcttgccttccttgcttcctccctcccttccttccttttttctttccctttcatatgcattaatccaaggatccaagctttatttccaatgacttggaaaactgaaccaagagcaactgttagggagtgtttttgtatgatcatttctttttctcccgtttgagaatccatagaacccctctgtaagatgtgagcttggtttccaaggctgggcttcagcacacatttgggaaagccctggtcttgtgtatgggctacaaagacttactagaagcagacgtgcggattgaacgttgacccctgtccagaacatctgttctcttcctatacctgtgtgcatcatcataactttaaagaaacactgacatggagcatggctggcttttcataggaaacccacatctgtttgccgtggggttgctccccaaccactgcagtttctgtgtcatttttggagctactgacgggacattggctctcttcttgtgtgctgcaatgtaccactctctctctgctcttcatcagatttttctgggaactgctccaaggagaggagatagagaacaacaatttcttttctctgtcctcacccagttttaaactccagaaacagcatagaaaactttacttttgtaaaacttttttttacctaaagcgaaaggccatctagtggagtaactgggaaaggcacactctgagggcagaacttcaccttcagactcacagcgaccaccgctttaggagccctggactcagcaggaaagtaatgagaggttgtgtcactaccacacgaggcatggagccaaagggagctttctcttattgaacgaagttttttggtgatgtagttctatgtatacttcagaaagtgttcccacaagccttaaattaaggcaaataaaatgtagaatcaccagaaaataaagaccaacagcatcaacctaggatgcaaatgtcttcagtagtccatagctggacattgaaatagtatgctcaacctgttgaaattgaccttaatttgattcaaattaagaagcttctcttcctctcatgctgcagtaggtttctaatgattcctaattgtattaatccaagaaattaaatgattctaaaaccatgaattggtaagtaattcagagaacttcatctttatgttaaaaactgtattaatagaattttagagctagaaagtcccttagcaactagtgaatccagtcatttattttctacaagaagaaaaccaaggccctgaaagactaacttatttgttgatgaccacacagtcctcttcctcagtataattcttttctctgcaattcttattcaggaagcagtctgattaaccctgagctaaagtttcatttgcaagtgcttttggtttttttgttctggaattgtgcatgtctgtgtgtgccttccctttttgaagcctaagccgcggtgctaacccatggcccagcatgtgagagttggagaacatctctgcagttgtttagcctcaatcgccagccttggcaaggaaaaatgacagagattcagaaaggtcaacagtggctcacctcatttcataactagctggtcccaaacctggaattgaactctgctcttcagatggccagtgtactgtagtatatttcctggaatgccaggctccatcccggtcttgccactcccactggttaggaagcatgcatacacagttagcaaaagcaaatttacttgagaagtgtactaactggaatttttataatctgtaatatggtaaagttattcttgtggtctttagaatttttaagattggggtattttctgcattttcttctgtcgccttcagaaatgatgaatacgtttccatttgatttctctctctttttccaaaccccagcatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcactgtgagtacagaagtgggtggcaggcacacttgggtccttccccatactcataagagctgtgcaaactgatgacaccagctcaggggaagcgtggttgggtggcaagagaagaggactagagtattgtctggtgataaatgcctcggtgtttgagtgactgagttggacagcgcagctctgcacagtggcaagggggcagtggtggctggcactgggaatgaatagcgggccaccctgctggccgcagcccaacagcttatggtaccacggggcttggaaggcaaagggaagtgccagcttccaacttacagagttgaagttgacttttaaaacagctaatccctatacgaggttttaaagttttcccttcctttcctagtgagtcctcaggcataggcgtatggaatgggaagggggtgccgcaaggttgtgcattcttcactgaggtgcccacgaggcgcactgggcacgctgagccctggtactttacatcttaaaggccctttacaaacatgatcaaattccatgtctttgtatggacacaaagctatattaatgaactttgtgctgaatctgaaatcagtgggaatttgaggagatcaatgagcagataatgaaacccattgtccacattgagcggtctattaaaaaaaaaaacttcaggacttttactggcactgaaaactctttatctggaactacaccaagctacatctgaatcccaataaatgcagagtttagtggactttttgttcctgggttttgaaaagctgctgacccttgaaacatcagtttttcatcaacttggagggcgtgttaggcataagctgctgttgccattgtgcagagtaatccagatttacctgttgtcctcagtttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgaggtaagcatcctcagtgggcatggagcttgcataaggaaacaaagaactatcccggggaaggcacatgggaaggcgcagtgtgttctgttttgttttccccttggccattcccagcatgaggggctctgcccctgcaggtgaaggcttgagcttcctaggtgggactggaaactggatcttatttggagaataataagagatgaggaggaaacttcttaaaacccctgcgaacttactagtttcatgttgttttgaactgccacctactggtcaaacagtgggagcatttgacttggaatctgagccagtcacgctgcccaaaatagcaggaatccatgcaaaggatgaccccataagccccaaggatatattaagaagtagcatgttgacagctgacagcttcctgctaagtcatccacttttatttgcttcctccaagtggtatcttcaaatggtattatatcaaaaaagatttttacagagcaaccagccttggctaaatgcaattttcagacattctaaattccaaaggatcttggaaaatggtctcagaaacccagaatactttctaggcagttacttaagaaaacatattgagtaaagcttcagggtgattcctgttgtgttactgttatttttaggtagcgatcccccctaaattgtagagaggcataagaataaaaattattccaaattcattgcttacattttagtgaacatcttcctacagacttccaatttggccttggaggtctagctcaaattctggcttgtctgtgaaatcttctcttgaatgtattgagagattaacaaaaggactccccacattttgagtggaaataggatagctaaccagaatttgttaacatgagacatagttcagcaccacagcgtgtcatcagtttgcttgaaatgtgttagagaaggaacatcgtgcacacatgagaccctggagtggctgtcatttcatctcaccagtgcaggtcaaacacattcatgatctttcagacagagagctgggcagagagaatcttgatagaaacaaagtgagccattctgctcagtggacttttggctttaaggtggcaaagatggttctcaccatgttttcttcagctgaaactgacagagcaaaaacatctctaaagggattaactgcactctgtaaaaagcacactcactcataaactcacacatgtaagttcatatatataccaactttctgtgtgaaaaggtcatggaaactggagttattcggaatctcattttctaactgtttgaagacattttaaagatgccacatctccatttttaatgtaaaaatgcttttacagtatgcagtagctggaatataatctattacacttgttttgtacaaaattttagggagtctagaatagatagatacatagagatagaaagtagatcagtggttgccaaaagcagaggggagagggaatagtgatgactgctaatggatacaaggtttttttgttggggtggtgaagatattctggaattaggtaatggtgatgattacacaatgtctagaatgtactaatgccactgaattgtgcaatttaaagggattatttttatggcatgtgaattatatttcaatttaaaattttaaggggttttgacttaacagaatgtatttcatatatttcatagatttaagtgtaattttgactagaaatttagggggcattcattcctatagatgttaggccaatgctgtctcctattatcatggagaagtttggacagagggtatgttaggatcagaatgcacacatataaagacaattaccaagcttttttgtctttttatggacctaaaatatttgtacatgtctgtttgctttaattgtggtgtagttgagcttgtgttcttctccaaggtaaaaagtgcaatgttgtgtgagagttgagtgtttgttataagattaaaagataaggatatcttgggtagtaatgtcattgaccacacttgagcaatttacttaaattactaacttttatcataaatacataattaaaattctacccacagacatatttacaaacaaattatacttctctcttctatatgcaagactttggccctgtgtgtgactgatggacattttcagacgcatcaaaactaagtttgtccaggaaatccagatttgtgcaatttcacaatcctagatgaatcaagtgatttgccttcatttatttcctctcttatttgcaacttcatttattcattgaacaaatacttaaagctatttatgtgccaagccctttgctgttctaagtgtggccaagaaaataatggactgtaatgggaagggagtaattgctggcacttctctgttcctctggctgtcctgctcatttagggctgctagactgaccgtagctctgacaggacttcttactccagatcagacagctcatttttcccccaaagataccgctaaacaagtttcctgagctctgattcggttgaacctccctctctagaaagctgcaatggctccctctttcctatagggagacttgagactccctaaggttgtgtaagtgtcagttctcacagggcccaagctcatccctctagtcctgacctctcactatcatgaccatgaatgaaaccttccagaagctggtgctgtgcactgccatgcttaggtgcatgaagtggttctgccactggacctttgctgaggacacttctttttggcatcccaagtaaaatgactcctaataaaagctctgtatattgagtgcttactatgttccatgcatcctggtaagcacttcatgtacatgatctaatttagcacttactgataatcccgtgagctgggcattaagcccagatatagaatcttaataactgatgcctcccatgattatcctagctgaaaaatgatccctcctctgtctatatccttacatagctttcacactttatattacagatcattgcatcttcttatttttcctatcagattttgtattccttatgattaaattttgttgtatgcaactttgtgcttgcagaatcttgcacttcagtaagtctgagaacatttttcttagtctctaattatattttatttcagtcactgatcacaacaaaatttgtgggcaaaagttgtgtgaagggttaatatattttgtttatgttatgttgttgtgaggtatacatttcctgaacctgtattcttgtgaatttgtgaatttttgtgggtagataatgtgtatgttcacacacaagggcacacgggcacaggtgcacctgtatgggctgttgtttctggaagtgcaggagccgacacatttgtatctcattacatattggctgcgtccttggttctaagctaacccataatgtacatccatatatttacaggaagagtagctctccaaacatgcaggctttgtgctccctctctccttctggtctccatacctctgccccatatatcccagtctgcctgttgatggaacaacctgtcacaggaatgctgtgagcaagcatagggcctgtgtcagaacactgtaaggtaatggcactaattatcagagccagtcttttgtccctaatgcatagaatttgatgtgctcatcttattatatatatatatgctgcaaatcacacaagctcctgaatagatgtaattcatagttaatgggaatcaattctgcccaaaggagtctcaggtttggaggtgaaacctctcagtttcaggatctttgcttcactgcattaggacatttcagcattttaggtagcactcagtctgttcttgggcttttagtgaaaaagcatcttttagacatacattctacaagacacggcatccttttaaatataataggtacattatagtaatcctgcttttcatgacgcttgcttacgtaaaagctcatcctctgctatacatagatataaatatatattcatgaaagcattcttgcgtatattatattttaagccaagtgaacaaactcacaaatccgatgttggtcatgagccaaaggtcagcagttctgtgatttcagaaaataatccgcttatataagcatccgcataattttttatgactgtatccttaggcttgatcactgacccacatagaaaatgaaattagcatgaaataatttatagaccttagttataaattcactgaggagaagaaaacagaccagaaatcctggtccccagaacatccgtcagccctctgcagtttatgatgaggattcatggacagtctgtaacagggctttccaacttcaaagagcagaaaggttctggctattttgagccctgaacatccccacacttgtaatgctacccaaaggagcacattttagtgtcatctaacatgggagatgccatcggcaatttttaaattatgcctgtgcataaatagcacattttcaaaaggatcagagtgatattagatctcacaaccaggacatccataaaaaactttgtcacacaatctcttctgaaaggtgtgcagtcttctcctgattagatgatgggtgtcttttaagccatcttcatagtcatcgtcatcatcatcatcatcatcatcaaatatctattgagtgcctattatggcaccgtgatacttctcactcacagtgtaaatgcttccaagaacatcaaggcaatttacacattcttagttctccctgagcctctctctcaagccataatctattaaagctaaattctatggacacggaacagtgttctaatggccttattaaactattagttcctagaggtatctgaacacctcaaagccttgtgaaagtgttttgaaaggattaaaaatgtaatgagcaaccataaaggacttttgggctggggcatagtctctttcataacaatctcttacctcgttcttgtgggatttggcagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatggtatgtcattcactctccttctgacttcacagcaggcccatttaaaagagccaggtagggtgcatagagggacaggacttcccggtcctcactgtgtcaggctgtctctgatctgaggaggcgatgagggcagtgacccgtattgcttacgtgaagtcgatcagctcagaaaaagagtttccaggtttcctaactgatttttaaaatccctcccagaaccataccactgtgccatggaaggaagaaagacacgactgtctgtctctccagcgtgtctgtaatgtcgaaaatcattcattgactcttcctgtaaacatgctttctgtcttctttgccctggtgaccccaaggtaaataggccatggcccatattctttaggagtttacagtccagtgggatagatagactgaaaaacaaataccgtgcagtgtgatggaggcttacacacaagtctgtgtaaagaggattcaggagagggacggactgccggtcagtcggggcagaggaagccatgggacaggagttcagtgctccagagggaagagctgaggaggatgaggaggcagaggagcacaggggtgggaggggaacagcatagcaggggtgagtttttttgtttgtttttttgttcttgttttttgaggaaaccactccagtaccagtctagaaactgggtaaactggagaccacttctgcagttgggcctgaaccagtaaggcagagcatgagagagggatctggaagattcagtaggcaatctttgtgtttggagactaataggacatgtgggctctgctactctttcagcttctttcaaacctcagttcgtgacttcgcttcatgaatgtgattttataaaacacctaaaaatttcaaagacaacaagaaaaattaagagtagatagtatagtagaggagattcagcccatctggccatgcgtagaatggatttaattgtgcaaatatattgggttctgggctgtcactctctaacctgtgaaggaagtgtaccagagagaagtttcatgctcagactgccggatgcacggaaacaatcaggcaaacagatttatacttaaagccagcattttcttaaaattagagcagtctatcggatggagagcctatgaattcatgagtgatgtcacagtacgtgtgggtgggaaataatgcacaatcttaccattgagacggtgagaagctatgttttaatgacttactgagtttgtctttgaattcttaagagtcttagagagtgacattaagtctagccaaaaataacacaaatcagctatgcagatttatcatgatttatcagtgggtagctgtactttgctttaaaaaagtatcttaataagatgtttatacattatggttgatcactgtattttaatcagttcataaactgtgttttatatactttttttgaaggggagcacatgtctattcttaaaataaagcctacctgtataataattgtacagaacattcaacggtttatcctcacgtgtttaacaaaacaaagaaagttaatttgcagtcttagattatgtcatgaaaccgatgatttatattcttgggatattccaagaacccaaaatctcttctacttttagtgtacattcctagctcaagaaaattgtcattttctcttcaaacacccattgtttaaaaagaaaattggtagaaataaaaattacagcgatttggctcagcaacattgagatgtcccaatgtgtgaaatatttcataaagtaattcagtcatattaggttggtgccaacgtaattgtgggtcttgtcattacttttaatggcaaaacccacagttactttggcaccaacctagaaccataggactaaaagaaaccatggagatcaagactatgcccatattttgaggaagctgaggcttagtgaggttaataaattaatcacatttccacagcagatattatgtgtgtatatgctcacacacatttaaaagtaggtatcttcacagacatttactaataaacatgaaatttacatttctacttttctttaaaaaacatgtctttgatttgatcatcatgctataaattaaattctttcttcttttttcttattaatgcaacatctcttctgtctaatgctcctaaatgtcttgttctcacttcctaaggacagtgggtaataaggtgagggaattttggcttctctgtcctttttgttttgttttcatttttttaacatttacttttttctgttaatttttctttagtttttgtggttttgtgatacttttggtagtgaacattactcagatatgtttcaaatatagaagcaatgtgttttcaacattcagcatgtgaaaaatgtggagttagttggtgaaattcattgttctatctgtctaggtttccataacaaatcacactggggcctaccaagcagatgttctgaaagactcattattgtactgactaatgcaaattcatccttagaccagatgtgcaccaccttctttgaggaagatctggctttatttgttgttagcaatgtaatctctatttaaatgtggacgctcattgaagcaatttcctaattgtgagtgcatttgtgccttatatgaagtgtgtctgcctgtgtgtttgcacaaatgcacaagttcatgtctgcacacactctgatttgacagtccaggagtcaaagacatccaaaactctggaaacaagtacctcaggaaggagcaggtggtctggcactccagcactctgctgaggccaaaaattaagcaaggcttcacatactcacgatcaaatttgtataacttatttggctctgcttggttgcccgggacaaagttagtgtaccatgcagcactcacttagaaagtgttcatttgcttgggtgtatgtaccatgatagcagaagaagtgaaagggttccactgcgaagagcccttcctggtggcactgtgcattccacctgagactacagtactctgtaaccgagtgagtgtagttatctttccctaaagcactctccctttcggctgctgtccgtgtttatagtaacactggtgaaggcgctgcagacgcatggaagtagccggcctaggagtccaggctagttgcaccattcactttgtgactttgggcagtcactaaacttctctgaacatcacttttcttatctgtacaaaaaggattcgactgtttatcaaccaggacaccgctggaacttgagatggaacaattctgtgctgtgtgactgtcctgtgcattgtaggccattttatatagtaatccccagatattgggcaccctgaatttccaggagccctgggagcgagaggaggcagtactttccctgattgaggactacggtggactagattaagattccattgtttgcagcattgtcttatagagtctactcggttggggttagggaatcatttcctaatcctcctagtgaactattagggagtacactaaggagaacagtgaaatcattctacagactcatgacggctgtgatctgcagcctttctttctttctttctttctttctttctttctttctttccttctttctttctttctttctttctttctttctttctttctttctttcttctttctttctttctttctttctttcttctttctttctttctttcttggtatagcacaagctaagtgattgaagttttacctctctcaactgcttttactgacaccttggttgaggttctacaaaagcaagaaaatgtggaaggagggaggagaggttacaaagagcttggctaaccagccctgaacagcctagaggggctcttgttggaggaggtaatgtgtgctgatggcgcatatcttacatttatgtttcagctgagcaaaatgaacctcaagactaaaaccacccgggatcataataattgctaacatcctgtgaaccaattgctattatccaggtctttttatacttgtgtgctctctgggcttcacacttaattcctcacaacaatccctgaaataaatggtccctgttttatagataaggaaactgaggtttagagtggctaagtaatgtgcccaaagaataaagtggtggagatgggattggaaccgaggaagtatgtctgcagagttggcgattggggcaggattccatggctgataccatgccagtcacactgcagctagcattctctgctttccattgcctcctgttgcccatcagcctggtggtccatccgtcattctggccaaaagtggccagcttccattcaccagaacatagtttttcttctcattcaaccaactgatgatcttgaagatctcgatatgcatgagctctcattattggctccctttccttgaccctccctggtgacatttctttcctttccacttgaccccaacagacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggtgagttctacatcagaccatgcatctgctcagggtttttttttctgttcttttaaatgcaggccctcagttttatgtttgctagtttctccaccagtcctaaaatgacgctgtaaccatccgttaatgtttagcccattcaagttgccttttgggattgtccatattttaaaaacagctaggaacaggataatattgagaaaaaaatgtgactgtgcatgactcatattctgatggtgaaatcataactgttagattagggtaagggaatgccagcagtggaggcatctgtggttggaactctgtctctggtttccaaaatttaaaaccacgaggttagcagccacttttatttatatttacccagttcaaggaaagtcagaaatccctccccactgtcagtccccaggtcagtttgcacttctgagattacacttctgagagcacctaaggggtgaagctcttgcctgcaccaacacaggtgttacctgttggtaggatgtggcatgaacaggacgccctgagcgtgaatgtgaaactcgtggagtacctttgcctggggacttgcctggaactcaagcgttgtgtaccatcacaagattctttttgtccttgcacagcgcttggggaggggcttcagtgaatcgagggagttgttattgttttgtttaagccaggcatcagcaaactacagcctgcggccatctccagccgcccctgtttttgtaaaggaagcttcatggacaccccgccacgcttgcttgctcactgctctctgtggccgtgttggggctacactgcagagctgagtagttgtgaggcaggcaatgtggcctgggacaccagaaatagttcctagctggccctttacagaaaagggttgctcatgcctggtgtaagtcatgctcgaagggaattcatctccgcatggtctctccctttctctgtctccaggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgccgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaaaaaaaaaactgtaagccccgccccctttttagtaaaccgatgtaaatttgtgatgtgcatattcttctttcttttagaagagcagtcaaattaaaggatttgacatgttttgctgttgctcaaaggaaataggagttggtgtgcttgtgaccaaggggttacacttccagcttttaaaattctcctttaca

SEQ ID NO: 16 - DNA, 32411 bp, Homo sapiens
tcaggccaacttcggcctgtgctccagaggaagccttcaacgcagagctggatgggggaggggtggagggcagtcgctgtgaacgtccaggtgggagtctggggaccaggtactgcagggaagggctaaaagataggtcggggtaacccttcagatctggctcagctagcctgtctccaagatttaggactctgaatctctgtgggctcctccctgtccccactcccaaacgcctgacgcggtgccccctcgccctccgctgctcctttctaccgctttccctcctccctcccatgtcttttccgtccttggtctagggctctcggcctgcgcctctgcaaacaccccctcccctccaactccggcagaactccgaggggaggggccggaggccacccttcccgcctgtggtcagaggggggcagcgccgcagccccgggtttggggggcaggggccatctctgcgccccgcccgatcaggccactcggcgcactaggggtggagggcgggaagcgtgactcccagagaggggggtccggcttgggcaggtgcgggcactggcagggcccaggcgggctccgggggcgggcggttcaggttacagcccagcggggggcagggggcggcccgcggtttgggcgagttcgccagcctcgaaaggggccgggcgcatataacgggcgccgcggcggggagaagacgcagagcgctgctgggctgccgggtctcccgcttccccctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagacgctggtgctgctgacgctgctcgtcgccgctgtccttcggtgtcagggccaggatgtccgtaagtcttcccccgcccctgcctgcctgcctgctttccatgcgtccctcagcatccttctccccggcccgctccagctctggagcccgcggctccgggctaaaacggctcccggggtcgtagcgcgccgacttaggcacaggacacgcagaagttcaccaagaagagttctgccaatcaaggactctgtcccagggtcctcggtgcccatcgcagttgcaagtatttgcaggtccctacgttgcgctagaatactgaacttgcaaagtgttggctcggagaagtttgcgcacagatataaatgggctcttttccaccagctttgataattaggcgcacatgcacacagctcgcctcttcgaagcacttcgagttcagcaaaaacagatctcaactcatcgaacttaggtgaagtaggaaagagagagcgcgagcgagggagcaagcaaacgccaaagggttgacttcacagcctgtccaaggcttggtggctggtgggctcaaagcagagttagacaaaggggactaacactctgacactggtgggctgaaatcccaggccacaaagaacggcttccgataggccctctgagacctcagcgcctctttagggtaccctccccctcccagctggccctggagcaaggtgcagccctagcgctcatctcgacttccctccgtccgcctgcgcctctcttctgataaagggtacagaaacttccagtaggagaggccatctgaaagacgataacattccaaccagaccgtgcttttcaaatgcccccgaaaatagcgcccccttccccgcggtcttaccccattccccgccgccccgaggtactacaatgagttacttttctaaattctggaactcaccgagccaggctgcgtggtgtgtgtgtgtgtgcgtgtgtgtgtgtgtatgtgtgtgtcagggaaggggagcaggctggtcgattgctacggttgctacaactatttcaaccggtatagttagagatggctcttgtagtcgggtccaaatgctgttcggactgcacctttctacccctcctttggtaaggtccactgtctgggattatattcaggacaaacgaagcctggaaagtgtattaggtagagaggatttttttttccacgtgtttgggcacgtttccgacggctgggattccagccctgtctttgtatgttacagattgtaaatcaatcgcagagggaaactcttcggcggggggaataaaagttctctgccttcgaggctctgtgggccctctcctgccaccaggctgtttccagggatagcgtggaaggcggcgggctcaggcgggctttccggtcattagcgcagcgggggcagggctggagcctgcggcgcagctgcgaggagccgggagcaggagactctggccgggtcacccggtagtgcgctaagctggaggcgcgctcctgggcatttgaggaatacagcgtgactatacgtggcctggactcagactgactatatttttgtactacatttacaagcacacgcccacaaagctgtcttcttgactgacccctgccttagtgcgcaatggaattagctgggtggctttaaaataattctcaaattctccatccggtattagggtcgcttgcttaattaggcggtagagctctctcatcgccgcatctttcctgggagggagtgattccacagcttctccggcccaaaccttccagtcgctcctcctcccagagggagtgtgattctgcatccgagaggctgattttgcgccctggagcatcccaccttttataacttcccccgcctggggtcagcggacccaaaggtgtgacgtggggaaatgcgcagtctgcgtggacgtcaggaatgtcagacacctagagctcggccacacccctcctctccatctttccacgagtttgagaaacttactggcggcggcgtctttgaccctcatctgcatttcagagccctcgcctccgaaagtgcccctggctcaggggagagatctcaatcctcctttgtgaggcttgtttgcattgggagattggcagcgatggcttccagatggggctgaaacgctgcccgtatttatttaaactggttcctcgcggagacctgtgaatcgggctctgtgtgcgctcgagaaaagccccattcatgagagacgaggtccagtgggttctctcgtactcccagaccccctctcccacaatgcccccctgtgcccgcccgccgccacctctcggctccagccctgcgcagagcggcggtgaagcaaaacagttccccgaaagaggtagctttttaattggcttgccacaaagaatcacttatacggccctgcggtaatgaggggaaccggatcaggcgcgccgggatgctatcggcagccgttttggagcagcaattatggtggtgctgggctcctccgtccacacctaggggatccggttacggcgctggctcctttctggggcagtcatttaatcccacttttcactctcccggtgtctgtgagcgagccgtgtccagagccgcagccacagagtcactcagcggctcttacacccagcgcagcctggccccgcccctgcgccggcgcttcccgggccgcccttccccgggaaatctgatccgcacggggagtggcccctctcctagcatttccccctctcctccctgggtcctcatgggcgagggtgggctctcctgtagtctgggctggagcgcattaaccgatgccccctctcccacaccttcctcaccgcctgcattccactgctccagctattttaacggcgggtgtgtccccgcaacttctgtattttccctggaatccctcaccctcctgtgattatcttgcccaaaggctaggcggatttcttctagtgggaaagtaaaaaggaaagtttatctttggattttcactctctttaaagagcagtgggcaggctcgtttctttctcgccctctgggtttgtggctctttcctattattcatcccctgctgctgctattgccttggggattttgatgagaaaaacagcgctgggcgctccctagcacgtggtgcgggctctacagcccttggctgctaaggagcgctcttgtcagcacaggtttcatttgcagcatgaattccagacggcagggcgctggtggaggagactagtccctgctattcttcctctgcagtcttggaggaggccaggcctggactggccaatcttagccctagccaggtattcaacgacccctgctccccaaactggggtgctgttttcagatggaggcagggcctctccaggcagggctacaggtggaggtcagcactgggggcgctttggctccactggcctcctaagcagtttattagcctgcccaagccccaagtgtattgtttgaatgggtctatccccctccccaaattggtcctaattctaatatggttcaaagaatgagacaagatcctaattctaatagctcgtcttttcacccccctttcttatatacctatttttggagcctcactgcttatagattccaatttttgtaggtagaattttctacattccctctgaatgttagttgtcagttgtatttagctaatcccataattcccagaggaaggcagaagaaagaagacttctctgctcctgggctggtggaagggaggtctcgccatttttctgtctcctttctttttatagtcccagaattcctattcagaatatcttgtctcctcccttccgctcaccctccaactccctccacccactccatcacctggtctcccccgtattaggtgggtaaagagaatatagtatagtaaccccccaccttcattgctgggtcaagattttcactggtgaatagacaacatggtgcaaggtgcataataaatatttgttgaatacatggaaaaatcaatgatgttttaggaaaataatttttaagttctatatgtccaggtggccccagcctacattcttcagcatttgaattctgtcaagttgactgcaacctctctctttttctctctggctccccaccccctccttcccttggctctctgcttctccctccccacccttggtgcagaggaggctggcagctgtgtgcaggatgggcagaggtataatgataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtggttgtaatttatttatttcctgttcaacataaataaattacttgcaagcactgcaaacacgctcccatagatgctggtcgtctctgcaaagcagaggggctagttatccatgggacctggtagctggggtagaaaggaaaggccacttctcacttgcaggttgaaactgagtgaacgagcctgagacactagaggggtccttctttgcccaacatctccaaaaacatttgcttccaagacacatgaaggacagatgtgattctacaaaaaaaaaaaaaaaaaaatcctctctgaaatcatctctgcaaattactagagccactatggagatcaaatgctctgtctggccaatccacgaattaattcctcctctgccaccgacaccttgtcttctccttagaagacttctatgtatgtggtcttcagtgtggagaaagctctgccagctagtggggagactgcaggggcagaggctccctctttgagttatggaacattggtggtagtttcctctctgctattacctctcttggagttgaccattaattcagaagcaaaataataggagagggaagggctaggctttgggagttctcgtggggacgggtggagacagagccccatgtatctgcactgtagtgggtggttataaactcccagttagatccagtgctggtggatgatatatgtgcaggtgaccccttcccagcattcatacagatgtcctatctccctgcagagtgagtggggacgcttgtgtaggttttttgggtagctcttgctgtccgcttcctgctgaagtagagaaggccgtggcaagggaagtgagaagctgcctttccttaacacttcaccaacactggctccctaatgtgcagattcccagatcctttctgaggggcccgtgtgagtgaagtgttgattgcctttactattttgctgctactgtgaaggagaggttattgactggggatggcacaggctatgatgctccgatgctcttcataactcatatgccttgctgtttttgtgtttttatttgtgcttgcttcaaggagacccagctctaatgtaagacctttctaagtacctaactcttcctctgggagggcttggggttcgggaacggctccctaccctgtggggggaagagagactgaatctgtgctttccttcttgtggctgattagatcttgagctcttcattgcctttttgtgctgcccttgctcctttcttttgcatgctgcctgctttttgaataacaaagtctgggtcacctccattcctcatgggacctcagcaaccccagggccacagtggccctaacaccccaacagaggggttcagtggagtcacaggaagctgccgccttccttgattgtgtccttttacttgtttgatctaatgagtgtttgagtgacaagaataggtatttttccatctcaagattcttaccttcttcttctctatattttttcccttgcagggcaaccaggaccaaaggtaagggctttcttctttttcttttttcatatttttttggctttatattttctgcttcaaaagcaatgctatgttaatccagtctgtgattttttagacatcagaagatatctgtttcagagggtacctcaacacaggggctgctggcagggttttagactaggggcttagtgggcttactcggcttaatcctgtgaatgtttcatgtttcagggacagaaaggagaacctggagacatcaaggatgtaagtgcaaattattctcacccggtattgcagctgctgctctaaatgggtcatttccttgtgctctcctctaacttaccatcctgtggggctctctctcacagattgtaggacccaaaggacctcctgggcctcaggtaagagagggagaaatctctttctccgtcccttcctcgctgcgcgcaagttactgatctgcaggctcctggccttgctgtcatcttaccatgttcttcaccttcagggacctgcaggggaacaaggacccagaggggatcgtggtgacaaaggtgaaaaagtgagtaaaaagcaatgctgcttgaccctggtggacttcccaggtcccccaaggccccaccatgtgtttaagggcctggtcacctcttaaagagcagccaagggacagatggctcttggagaaacactgcttcccattgatgcctttttctctttatgccaagggtgcccctggacctcgtggcagagatggagaacctgggacccctggaaatcctggcccccctggtcctcccggcccccctggtccccctggtcttggtggagtaagtatccttacttcccattccttcaggctgtccctccagaaatgtggcttttaaattgctgcttgcacttacctggctggctcccagggctgccagcagtgtgtacatagcctgtccatgggctttgccctcaggcctgtaatttagaagagtcacatattaggcatgagactgtggtgctaagggctggcttttttcactaactgggattctataaagaaagtcctcagttacctggcttcctggcatctgtaccacgtagttgatgctggggggtgggtgtaagggataggaggaaggatgactgggcacttgtatttccctggaagacgagtgaccactgtccttggaagacatttatccttggttcttgccaagtacattccaagcaactattcactctcatgaaagagctccactgagtgaaggtgtgtggctaaagtcaattctggaatcaaaccaatcaacaaattatatgattgcctagtttttgcaggtttgctattttgatgtttgctgtattttaaattcttaaactcaaatgggatcacagatgcctactacatctcttgctgaaatattccaagactgttgattttagtcttttgctgggcactaaagtcttaaagaataaagaacacccttagaaggtttggttatgtttctccatatacgttaaataacatctgtcatattttagagcataaaaataattttataaaatgaaatgcaaggaactgatacttcctcaaataacactttcccttccagtgaaatgattttgccactgtcatctaataatccattcccaaaattactttccaggcatcagtggtaattctgatcaatgataggttagtctccaacaatcagagtttatctcagtagagttctttgtatccatatagagcttacctagccaagtagggaagacctagtgcctttcaacctcctaacgttgttgggtttctttgcagaactttgctgcccagatggctggaggatttgatgaaaaggctggtggcgcccagttgggagtaatgcaaggaccaatggtaagaaaagacactagttctttgcagccaaaatggcaggaggtggcccttagcagagccagagagtctgacaacctctgctttacagataattgcttagagtggctctcctccgtagttatgtaacctcccattcagctagcccaaagcatttggtttttaatggcaatggatgccacttttaatgatgcgctggagtgactaagaagaatgaagatggggagatgcatataggctgatctgttagaagaccagttgctattgctcttggaatgagaactgaagaatgcagacagcagctactgttctccagcatccacagacttccagcaggaaatctcagcccgcagctctgacttggcacatgctaaatgaaactcagcctttagtaaacatggctgctgtccaggagaaagcaaggccagcttttctgtccaaatggtgcctataaataaaaatagagtgttgcgtggggagtgggaaatgagagggagcagccactctaggccccttgcccacagagtaacttcttgtcctttgcccgggctgttggctgggagaagatggcacactggaggccactgaggaagcatgtgtagtaaacccctcattttctgttccgatgcagggccccatgggacctcgaggacctccaggccctgcaggtgctcctgtaagtatctgcaattctttttgcctccatcgtgtcgcagatgattcccaagcactatgatgttttagcagtttatagggattgacctggtatcctcattttactttttaggggcctcaaggatttcaaggcaatcctggtgaacctggtgaacctggtgtctctgtgagtaccagcacggccctgtcccttctctgggggagcctctaatgatagaccactaggaccgcagctgctgtccctcccaggctctgcccagctctttcccacagtcggtggccccaaggaaattcggatgtcacttcctagctgtggaggaactctgacagacagcccaatgtggcaaggaccaccagggactctgtcctaacagccccctttccgggtcaccccagcctgtgctatctgctgcgtcccactatgatctctgcacctttgctctgaccttcccatctttcttcttcatagaagaactggcttccaaaactacaatgtcaaagttttgtccattgcttaggtgtcttcccactataaccatctcttaaactatcttcctttgtttgtagggtcccatgggtccccgtggtcctcctggtccccctggaaagcctggtgatgatgtgagtatacacgagtagacaaatgaggagctgcctcctttgaaagggcctggagagggtgtgtgcttggggagtgacagggaggcacccagggtggaggtatcttgaggagcaagactgggcagtcccaaaccctgacgccatctcctatctatatggccactgtgactgtgctggcaagttccctggggaccgctttggatccaaggggaagacaaataattaaaacatcattagccccaggaagggaaattgagaaatgagagaagggagagaaaaaatacaaggcagaaagatgtagagaaggaaaaacaaagaaagaagcgttcaacaacccagcattatcttaattgtaaatgagttagaaaaagcacagcctgagtcaggatgtctacaaaggatgcaaacgaaatgaagagacaagaattggcactcttgtgctatttttatgaattgcattagacagtaaaagtctcttgaggttagagagagcacatacagtcagcagaacctaggagaggagagaaaaagcctctcaggggaagttggaggctggtgaggacagaggagcttgcccatgggctatgcatgtgtccaaaagaataaatggtgacccatgaaaggcatccaggcacgtggagtctgaaggaggtgagggagatgagtgagccggtaggcaaaggcatggagggctggaaggagggaagccctctggggtgcccccactatgctactgcgtctctgaggaagctgggatatctctctctctcccttcagggtgaagctggaaaacctggaaaagctggtgaaaggggtccgcctggtcctcaggtaaacgccaccgttcccagcctcaggcatctttcctagcgtctccctccctgtggccttaaacacagtgcatccagttcaatgaggtcacttctgagatgaaacgccagtagcccctatatttatcacgaccatgtttgtaatttccactcaggctctcatgagggaggctgggcagttgttatttataccactttgcataaaatggggggtacggggaggggtggtctgggttttacagaaagagctgtccaagtgtggggattcgagacaacgccctggtggcccaagggaactggaggccctcctgcagcccagggcagctttccactgttattttactctgtgctctgaacacctccactttggattgcagggtgctcgtggtttcccaggaaccccaggccttcctggtgtcaaaggtcacagagtaagtatcacgggtgagaaggttggaaggaagagatgcctggtgggagagaaaagcactttggggtgcgtgcatttcttccaacttgggtttcccagaagtctgattgaacattttctcttgttccctagggttatccaggcctggacggtgctaagggagaggcgggtgctcctggtgtgaaggtgagaggccagaaagtacaatgggatggggaggagggagacaatgaggagcccctcttcctagccagggagacactgtggagctcagtggaactagctcctcagaacagccttggctgggaacaccagccctacatcctgatgggccaacagcaggcctggagagctcagggcattgtccctcacaggactgaagtttgtgtcagtgcgagctgagatgaccagggcttttggcgtcttccctaggagtttgctggcggccaagaatggggtcccagacactgaccttgtgcatcatttttccagggtgagagtggttccccgggtgagaacggatctccgggcccaatggtaagtatggacaccctccaggaaggtttatcaaagactcttcagactatcagatggctgcaaagagctccctttgtgcaaagttcatattctgtgttgtagatttcatctgattgtgagcaaaaagcaaaatgtattagacagatgatttgttcaagatttcaccaacatttccttaagatacccattttatcacactaaagatgctcccatttaaaaaaattctgttgagtctcaacattttgtcaagctcatctactgcaaggagcaaggtgtgcttgtaacaaaggttcccaataggtagcaacaggaacattcgtgtgttccgcctgtggagaaaactgttgggtgtgatctgaggcatcctggctagtcaaggagccagcaccatcaggaggtccttgttttcctgggtgtgggcatcctccctctcctctggtatccgcaaagggcctgcaggtagaaatggtcaccctgagcaccgtaaagccaactcatgcttaggctgtcctggtgtgtgttccagggtcctcgtggcctgcctggtgaaagaggacggactggccctgctggcgctgcggtgagtaattgacaaagccaaacaccaccatttgccgagcactttagagtttacaggtttgtttctcttgaccctcgaaacaaccctgtgaggcatagggagtattgttatcccttaagaattcacccccagtgtgcccatcaaaacttcccaggctgagtctgcacagttgaaggaggaaggataggaatgggagggtcgatgggtgaaagcatgattctcttaaccagtccagattatcaggtaatcccttcaacaaccaccacccactccctgggcaatccagctggagtttacagacagacttagctggctatagcaccaccgtgctactctctgttcttcctggttgctcaaatgccctagaaaagtggaacaggtgagcatcaactcacagggctctatgctggctgctgctgtgagggatgttatgctatagtaccaggggccaccattccataggcacttcctgtgtttaataccctatatgctttacttcatctcatcttcctccatatcctgagaggtggttctattcttctccccattttacggatgaaaaaaccgagacacagaaaggtgaaatagcttaagataaatagtgccttgcagccttagactctggtggcctctagttaatgtgggaaattaagggtgaggggattggcagctgatggagggtgcagggtgccagacagaggcgtttagctctgattccttagcaatagagagtccttgtaggcacttggtcaggcgagtgatgcgatgaaagctgtgtttaagaaagattatgctttctgctgatttcatacccccaacacccaagctctgaggcccctcctcacaggtccttgcagggctggccaaaataaagcagcttcactccgttgtgctgctttccagctaatgtgtctgtttggcagaagtttccctcaaaggcagatcagtgaaataagcagaagcctcgacccccctttgtcagccagagctgctgaagtgccttgccccagggtcactttgtgtgaggggattagagagcactggggctgccaagaaacactgccgtttctacagattagcaggatgctggcttgtggccttttagcgaggctcagagctgcggtggccctagtctgcatgggctaaagacaagctccatctcctgtccttgttccctccttcctgggcacagccgccctgcttcttggttctctctgttggttcctgtccgcacggtagttaggctggcagcgtgtgtaggatttggcttagaagattgacaacattgcctttgagcccttctttgctactcctccctctcccctcccatcagactcctctctggagtctgctctgcgaggcctctgctctgtggtatcccagcagccttctcagccttgacttccagaagggggctgtgcagtgtccggggtgtgcaggccccagacacggggtaggctcatggagatccaagtgctgatctagtgtcaaggctggcctggagactgggctgggttggtgtctgcctgctgtggtcatgtgccctcccttgggcctgtatcctctctccagacttgctgcagggagaggtggcagatgtcagcctagttctggcctctcagagcagcatggcagctccctttcactcaggcccaggctgggccctcctgctggctgacccctggggagagggtgctccagagctccccaaggaactgcttcccgaagcagccaggccagcccagaggggctgtggccaatcctgaagctttatgttcctgctgacattttttctaagttttctcttgctttcctcttaaatgccaatctggagagtctccgttaggagaaatggaccccagccaggaagaagagttgagttgtatttaaaacacgagctccccctaaagcatccttctttagcttctaaggagaggcagagactgacaggcaggactcagcaggaaaaggtacccccctgacctgctcagtcaggccctaggcccagctccacccagcctgtggcccccagagtttcggtaaagagttccctgggccttaaggaaccttgagagagcatttgaggggtgccaccacaaacttggcagaaaaaaccctccccctccaagtccagtcctagagaaggagctggcaaccttgccttgctttgtaagcaaaagcctcttagggcttgagctcagatgtagtgtttgagctgtggctggtgccctgccccatcagggagccaatggtagacatcctatgggcatctttgttttccgtaagagcaggctgtctggggatgggccagaggaagaggcaacctggagtcaaccaagaggaggccttaaccaagccttaaccacagaggttaaccaagccttgaaagcgcttccccctgagcaggcaggaagcactgagtccacatggttgcctcgctgtttcatttccttacactcaattctctcagtctttaaatgatcacttggccttgaagttacggatatttggggtctgaactgaagttgaagaaaagagaaaatgatttaagctttgtttaagattaggggccaggtgcggtggctcacgcctgtaatcccagcaccttgggagcctgaggcgggtggatcacctgaggtcaggagttccagaccagcctggccaacatagcaaaacccagtctctactaaaaataacaataaaaaaaatagccaggtgtggtgacacatgcctgtaatcccagttactcaggaggctgaggcagaattgcttgaacttgagaggtggaggttgtagtgagccaagaccgcaccactgcactccagcctggcgacagagccagactccgtctcaaaaacaacaacaaaaaaagattagaagaagcccattactgccttctggccacccactcgcacagacaccaaaactgcagcccacacctcgccatcctcgtgctctgccctgggacaccccaggcacagtgtgtccttcgttttctgtaagggtgggctgggagcagggacggacagggcctgtgggcacctctcatggtcacttccttcttgctcacagggtgcccgaggcaacgatggtcagccaggccccgcagggcctccggtaagttcatttcatcctcagcaggtcattgttgctgtgctttaagtcccgttaagcagcccaaggcagtctgcagggtgtattgggtgcaaccacagcagcactctgatgtctactggaaagggggaggaaagagaagaagtttgtaaatatcaattgagcatatcgataacaagctttgaagcatgggctcattttcctcagccatcctttcagcagtctttttagaggagggaggtcaaaggagtttctgcttctcaccacagatgtagtcagaaacttgctttgccttctgaagccaggcaaagtttcctggggacgctggcaatggggacaattttcatccaaggccttttagccacaatggatatggagtgaaatcagtacagaggagggaaggagtgtgaggtgtcggggtggctcgctttggaggccagaactggcattcacctctcttctcatccgcctactctctccagggtcctgtcggtcctgctggtggtcctggcttccctggtgctcctggagccaaggtacgtgccctgttgtccagtcaggaacttctgggtgccgagaagctgtcctttccccgtaacccttgctcattgctccctcaacaaccacctgctcccttctgagaagtagctccccaccaccccacccactggcccctccatccaggcagggcaaaaagccagacactcgcagtctcacctggagggaaagtaagacagaagataaaatgtgggagatccagttacaactttggagtggggaaaggtggacagagaagaagacggggatacaccataggcctggcaggggcagaaggccaggagtggcagcacagggaagcaaacctaggggagacccaacagctgagcaagctcggggccctgacgggcactggagggaactgggcagggaaaagggcacaggcagggagcccctgctcccctctgggtttctgctttatttggggtgcctggctcttccaaaccatgttaacggagttctctggaggattactagaggccagtgggaggccagccagttcagggacaggcctcgcagcccaggaaggattccagtgtgaacgtccctgggaatgaataaggagcctccatgtgtcactggcatcaggttgcttttcccctcctgggggtttccatggcaaccagacagtgtctgaggtcccggagccgggtgaaggagacccattgtgaagagggacagcggaaggtgaggggggctgaccttttgaaaataataattaccacagtgaagcaggaatgttctgagaagaaacctgaggaggctctgccctctctccaggtcagcagccctccccagggactctgccatctagagtgggttgtaattttcaggaaaaaatgaaagtaaaagcacaagccattttgtggggagggggcttgccagaggcgcccgctaaggggaattgggctgtattgagagcagggaggggcagagtccccatgtgcttttgccttggctttctggcttactgagaacagactggggccggagccagggtgtcactgttcacccgtcagccagatgggagtgaggtggtgctctgagctgggatgttcagagacttagaagggacctcagctcctcaataaaatagaaaaacaggaggtgggggagagagcggtgtccgtccatcatcccacggtgccaggatggcagggtccccagcccacgcttttctgatggtgtcgatggaacagcaggttgcccattgctgtagtatgtagctgtgccgtggcatgtggaggctcactgtgtagagatgaggtaagcagtagaggaggcaggcgtgggaagtcatcaagtcatcagctcggtcaggcagggagaaaaacggcagcgtgaactgtgtgtgaacgcacatgttcatgtgcagggttgggtgcatgtgcataatttagtgctgtgcttgcagctggccctgagctattgcccacccactagaggtctgtgtcccctctcttcttcttcatttcatcctccctgtctcttcccagggtgaagccggccccactggtgcccgtggtcctgaaggtgctcaaggtcctcgcggtgaacctggtactcctgggtcccctgggcctgctggtgcctccgtaagtgcagcttctctttggcctgggggggtctggggtctgtggctttggaactcttgactctgtactttgctctgacagttgtgggctccaaccaccaaaccttcattctggcccaatgcctgtccccacctctagatgtattcccttctatcccatcttccccttgaaacacatagtgggaatgtccctgaaatggacagcacctatgccaggtccctggatctggatcctggagggctggaggtggttggggttcattctttgctgcttatttgacaatgtctcccttttcagggtaaccctggaacagatggaattcctggagccaaaggatctgctgtgagtgttgcccgtggactttgctaccccaggagagcccagtcctgcctctcccctctcctgacacccctcccttcttctcatgcccacagggtgctcctggcattgctggtgctcctggcttccctgggccacggggccctcctggccctcaaggtgcaactggtcctctgggcccgaaaggtcagacggtaagagcccaaagtgacccccaagttccactgacatctctggagtcaaaccccatcacccctctttcccatgctctcctgccctggcctcacagcggcctccatccgagggcatcttgaacaggggttctggggaggggcaggctccctggagagaatctggtgtgaggacctgcctctcttttcaagggtgaacctggtattgctggcttcaaaggtgaacaaggccccaagggagaacctgtgagtatctgcccccaagcccttgtcttctctgctgctgttctatgaggcacaggcctcagccccactgacccaccacctccctcctccagggctctatcccccaatctgggtcctttcagattatgcctggaggagacttaacagggctgagaaggcccagatacagcttcagctcccatccttggtttggctagtgtgaacagttggatctttagcccctctcacttccctctgccctgccatggctcgtcctttatggcctctcgtcctcaagcccccccccagccctgaaacagttgccaaggctacttccttcatactctgagtcgaggcttgctccaaggccaggtgaaggctcactctgtttctcttttttgctggtcctcagggccctgctggcccccagggagcccctggacccgctggtgaagaaggcaagagaggtgcccgtggagagcctggtggcgttgggcccatcggtccccctggagaaagagttaagtgaatgtggaggctccatcccatggggcctgtgacctcgagagggaagtggagtccttgtggtccgtgttctggtcaagtctcgtgacttttccgcatgtcatcctcctctttctccatccacaccgcggggagagggagtctgatcctgatttgtgccgccaaccaccagactgacatgaaatagtctgagctccttcccaggaagcggggcaggctccagaagttaacctctgagaatcctgcaggccacagctactgctccccagaaattggggttggtgggttagtgggatggacccactggagcctggctgggttggggctgttctcactcactgcctctcctccctgtggctccttagggtgctcccggcaaccgcggtttcccaggtcaagatggtctggcaggtcccaaggtgagtgggagaagaggggctggggtccctccctgcatcgctgaggtcacatggtatcccactgactccctgtgtacccttgtagggagcccctggagagcgagggcccagtggtcttgctggccccaagggagccaacggtgaccctggccgtcctggagaacctggccttcctggagcccgggtaagtagcagagctgctgttgcccttggcttcagaccctcaggcccttcctggctggctccttccagccctgcactgccaggattgggaggtcctggggccggctcctgaccccaccctcttctctctcctgaacaaagggtctcactggccgccctggtgatgctggtcctcaaggcaaagttggcccttctgtaagtctatcctctgagggctgctaggagggtggggggatctccctggggaagcaagggaaaagagagatggagtttgggttagggaggcctgaagtactgtgaattttgagaattgtgacagggggtagatggtaggcactggggccagatgtaacctgtgcagtagctgtgagcactgaaaatgccaccccagtatgcattcggggcttatccttgggggaatgatgacatcgtgtgtgcactttctggggcagctttctaagctcagcggtgtcttgttgtagatgggcccatgggtgtgatgtggtcaatcctagatgctgagcatgtgtggctggtgcctagtcctgggcctgccatgtaggcccttagtggatgttgggtggatggatgtggtcagagtgtctatgttctgagaatggtgttctgtctttcagggagcccctggtgaagatggtcgtcctggacctccaggtcctcagggggctcgtgggcagcctggtgtcatgggtttccctggccccaaaggtgccaacgtaagtaataatttgctcttctatttccttccatgtggtgctacctacctccctgccctcttggggaaagggctgggtcctgagtagagtttaaccagggacagtgatgagtggggctcctgtgccatgggtggcagtgggggtctgtatgtgatttggggaaaatccatggccccacagagcctcggggcattgcggccataattgttccatgtggcagtgcccagcaggctggttgccattatggcccctgaacagaagagaagggctgatactttgctttatcttggctgtccatcaggatgtggccccaggcctcagtccctgcagcccgctctgcccccaactccctcccaaaccatccgcctcatggccctgccctctctttccttcagggtgagcctggcaaagctggtgagaagggactgcctggtgctcctggtctgagggtaagtatccttccccgctgcccatgacttggtgttggccgggcatctgcagggaggacaggggaacggcctccccatggcatggtcccgggacccctcagtattgagtgttgatctctgtggctgagccccatgctggctgggccctttgggtgtctacacagggagacttctgtttgccattggtcagcaggccggggagctggggaaggcttccatgctgagaacagctaagaaaagacggggcctgggaaggaagggaggggaaggtgtggaaatggagctcagctggggtaccgtggaggtctggaaactctgggccagaagtacctttgcccaatcctagggggactgcaagtgggaagaaaagcgtgtcattgacttttctttttctcttctgtctagggtcttcctggcaaagatggtgagacaggtgctgcaggaccccctggccctgctgtaagtacctgcccagcctccccaggtggccctgggggcaggggctgggaggggtgggggtgggagagcccatccattaatggagctgacagatgtgaatgtgggctgagctgatacaccagactcactctgagctgaggcagggtgtcccaggaggctgtgtggacccacattggtggagaggagtgtgggtggctgatgggagtgcagggaggcatgcatgcactgtctgagtggtgcaggaagacgcctgtgctgcccaccctgctgacctcccctgggccctactagctgtggctctcagggtctctggaacactggctcagctcaccttttcttttccactgcagggacctgctggtgaacgaggcgagcagggtgctcctgggccatctgggttccaggtaggtggctggaccaggctctctgtgcagtcctttgccatacccagggctccctgggacagcagcaggcactatcggtggagggcccacacctcttgcagggtgccaggcatcgagccttccctgcacccctggctgtcactgctgctgcttcctttctttgggtctgccctatactgtgcctccctgggggccagggcagcaaactcactcctttgctaacgcttgtcacttcggcttctagggacttcctggccctcctggtcccccaggtgaaggtggaaaaccaggtgaccaggtgagtatggggctctttggacctgcaacctgtttagatgggaaggtcttttctgatgcctaggaggcaagggcaagagggcatgaggagccctgtgaggcctgggaatgtcctggacccatgtcccagcctccacagatgacacaatcccccatgggaggagtgatattcagccctgctgtggagaattgttcaggggtctgtgatatgaagccttcactctcacacatctttctttgttctccagggtgttcccggtgaagctggagcccctggcctcgtgggtcccagggtgagtatcctgttggccaatgcgggctgcctccttgggcctgccctgggtcctatgctcctgctcctttccccacctccctgcttctccctggaccttctcccccactgctgttggttgatcacttcttggtgtctctgccgcagggtgaacgaggtttcccaggtgaacgtggctctcccggtgcccagggcctccagggtccccgtggcctccccggcactcctggcactgatggtcccaaagtaagtgaggctgcatcctgtaggggtcttcgtggtagcctgggagtcccactgagcagggagaagaggagcgggctcaggaggaatgaagaacagaagtggggggagctggaaaggaggtctacatgggaggaagggaaggaagaggggtttggggccctggttacccaggctccatgaacatgggttcagggagaggtgctgtccactacagactccctcttacctccctccccagggtgcatctggcccagcaggcccccctggggctcagggccctccaggtcttcagggaatgcctggcgagaggggagcagctggtatcgctgggcccaaaggcgacagggtaagtactgaggttacagcctctcaccaaagctgtggctttgccacattcctgccccttgtgatcgcttccgttcccttatggcacctggtgatgaaggtttctgttagccctttttgaggagcttaaagactcctttccaaagctccctgccttttagtgacatcctttcccctgttccttcatctcacccctgctgctcctcacccaccctgagaccacagcaaattcctcttgggcagggactgggctttccctagcaccccagcctgggtgggactgagcaaaccatgggggtcctggggtgcctggctgaggcggctggttttctcttccctcagggtgacgttggtgagaaaggccctgagggagcccctggaaaggatggtggacgagtaagtgaatgcgggctgctggactgctgggcattaggatcctagccctgcacccaggagagcaggagagagggctgggcagtctgccactggggtccctggtcctgtctctgtcggggctgggcaactgcagggacttctctgttaaaatggggccagagggtaagtgggagctctggaggcggtgggagcacgcaccaaggttggcttggtgccgggccgcacgtgctcggctggctcagcctgcctccctcacctctacctgctctccccgcagggcctgacaggtcccattggcccccctggcccagctggtgctaatggcgagaaggtgagtcccggctcctttcctctccacaccttgcctccctgtcacacctccttcttatctcctgccaaaggcggttctgtcttgtcctccctcaccactgtcaccctcggccaaggccgtaggagtgaagagggggccctctcagaagtgaagccgctggcagtgttccctgttgggtggggcaactgggctggggtaaacacacattcagcagaggccctcgagagggtgcgggtatgggctgcacagtaacacaggctgtgccagggggacctggagcccccttcccacgagcaaggccccccaaatgcactttgccctctcccactctgcctccccaccttcttaccccagctcttcctcccttccccaccctcagggagaagttggacctcctggtcctgcaggaagtgctggtgctcgtggcgctccggtgagtgtctgcccctctgagcctggctctgcccgaggcccctgggaaccagagagccagggagtcagtgcaggccctcatgctgcctggtggccctgtgtgctgccaggcactggctccctccctacccgctgggtctagggtgggaggagagatgggaagggaagggggaaggcacgtcactcccatcatgtgttcagggtgagggcttttgggttaacagagcctctgcctgcgttcaggactaaggctgctttcagatccccgtctctggggaacaggaggctgggcagggcccaaggggctcttggaggggagcagaagcaggtcaggcagcggggcctgacctctcgccatgcccccttctctcacagggtgaacgtggagagactgggccccccggaccagcgggatttgctgggcctcctgtgagtatctctgtccatcctcctgggtccctccactcaggccagttccacatccagcaccctcgggcatcggagcttgtcagggagggaaatggatgctcctctcctctcctttcccgcctccatactaatagaaccatcatgtccagaccaggacacacacgcagatactcacagagtctcctgctcttctggaagagctccagggttttagcctgcccctcattcacctgcttcctccttcccattatagggtgctgatggccagcctggggccaagggtgagcaaggagaggccggccagaaaggcgatgctggtgcccctggtcctcagggcccctctggagcacctgggcctcaggtgggtaacgctgcactccaagaattgttccctcaaggaagggctcctggcgtgcagatgggaaggccccagcaggctgcgcagaggatggttcgcaggcctgggaacacccccatgttggtagaaggagcttccatgtggcatgtgggctgtgtgggtggggtgtagggactgacagagtacaggctggccacagccagccagaaccaagctgctgatctcctggggaggagggggcggtggcaggaagagcttcccgggaggccagaccccagaccggttctgtggttgcctgacaggcttctcctagaacacaagtctcctgtggcagaggggacagagctgcctgtggcagcctcttcaggctgggtttttagtgccaagaaagctgcatcttcgaaaacctcaggggtccattgttggggctcagacagaagcccaccgtcttccttgggccactgggcctcactgtctccctctttcctttccagggtcctactggagtgactggtcctaaaggagcccgaggtgcccaaggccccccggtgagtgaggcctctgacaccccaccctgcacctcacaaagaggcctggccccagaggctcccatggcgggggtgttctgggatgcccccgactgttttcccagccctgcgttggtccccagcctaagcccacccacagccaggtgggagagagggcgcctgtgggctgggtgcactgtggtcccggattccccagcccgaggcttgtccctcgttcagctccctgaagtgctgactgtggaaaccggaggcagggaaacagcctgtgcctgcttctatgaccagacccgggggccctttctccctccctggatcccccttgctgctttgcagtccctcgccctttccataccaggctctgagaccacccccgccccccgcccattttaatctcaaacctcctgagggcttgaggttctcaggggctctcctctccccacacagggagccactggattccctggagctgctggccgcgttggacccccaggctccaatgtaagtgatgctcctggcatgagaggcacaggcaggcatggaatagcctggcccagcacccaacagggtctggagagctccaggctggccttcactcctctgagtccgttcctgccccctggaggagtagctaactgatcatggggacctatcccctgagggtggctgggggcagggttgtggccctgctgtcagcaatgggtggctgccctgctggcttggtgggcaggacagggctgccatgattaccttcatcctggacagatgtttcttgagcatgttctgtgcacttgtctgtgtgctttaaagcaagtccgcatgtcctgggtcgctctcagggagtttgcatggagggagcagtggtgatgaactcactgggttcaccagcgccataggcagagggagagagtgctgggggcaagctcaggggtcagaggggcagggctggagcggctcctgaggaagggggattgaggacaaagggaggagggaggagagattccaggtagatgggagaaagcaaagcaagcaggagctggagaagttggggctgtctgcccagagctgtctcacatggtgagaaggttgcagcggtagattggggttgggggggttaagctgcctgcccttagtgtggggaggtagagaagcccccagagaggaaactgctgtcactgaggccacagtgactttggcagcctggatgaggaagggtgagatgagtcctcacttcccgcattttctccttctagggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctgtaagtccctcaccaggcccatgccaaggtccctgggagcagggtcgtgagtggcttctgagctcacagagcatggggtaggagggagcaggggccgtggggatgccagggagcggggctgcacagacagagctgtgctgagaggacagaagaggctgggccactgtcagttctcatctcctgcctctcctctctcagggtgccgaaggtccaccaggtccccagggtctggctggtcagagaggcatcgtcggtctgcctgggcaacgtggtgagagaggattccctggcttgcctggcccgtcggtgagtgtggggtatccctccctccatccaagctgggccctgcctgccaaggcttctacctccctcagcaccctcaggactgtcccttgtctgccctctccctgaagggtcagtgggccctgggcaggggtgcttaccacttgcactcatcatccttgtctctgtccctccagggtgagcccggcaagcagggtgctcctggagcatctggagacagaggtcctcctggccccgtgggtcctcctggcctgacgggtcctgcaggtgaacctggacgagaggtgagcagtgagaccccctggggtggccctgattggggagaggggccctgtgagtctctgtgctgggtcagcaaggacaagtcccagtcagggccctggagaagggggtggcagtgtcggccgacaggcctgaaagcctaggtacaatgggaaggttgtcggggagagagacgggcatagagaccaagggctgcttccggaaggaggagggaaacttggtgaggaaactttggcttcaaagtgtgagtgagttgggcagaagaggagaggcctgggcttctgagaggggctgggggagcagagggggagatgggcaggaagcagctctaagtgcattcttgtttcactttgtccagggaagccccggtgctgatggcccccctggcagagatggcgctgctggagtcaaggtgagtgtctggtgtctgtgtgtgcagtgggttggggaggacattgcctcgggcctgacaggtcagctgggggtggcaggttggaacaagtctcatctcagcctagaaggaccttctgttcctgtctcttctggaacattcttctctgagcctgagacctctctcctgacagggtgatcgtggtgagactggtgctgtgggagctcctggagcccctgggccccctggctcccctggccccgctggtccaactggcaagcaaggagacagaggagaagctgtaagtatcctgaattcagtaaaagccgccttcccctgcgcggtggggctgaggcagtccctgggtttccgcagtctctggactaaggagcagtggcctcagatgcagaggaggcccccacctgtcctggcttttctctgacgctgcgctcactctctcctcagggtgcacaaggccccatgggaccctcaggaccagctggagcccggggaatccaggtgagtatccaagtgtcctgcactgagtccccaccagggataggctgggagggcagccagcctccaggtggttcctgggcctccagccctgtgtttccggggattcctcagcttgggtgggacaggagggggctcctgtcctggccctgacctgactcaatcggtgtctgtcttgttcccagggtcctcaaggccccagaggtgacaaaggagaggctggagagcctggcgagagaggcctgaagggacaccgtggcttcactggtctgcagggtctgcccggccctcctgtgagtgtcactgcctgcgtgggacttcccgaggcctcctgccacacagagcccacttgagctccctgtgctgccaggacagcttgggatcaccctaagcagtttctaggatttcctcagggctggagggaggaggaagtggaaagggaatggggctgggacataaagctgttcccccagctcccagaatatagatagatatgtctgtgctgaccgtggccttttgcctcttccttctacacagggtccttctggagaccaaggtgcttctggtcctgctggtccttctggccctagagtaagtgacatggagttggaagatggagggggcccttcagagagtgtgggcctgtgttcccatggggagggaaatgctgctgcttctggggaagctgtgggctcaggggtcctcactcagtaatgggggcaggactggctcatgtgcctatggccagaaaagcgcctgaggccacaatggctgtaagacaaacatgaatcagcctctcgctgtcagacagaacagcattttacaaagaggagcttaggagggtaggcaagccatggagctatcctgctggttcttggccaaatagagaccaacttagggttccatgactgagcatgtgaagaactgggggcggagtggctggtgctatcaggacagccacctacccagccccagcgactccccagccttccctgtggtgaccactctttcctcacgacctctctctcttgcagggtcctcctggccccgtcggtccctctggcaaagatggtgctaatggaatccctggccccattgggcctcctggtccccgtggacgatcaggcgaaaccggccctgctgtaagtgtcctgactccttccctgctgtcgaggtgtccctaccatccgggaggcttgagctcttttttgctcagggcctcttttagggcatcagcctgcagctaacagtgatggcatcctttatcctgaggtctcctcagaggtcacagggcccatgatcagtgctgggaaactgaagagaagggctaaggaagaaatagacatggtgctgtggtttccttggtcctcgcctgctacacctccgccccacccatggggctgggaagagggacactctagtacattctagcaaatggggatggacatggaggggcactttcacacaatcctggctgatctctctgtttcctgctgcagggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggtaagcttggagaacaggatcccctgccccgggaagcagggagtcatcccttaggcctagcagcaagggaggagatgccccctagtacagggcagagctgggcctggaagtttccgccagagggttcctctcttatttcacagcagagaagctgcagccctggcccctgtcctgccatggctacctggccgaggtgacctcagggtggactccatccaccagctgggcactgcttctgctctctttgcatgtgttcttccttagggctggacttagctcatgcagatctccctgcccctgcatcctcccaggtccccctcctttcaggccacatgtgaacctcatcccttgtccctgtaggcctctctgtctctttcagtcaggcctgggtctctcaagcttttgtgtctgtgcctgtctgagcccccatgggtgctgcctcttccccctgcaggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatgtgagtacctgggtgccctagatgatgagcagagatggctcctcaaactctttcttttctttctccctggaagcttttagcaccttccccatattttcctccagttttctgttgggcttgagaggagggaaagaggaggaaaagtattttttccccacgtggaggtgggaaaagaggtcctctgagcttgctccactcctggaagcaaaaatgtccaactagctccctgctgccccagtacccttgaggtccttgaaccatgaactcttggcagcccctacagcccctggtcccattgaatgccagctcccaggcctcacactgccgctctctgccccaacagttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacggtgagtggggctgccagagagaagagctgcctgtgcccaaaccgcctggagcagggctgagggttggcccgcggcagctgtcaggtcctaaagtgacaggatcatcagaggcatgagtttgagggtcatgtagagaagataggctgagtgacaggtgagagagaggcacatatcattccatcttctccattcccctggctcaggggaacaaaaccctacctggaacccagtgactactgtagaagtgttctcgcaatgtgtacagggtgaagaagcggtcacaggttgggagctcactgtggggagtggggaaggaggggaagggcagggtggagaagggccctgccgctaaggataggagttgaagtggagaggcctttggcaagccaagaagaggtctcaggagccccctcagtgtggttcaaccttgtgggctctgatgctcgccagtttgttcagttttgggcttctgggcagctggaactgggtagcaaggcatctactgaacagagcctcctccttttttctcccctagaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtacatattgacttgtggtttgttctttagtttgttttccattaatcctccgttctgtaggcatgcccaaatagcagtcctaaggacttcttctgttgatttttcaaccgagagtaaggacactgaagccacaccgccagggttagcagcctcacacaaacatgaacttgcctctctggtaaaccttggcactatgtggaac

SEQ ID NO: 17 - DNA, 16153 bp, Homo sapiens
ccctaggtttagcttctctcctcctgatggcgcacctggtcccccttgctgctctcccagcctccctggcacagagaggcgccctggggccaaggcagtttccctgggaatgctcattcatgcatgaagtttttctctgttgcaccctggacccagactcctcgatccacccagggtggtgtctgtggggagggggttcatttccccaggaagcacagccacgccgtccctcactggcctcgtcaagcagagctgtgtgtccagtggcttttgctggggccccctccttatctccttccaaggtgggggtgtttggaggtggaggaggctttcatattccgtgccatgacccctcaaggcgggccattcgtgtgcaccctccacccccagtgccaggcagaagcccatcctcacccaggaacagggcagcctgtccaacagaagggtctcggcctctccatcagcaccgggaagccctttctaggcaaacttctcaccacttcttccctcccttatactttgaaagagggagctctaggcaggggaggggctagagggggaagccgctgcccagatcctgacaaggtgacctgaaggaacccggggagggggatgggacagggctcaggcttggggtgtatggggaggggggctttgcttttaaaagaggtcatctcagcaatatctttttgtttttccccaggggccgaagagtcaccaccgagcttgtgtgggaggaggtggattccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcagccccaactgcgaggcagagaggtgagtgtctcaggcaccctgaggcctggcagagagggccacaggctctgcgcgggagtcttcgaactgggatctcccccttctgcaagcagctttggctcagagaggctggcgtggattcagtcacacagctgggatctggagttccgtggttggctccaggtgcttccgtctaggggccagagcaggtgtgggcagagcaggttccccgcagtctccacggcaccgaggtcctggcaggggagctcctgggagacgaaagagggcaaagaaggggagaggggcagggagagagcgggcagccaaaggggagaagatggggggcagaaagtgggtagagagggaaaaagggaaaatatcattggggaagaacctaaaaacccaaggaaagctgggctctgctgggggctgtgagacccccgggttctccccgccccaggctgctggccatggggtcttgcaccaatggcctgacctttctgtcggtctgtatttatcaaagtgggtgacagtctcaggcctcctggctgttcagaattgaggtaataaccagaggccttctgagcaaagggcctaaggggctccggcgtcaggatcccattgtggtcaggagcctgcggggcttcccgtgtgcaagaggggtgaaaggtggctagaaaggcccagccagtggcctctgcctcagccagagggagctctgtagtgggggcagcacccattcactggtcaggcactggggtgacaggggaggctccaggacttggggagcgttggagctggaggcacatggattggagtccctgtacctgccccacgacagggcctgcagggagggatccagcaggtgactcttcaggctgatttgcccatcccagatagaagccgggagtgttctttcaaaggtgtctttaccttagacactcaataaaatggtaacacagtggcgccgcctcagtcctttggagtgtgcaccgtctgaacccctctcccagggccctctcccaagcaccccaacctggacccatatcccccacgtacttttggctttgggcagattgagcagccttggggtggtctgtgctgtctggtgtggagggttgcagttcgggtccttagtcctacttcccaggccggccgggctgacgccagcgagtgtgtccttccccagcgaggggagtgagcgcaaggtcagcgcctcgtctgcggcgccctgcagggggtgacggaggggcgctctgaggacccttggagaaaggagctgggtttgtaaaatgctgggcttggtcccacggacggcggagcggtgagctcagagccagagctggggaggaaatgggaatgagaaaggcccacttcagggctggtgagcgaggggatggggagcagccacaggccgaggctggggcatgggccaggctccatggggtgagtctgagtccttgaggggatgttcatcctctgtggaatgtgggtttgccagtggagaggagaccagcgttgccctggtgaggtgctggttcagggctggggggcggacgctgcttggggctaaagttcctgccggccaagctctgggtgggaggagaccctggccccctcccaacacccttggactgctggcgggacccttcctacctccgggggctggaagtagtgggggaggagccagtcttgaggaagaaccccgatgctggtcttgactagaggggagccggtgtgcttttcgagcctcagggtgacccgcgtctgccccagcctccagcctgccctggtcacttctgactaaataaggagagcactcagcaggcagccccacgagggagggggaacatgtgtgcacccccactcccccacctgctcctccctccctacagggccactacaccctgctgtgggcaccccaaggtgaccctcagccttcttcctaccttaaaaagtccaggcatgcattttcaagcatgagcggtggccccctgggggaaggcacctcggcagggcagaacaaagggaagggacccccaaacaggtcactggtgtaattgtccccagcacccccaaagaggaggagaacccacaactcggaactggggctcacccccgatgcccaacctgtccccagcctgggaagcaggcgtggaggagaaggtggggggagcctagagctggccctgggggccctggttttgtccatgacgggagcctcggcaacctagtccgctctcccggggaccaggtttgcagacaggcacctttcaaatgctcctcacccccaaatttacaagtcaccctgcagaggaaaacatcaacacagccaggggttctctgctggaggctcccccttctataggcacagccggagaggccagagagctggggacacggggaggctgcagaaggctggtgggaaggggggcagtgatgggtggggagagatgggccagatgttcttggaatgggacatgggggtgattgatgcagacagaaatttgaaggggacattcccacgtgtcttgttctgtgggtggaaaatgggctgtttttcatggtgggggcgggttctccctgtcttgccaagctaatgtgaaagagatgcctcatcctgcccagctccccacacctgtccaaggccattaacttctgcctccccagtgtcaggctttgagatgccccccttctagccggggtcctcctatggggtgacaatggggacaagcaatgcccactgtagttgccccaggatcccccaccattctgctggtccccagcggtgccccctctctggcagtacccccacccaccccacaggtccccttagggccactgccccatcgcccgacattgcccaacgccaaggggtgaccttgttcctgccgacagggccgttgggcgcctgcatgcgggtttaatatttgcctataaggaactgggctttccccagccggagtggacagactttccctgaaaattcgcttggagagaacgaaaagagacccctggcaccccagcggcgtgcagccctgcacccccctcctcccgggccccgtgtttctcattttcctccccacttcctctgctcttcagtgttacccaaacaaaactggtttcacccttgtttggtgctggcgaaggcccgaacggcgcgcgcaaagctccggggcaggccggaggtggccaccgggggtgctccgggcccccaagccaagccggggactagcctgcccccggtggcggctcggccgcggcttcgcctaggctcgcagcgcggaggcgagtggggcgcagtggcgagggggagcctgcggacctcccacgcggggaccgagcaggtatctgggagtcccgggagcgcccgggaagcagcgtcctggtcgctccctcgcggcccttgggtttcttccttacacccggacgcccgctaagctcgggctgccgccacaaacgcgctctccgtgtggagaaggcaaagaaaaaaaaaaataaaagcaaaaggaagaaaaaccccaaagaacgaaaagcagaatttcagccggccgtgcgcgccagggcgctccgcgctacctgcccgcgccgcccgcgctcgggttcccggggagggcgccagtgctccgcgcgcgccccagccaaggtgaatccccggcagcgccttccttccgctgcccgggaagcttgagctcaacaattagcccttgatcctcgggggattccaatccacggaacaacttccctgctttccccgaactcggacattttactttttctgggatcctctaaatttaagcattgcttcccaagtcttctaaatatactcaccatttcgacgggtcacaataattttcttggacgttaatttccggggacgtcaaaacacatcagtcccggcgggcttttccagacttacactatgtggcctggggccccagatgtgctttctcccaggctctggacagttttatacaccccctccaggtcccacagatttacaggccactaacccggcttccctaattttaaagacgaagcccttggtccgtggtggtcgcgctgaccaatttgcctggctccccaggatgtggacagtgccttttccacatttaggcattgtttccaaaacaagtggaactttcccgcataattttgaatattaactccagggtctcctaagcttactgtttccggcacacgtccgccccattccgcgcccccccaccccacccccgcgccccttcccgttcacctcagcatgggacatttgctgttgggtcccgcaaatctattcacactaacctgggttccctaaactttacacgttgaatcccaagtccctcatgacactcagcagggctggaaggttggaaccctcagagtatgaaaattgcttcccataccttcccccaaattcggtcattacacccagagcatgttgaatccttttctgaatcataaacgacctgccctctgattgcctgagtttcataaaatggagggatttccccagtgattccccaaagctattgagaatgttgtgggtgtgtgagtcacaaagctttggggcattaacgtctatggctctatatgctgcctggccacgaatcaggtcccttaagatgtagacagtgccacccaggtccctggagcacactgagcagttaccaggaggtgctcaagtgtgacccaggattctccaggtccccccaaatcacacagggtctcccgggtccctctgggctacaccaagcacaaaaggaccccttgggcagagcctacttttatttctgttatgccaggtgttgctaacggccccagttcccaaacattccgagcactttctctgcatcacaacatattgactattaaacaattctctgggtcccaggagcttcataacaagaatcttgcttttctaaaattcaggcattggtctgaaaccccaacggccaggatcacactggacccttttcctggtcccccatacttggatgttctggacgctgccctccaggccctctaggaacattcagcattgccctcggatcacaggacagcactgatttcttgggctccaaacaacccactgagtcatctcaaagttaagcaatatttccttcaagcacactgcacactccctatcacaaaatctgaaaattcctaagtcctaagacctaggaattctgaatcccctttctttaaaatgtacatatggacccccaagtcctccaaggactctgagcaacttccctagatctttagattcaaaaacgattttcctggagcccccaaattgcggtattgtctcccagccttccaaagcaaattgagatttttttcccttcacaaaacaattgaggtttttttttttttaatactgatttatgagtctcctgactttatggtccctgccctgggtccccctacatttagaaaatgttccatggacccccaaagcacactaaaaaatgtccctgggtcccaagaaatcccaggcatggaaaaacctgcgacctataagtttcctagctactaactaggtttccagaaatttagatatcaaatctccattgggtaatttccatgtgtcccaaaaacttgaaatgtgtttcactggggctcccccaaatgcagacgacatccaggaaaatatatagtctttttcttatttaccaaaaataagctaatggaaatcatttaaaaattagcatagaaaaataatactgattttttatttttttattttttattttgctttccccaaatgtactgatcacactccaggctcccccaaaatctagacagtgctttcttccatctctgaagggtgttaaaacctttccctgaagccacagtaattatgaaggttattttttccccggctgctgccagcgtccaggccactaacttatattcttaagatgtgaaaattaatctcagcttccccctaacacaccaagaatgtgtttggatccccaaaatgtgttccttgctttcatctgccaattttacgtaatatggctctacggcaaaattcccaatttcatatggagaattttctttaactacccctcctcacaaattggtcccccaagctagctggcccctatttgagacctctttctctatgttcccaattgcatggagcaacttctctcatcccccaaacctgtaatctatttttctggagtctcgagtttagtcattaatcacggttcccacattaacggagtccccggggtcccctcctccaggacacccattcgctaagcccgcaaggcagaaagaactctgccttgcgttccccaaaatttgggcattgttcccggctcgccggccacccactgcagcttccccaaccccgcgcacagcgggcactggtttcgggcctctctgtctcctacgaagtccccagagcaactcggatttgggaaatttctctctagcgttgcccaaacacacttgggtcggccgcgcgccctcaggacgtggacagggagggcttccccgtgtccaggaaagcgaccgggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgcccgcggacgcagcctccagcttcgcggtgagctccccgccgcgccgatcccctccgcctctgcgcccctgaccggctctcggcccgcatctgctgctgtcccgccggtgctggcgctcgtctccggctgccgccggggaggccggcgtggggcgcgggacacggctgcggacttgcggctggcggctgcgctcgctcctgctgggcgccccgaaatccgcgccactttcgtttgctcattgcaaagatctcatttgtggggaaagcggctggagggtcccaaagtggggcgggcagggggctggggcgagggacgcggaggagaggcgctcccgccgggcggtaaagtgcctctagcccgcgggcctaggactccgccgggaggcgcgcgcggagcgcgggcgaagtgattgatggcggagcgaggggggcgaggggggccaggggggcgcgagattccgccggcggccccttccccttggctaggcttaggcggcggggggctggcggggtgcgggattttgtgcgtggtttttgacttggtaaaaatcacagtgctttcttacatcgttcaaactctccaggagatggtttccccagacccccaaattatcgtggtggcccccgagaccgaactcgcgtctatgcaagtccaacgcactgaggacggggtaaccattatccagatattttgggtgggccgcaaaggcgagctacttagacgcaccccggtgagctcggccatgcaggtaggatttgagctgtgtttcccgccctgatcctctctcctctggcggccggagcctccgtaggctccaagcctggcccagattcggcccggcgcagccggccttccgcgcgtcccgcacctggcgggggctccggggctccggcgcggcaccggggggcgctcgggatctggctgaggctccaagcgccgcgtggccggctcctcctgctggggcaggtggcggctgcgcgccccgcccgagcccaggggccccctcagccgcaacaaccagcaaggaccccccgactcagccccaagccacctgcatctgcactcagacggggcgcacccgcagtgcagcctcctggtggggcgctgggagcccgcctgcccctgcctgcccggagaccccagctcacgagcacaggccgcccgggcaccccagaaacccgggatggggcccctgaattctctagaacgggcattcagcatggccttggcgctctgcggctccctgccccccacccagcctcgcccccgcgcaccccccagcccctgcgaccgccgccccccccccggggccccagggcccccagcccgcaccccccgccccgctcttggctcgggttgcgggggcgggccgggggcggggcgagggctccgcgggcgcccattggcgcgggcgcgaggccagcgaggcccgcgcgggccctgggccgcgggctggcgcgactataagagccgggcgtgggcgcccgcagttcgcctgctctccggcggagctgcgtgaggcccggccggccccggccccccccttccggccgcccccgcctcctggcccacgcctgcccgcgctctgcccaccagcgcctccatcgggcaaggcggccccgcgtcgacgccgcccgctgcctcgctgctgactcccgtcccgggcgccgtccgcggggtcgcgctccgccgggcctgcggattccccgccgcctcctcttcatctacctcaactccccccatccccgcttcgcccgaggaggcggttccccccgcaggcagtccggctcgcaggccgccggcgttgtcacccccccccgcgctccccctccagccctccccccggcgcgcagcctcgggccgctcccctttccgcgctgcgtcccggagcggccccggtgccgccaccgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccaggtaagcggcgtgtgcgggccgggccggggccggggctggggcggcgcgggcttgcgccggacgcccggcccttcctccgcccgctcccggcccggggcctgcggggctcggcggggcggctgagcccgggggggaggaggaggaggaggaggaggacggacggctgcgggtcccgttccctgcgcggagccccgcgctcaccctggcggcggagctgggggtggggtgggggcgtcgggaagggccgagggaggtgtgaggtgtctgcaggggcgacttcccggtcggtctgtgggtgcagggggtgccgcctcacatgtgtgattcgtgccttgcgggccctggcctccggggtgctgggtaacgaggaggggcgcggagccgcagaagcccaccctggtatgttgacgcggtgccagcgagaccgcgagaggaagacgggggtgggcggggccaggatggagaggggccgagttggcaggagtcatggcagacgccacattcgcgacatctcccccacaccccctctggctctgtccgcaacatttccaaacaggagtcccgggagagggggagaggggctgctggtctgaggctaagaagggcagagccttcgacccggagagaggccgcggcccctgcccagtgggcagcgtggaagtttccatacaaggaggtgggaaggagacccccccccccttcactgccctgtgcagagatgagccgggggtgcaggatgggagcccatggcacttcgctacgggatggtccagggctcccggttgggggtgcaggagagaagagactggctgggaggagggagagggcgggagcaaaggcgcgggggagtggtcagcagggagaggggtggggggtagggtggagcccgggctgggaggagtcggctcacacataaaagctgaggcactgaccagcctgcaaactggacattagcttctcctgtgaaagagacttccagcttcctcctcctcctcttcctcctcctcctcctgccccagcgagccttctgctgagctgtaggtaaccagggctgtggagtgaggacccccgctgccatcccactccagcctgaggcagggcagcagggggcacggcccacgcctgggcctcgggccctgcagccgccagcccgctgcctctcggacagcacccccctcccctcttttcctctgcccctgcccccacctggtctctgctccctcacctgctccttccctttctgttccttcccttcggccccctccttgcccagctcaggacttttcctgggccctcacctgctccgcaccgctgcatgcttcctgtcctgctttctgccggtcccctgacccggacctccaagttcagagtggtggggcttgttgcggaagcgcggcgagggctagagtggccagctggcggagtgtgctcttagaatttggaagggggtggcagagggggcggtgagaggactggccagggtccagtcaaggagatgaccaaggaggctttcagatcctcggcgcagctgcccactagtctttagagagggcatgcaaagttgtgcttctgtcccactgcctgctcagtcgctcacataatttattgcatcaaaaactcccctgggtctgcggagcgaaggctggggctgcccgcctggagggttccaccttctgcaggggcagggccaacttgctgtggtggctcccggcctcccacccccgagtgggttaacccggccctgtggccctgcagcctgtggagggggtgtgtcctaagactggcctccccttccagattgtagtctggggaacctggtgtcggacttcccaggtggcctgagctggtctctccagctcccacggggagagtttggtagcgcaaatagggagatgttctggaggcccctggccttactggttcgatttgaggcctggaaaggaggctctgggcgtgtgtgtgtgtgtttgggggtacccaaggcagactggagttggagaactgggtgactgggaaaacaaggtttctagagcatgggtggcgtggttgtgttaaccattggagtccttgacccaggcctggctcagctgcagactggaaaggtggaaaagccagggggaggggcggggctggcccagcaggactggcctgctgctttgagggcgatggtcctcctggaccccccctgctcagctgggggttgtggggaggaagggactggtcctcctggatgcacatgctctgtaggggtggggctgtctgccatcttggctggcgctggaggcctgagaagtggcgatgtgacgctgggctggccctgcccccatggtgtcataggacggaggccaggtcgggtgtccagcctgggcccctgcagctgtggatgccgctgagctcctgcaataatgaccgtggagatggtcacccctcgtgtaaaattactagtgcttcttgcaaatggaaggaactgggccttttctgtgtgcttctggacgcttcattctgcacatggccctgcgccctcacctcggcattatgacctgtgtgttacttttgtaataaaaataatgtttataggaaagccgtgctttcaattttcaactgaatttgtaggttggcaaatttggtttgggaggggcacctctggcctggggcttggcctggctgccccgctcacgccacttctctcccgcccccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagtaagtagctgggaggggcttcctcagacctggtcaggcccctagagtgaccggtgaggacgcccaacctcaagccaggggagcacactcctaggtcagcagcccagccgcttgctctgagactttgaccttcccgccgcgtttctgagcacgtgcggtgtcccagggcatccacaccagctgcctttcccatcacacgcctccttcgaagggtgggccagaggtgccccctagacgtcaggggcactcacaggggtctccctgggcatcagaatttctgttgggggccgtgaggctcctgctcctgaggcaccgcacgcctagtgcagggcttcaggctctggaggaagagcctgcctttcttcctgcaccttttggacattctgacaagggacgtgcgttcggtgaatgatcagaattaaaatcaataaagtgatttatataattaaaatcaataagacaagtgcagttggtgggtggcaggggtgagcggtgcatgcgcctccttgggccccaaggctgccgtggggggtgcccacctgctgacctcaaggacgcttcagcctttcctcatgtttctctcttggttctccagcctgggggctggcaggtgggtgcatggcccattgtccttgagaccccacccccagataggggggctgggtggatgcagaggcaggcatggtgcctgggcatgcctgatggggcaggggaggggccgctccttactggcagaggccgcacggcttattccacctgacactcaccacgtgacatctttaccaccactgcttactcacgctgtgaaatgggctcacaggatgcaaatgcacttcaaagcttctctctgaaaagttcctgctgcttgactctggaagcccctgcccgccctggcctctcctgtgccctctctcttgcctgccccatttgggggtaggaagtggcactgcagggcctggtgccagccagtccttgcccagggagaagcttccctgcaccaggctttcctgagaggaggggagggccaagcccccacttgggggacccccgtgatggggctcctgctccctcctccggctgatggcacctgccctttggcaccccaaggtggagcccccagcgaccttccccttccagctgagcattgctgtgggggagagggggaagacgggaggaaagaagggagtggttccatcacgcctcctcactcctctcctcccgtcttctcctctcctgcccttgtctccctgtctcagcagctccaggggtggtgtgggcccctccagcctcctaggtggtgccaggccagagtccaagctcagggacagcagtccctcctgtgggggcccctgaactgggctcacatcccacacattttccaaaccactcccattgtgagcctttggtcctggtggtgtccctctggttgtgggaccaagagcttgtgcccatttttcatctgaggaaggaggcagcagaggccacgggctggtctgggtcccactcacctcccctctcacctctcttcttcctgggacgcctctgcctgccagctctcacttccctcccctgacccgcagggtggctgcgtccttccagggcctggcctgagggcaggggtggtttgctcccccttcagcctccgggggctggggtcagtgcggtgctaacacggctctctctgtgctgtgggacttccaggcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggtgagggtcctgggcccctttcccactctctagagacagagaaatagggcttcgggcgcccagcgtttcctgtggcctctgggacctcttggccagggacaaggacccgtgacttccttgcttgctgtgtggcccgggagcagctcagacgctggctccttctgtccctctgcccgtggacattagctcaagtcactgatcagtcacaggggtggcctgtcaggtcaggcgggcggctcaggcggaagagcgtggagagcaggcacctgctgaccagccccttcccctcccaggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctccct

SEQ ID NO: 18 - DNA, 81992 bp, Homo sapiens
gcaggaggattgcctgaggccagaaggtgaaggctgcagtgaaccgagattgtgccactgcactgtagcttgggtgacagagtgggaccctgtctcaaaaagaattggtttggaataacatttaaataatacctaaactccttgccttggcctacaagacctgaatatttggcccctgccttccctccagcccacagcaccggccccaggacctttgcacctgccatttctgctctccagaaagccctgcctcctccccatctttgtagtcataggtgtttcttgtcatttagagtttcagttcaaatatgacaccctcccattgatggaaatcatttcaccaccagacgttatgtggctcattgtttatccgctgcctgcctcccggctggagaggcgcagggagctgcctgtccctcctgttcagagccaccgttccgcacctggaccaccgcttggcagaggcgggagtggaggctgtcaccatcaggatgaaggacaggggtggcccggcgtggagaagctaagaagagatggcgataggtcaacgcgattgcgcctttaaggtggaagaaacgaagggcgagggtcagtaaagtcaaggacgggctcagatcccgccactggtgataagcgggacccataggaccgacgtgatcgcggccaggccctgggtggtttacctggacttttacctggctgccttttctctgcacccctccgtcctcactcccccagtcatcggcataggtcaagtcagagtgttgaagaaacacacgagtttggctctggaaaggaaaatcagaaaggcggcctaaggggccccacccccaggaacgctaagataggcggccaggggtgagcgggcagggccggccagcaggccctgaaagcagccgggccaccagcgcgtcccgagtccccctcgcaccgccccgcttgccccgcccctgccctctgcccccgcccctgccccgcccccgaaggcgagctgcgctgacagccggcggcgggctgggtgtttgcaatacaaaggcggccacgcgcggcgccgctcggtgagtagccgccgcctccagcctcccgctgtggagcaggggccgcagcctcgggttaggcggggcggggcgcggcgccggggcgctgaggacgcgtggcgaggcgggggctcggccccggggcccgaggaccgacggccgggctacgtccccggggccctctacgggaagtggttcgggggagggaggcggggaaacaggccccggaggccgggagggcctcgcgagcatccctcgggcctggctttcctgacgcgccgcgaggcccggtgtgggcccggcttggctgatctcgagcggcgtaggggccactgggggctgccgcgcagtcccagaaccgcggggactagctccagccggccagcgcgggtgcgtcctggctctgcgcgatcatccccagctttgcgccggggactgggatgagagcctttctttcccccggagttaggattccagcgctgcagttgaggaaactgaggctcagggaggttgacctctgtgcccaaggtcatacagttgccgggcggcagggcaggctgagcccaggttggaatcccggttctcatattacagctctcccctgcgaggcctctgcacctttcttgcagcctaggaggtgctaggcctagtgagctccgtcagctgctcctgcacgtaattttattatgggcaaggccaggaaaatgcaggatgagaagtaacgttttgggagtaacttaagtgctgtggagctagagtaggtaatttgtgtggtcagtagttgctggagaaagcagatgtcaaccctgtttttgatcagcaagcaggaaaccaactaagacaactggcagtattaatttggagatgttttagaacccggcagtttcccacaggatagaagtgttttgggaaatcaaagcttgtagccgtttttttaattgggggtgttgtggtatggtggtctaggggtagtgattgtgagattgactgtttatcctttgttccgtaatttgggtcttattaatgaaagtaagcagttgaggaatgtatagtatttgagaaataagcacatccacacatgaacacttttcttgctcccagattcttgttgaaaggtgtaacagttggatttatgattatatactttgatagcacttcacgtttgccagcatttgttattgagtgtttttgtgcatgggttgtgtgttttggcgcttattattcctatttgcatgtggggccctgtggtcctgtggagccaggcctggatatagccctggactcgggtcgggaggtctgggctctgcctgagctctgtgggaccctgagcgagttctttcacccacccaggtctcgcttatcagcagttcctttcttttagaaaagcacagggggacaaggggcggacctgctgagtcttgtggtgtgggagagaacgcgagggttcaggtgagagaccgcagggattcctggttgtaggggggaccttggaagtgactgagaaggagcctgccctggattaggtggggacaattggcctggcccagccagaaggaagtctgtgggtcctgctctcctgctctttgcgtggtcagctgcacaaagggcccagaacagacggcaggggagggtcaggagatgaaaagatatttcagaagaaggtcctgaggccaccgtggtctgagatgcgccgaggccggcacagagcactgggctttgcagttgttgttctgaccactcacagatgtagaacttgggcagaagacttcaatcctctgagcctcagttttcccatctgtaaaatgaagggataatcatacccattcacaggattgttgcaaaaattaattgagataaaaaagagcccctggaacataatatggggtccacgaatcattgtggttgttatgattttaaagtgccacagggtgccagcgaggaggggctctttgtggggttgggacagtcctggctgacgccggcctctgctctgtaaatcatccctgtgggacaccccctccccctgcctgccacctctcttccggttggcttttccggaccatctgtgtactgggttcaaggcctaaaaggtacctaaatgaggttaattgatttgggcaagcctgccaatgggggtagtcgaggggtacaggcagctttttccttagggtgggagggggctgttgcacggatgtcggcagcttttggagcattttgagagacatccaggtgttaggtcccgccaggacaccgaggctggtggttcgacctgtttgcacttgcacttcctcactggtagcccgggcgtgggatcttggagcttttgaggggtcctgaggaggaagtccctggaatcacccactagcagctttggggcttgttccttgagaagggcaaagtcacaattttgacactttattgaaccctggaccaatgtattgtataataagcccactcatttaaaactggaacggggtgtgtggggaaaaaagagttgggacaaaacccaagcaaagccgttcagtgacgtcacaggttcttcattcagaagaggcccaggtgcctatcggatggctgtttctgaaatgttcgctttctgagctgtgagggagggtctggagagagagaggggcccatgcctgtgtgtcgaggggacacacccacactggccctgctccttgatcagaggatgcaccagcgcctgaagggaatctgtgccccctaggaggccacactgggccctggggctgctggggtccgaagcaagtgccctgacctcccttcctgtgggttcccttcctcttcctctttccacagctttcccctgtctgtctccctacctgtaattcaccccaacaagcccttagcagctggggttggggtggggtctgtgcagccagggatatgttgagtagtgagtttctgcctgtagaaagctctgggtctgggctgacccagacccaggctgacacttttcacaatgaggtatgtggcccaggagtcttaaaacctcagcagtgtctggcccacaggctgttctgcacactgagggatgcagggcgcgttgtgccgctcccactcccagctgagaggttgggaggaaccagatggactgggctccatcaggagagaagccagaagcattttcacaccggtggtcatggctacagggtcatggttacagtggatttttcaacccactgaccaaatgttgtgattcttgcaacaacttaaaattttcggctgatgctgaatgctggggctttccagaaatagccataggctgttagaacaggcactttgctctgtaaggaggcctgtttgttcctgagtgtgagctgatttgcattggctcacaaagttgaccacagaccctgcatgggagacacaaccaacacccccatttgcctgctggcacgcacttgtgcccccctcccctccccggcctcgctccctggaagccctcgcacctctccccttgccctctgtcccctagccacacacactcactttttgatgaagtcgtcctccgcgttcatggatctcactaggctgtaggtcttcagtttacaagacaggagacaagcaacaagggttttaggataatgggcaccagacaagacaggcgcccagacaactgttctggcaaaacaatgtcccaccattggactctgtgcaatgccagaatgccaccagtctcggggtggcctctttgggctcagattttgggcaaatgagaatgtggaatgtaggcatagccttcaaatagttctgtattcattttaactagtaatattctttgcctctgtctttttgggaaggtactatttaaataggtgatatatacaaagtcccctctggcaagagacgttattcaaagaccggattttgtctggaaccagtttgtggtcacagaattagcacgtggtttttatttggtgcatgtgctttgaaaagtactttacatttactgcctcacaacagtcctatgaggtggctgtgctgatgtcatccctttttataaaatagatgcgaaactgcagtgcagagagcttagtaacctgtctttgatcacagagttagtggaaggtggaggcaggatttgaatacctccagagcctgcgctcttacctgctgagctatattgtctcctaatagtgccctggaacacccaggtgatatatgcccacctcccaattgctggggtgtggtaggggtggggggtaatacagaaataaagttataagggcagagcattctttttgaccaagacacgaatttggacagagggctcttgaaagtgcgtagagagaatgtgccattgggtctttgaaggaaaagaacgtcctgtccttaatcagtgagctaaataattaagagccaaaggatcggagtcaaagccttgggctgttttgctcagcatagttgtcataccatatttagatgtctacacccacctttatccaggccatttgtatttcttggcaggaacgtgagaacaagcgtcacctggggttgtggtatctgagggttgcaaagtgtcagcgctggaggagctgagtgatcactcatctgaccttccctccaaagcaggagtacccctgtccagcaccctgtcctgtctcagtggtttcagtgatggagaccctgagactgagtggaccagagttttccatccttcactcccagttctctgaggttactaataattgacatgaaatacatgcagacataaaaaacacaagctagaaagcaacactatgggaagtatttatgataaaaagtgaagatctcttcctccttttcccaggctggtccccaggggtgaatcttgtgaatcttgttttgtatgtatctcattccagaatttttttatgcatatcaaaatatgtacaaatgtaattttttaaaaatgggtccagctgggcgcggtggctcacgcctgtaatcccagcactttcggaggccgagatgggtggattacgaggtcaggagatcaagaccatcctggctaacatggtgaaaccccgtctctactaaaaatacaaaaaaattagccaggctggtggcaggcgcctgtagtcccagctactcgggaggctgaggcaggagattggcgtgaacctgggaggcggagcttgcagtgagccgagattgcgccactgccctccagcctgagtaacacagcgaaactccgtctcaaaacaaaacaaaacaaacaaacaaaaaaccacaatgggtccatattataagtatttttgtacctgttttcattctatatatacattttcatgttaatatttatggagctacctctctaccattttattatcagcctcataatattccattttacaatgtggatggcccataatttattaagccagagtcatacagatattaagttatttctgattttccctattacaattaatgctacagttactgtttttgtacacggatcttactgtatttgtacaatcagttcccagcggtatagttgctagggtttgccaataggtgccccaaaagatgggcattgccacattgcttaccccatttatgaccctgttagtagtgagtgacgatgtctgattctcctacttttcatgggccctggggttttaatgaaatgctttgattttggaccatctgaaaggcctctttcgattcctgtatctttaattatgaatggggttgaatatctctctcatatattattggccaaatgtgaactgtctatatgttttgtccattttttcttttgagctgttccaaggccattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctccaaggccattttaaactgaccttaatcttctagaggtggctggtgttggcaaaaattgtggggttaggaaagctgtggcaggggttttgaattttggcagttccaagaaagcagcgtttcttggcaatttgtgaagcctggagatggattctgccaattttggaataaatgtggaattttctaatttaatcgtgaggcaagaaaccatgtgacctctgtcacctcatcctgacagtgtccgcagtgctgtcctttctggaactgtatgaaattgcggtcgtgaatgctttggagcgtctgctgtgtgctggagttctacagatgagcttaattatgggaacgccctcctgtccctgggcaaggagggggatgagcagggtgggggtgtgctggaggaggagacgcctgccactttgccaccctggaagctcactgcaagagctgcaaaatttcccacctgcctaacacaggcagggctttggtggcgggaccccagggctggctgtttttgctctttcatcacttttgtcaggaagtattgaaagacctttaaaaggcctctgacttgcagggcctctgacctgcaggccttttaaagcatctccagcttttctagtgagtttttgtattttggacgggaatgtctcacgaaccctggcatgccaagaaagtccccaatttcccagcaggtagtgatggatgcagagctgtgctcttctgtttaagaagctcctcaaggcactctggccaggacagtttaaccacagggacgctggtggactcagtcaatccagacctggcagagggcagcagctgcctataagtgtgtgccagttacagcagggcgtgggctgctgcccaggtggcctgactttctgtctgtgttcctttccctgtatcaccctgagtctgagccagacttcctcttttgtcacaggtaattcatcacccttatcaaccgccgttaagtatcagtccacaatgctctgaaaagacttcctctttgccgtaagtgtaaattacaggaggaagctaacactatttataaatcaatttcattttcatgcaagtcttattagtcatgataccattttgggcacttcctagaagctttttgtgtttttaaatgctttggatgaaaatcctcatttgtcttgtaaacctccaaggtggatgtgatctcggcgaacaccagtaacagcgtgatgtttgtgactttatccagtgctgggcggaccacagatagagtccccaggtgctgagacactgactgtagtgtgctcagaggagggcggctagggcagtgagcaggaagccccaaaatcgtccctgtcaagcccagctggggagccgacagtgccttccctagaggaagggtgccaggggtggtcatttagttgtcctgacatgatccgttggccccacgagcagcagccaggtctgtatctgagagctgtaatttcctgctgataacaggaacacagataaggggcaccccatcccagagtgatattaggttggcttttgaatcaccaggctccttggatgtgccttaagcccacaggtgccctttaagcacctgccgtgagggcagatgtgacagatcgtgtttgctctctgggcagtgagtgggttttgggtagcttctctccaggaaatgatgaatcactcggagctgagcaagtgccagagaagtcttcaatcacagactgaacccaggagggtgtttcggcctttctaagtccttaagggttgtagggaaggttttgaacaatggcttttgactttaccttctgagaggctctgtcagggagtggtgatgctgcgggtgagagcagttttgaaggtgtcacatccagggccaaccctgagccttgcttctgtagccacctcctatgggaggtcatgacaataataagattttgcatgtgttgtccaggagcaaagacctttccaaactagtcgttgtgttgaccactgaggatgacagcctggtgggctcagtcagagccattgtgttaataccctgctcccacacacatagctggtaaatgccagaagttaacactcacagccaggccttccgacccccaattttgtgtcatttctgcttttcagtcttacccttaggtgtcacagctgtttatttaaactgtttgcagtgaattttgtttgggagcattgtcttgtgaaatttatgctctggcagagaacaattcctgctgtcttcttcatttcttctaatttttttttttttttttgagacggagtcacccaggctggagtgcagtggcacgatctcggctcactgcaagctctgcctcccgggttcacgccattctcctgcctcagcctcccaagtagctgggactacaggcgcccgccaccatgcccggctaatcttttttgtatttttagcagagacggggtttcaccatgttagccaggatggtctcgatctcctgacctcgtgatccgcccgcctcagcctcccaaagtgctgggattacaggcatgagccaccgcgcccggccatttcttctcatttttaaattttagtgcttttccccctcgtgccccgacttgccaagctactttgagggtggtgggtgcatcttgctgttttacactctggaatgtcgtgatgggaccaaaaataaaagtttcttgcttgagatgggccctgcgatggggcaggtaccgcgtcagaaatgagcaagcctcgtccctgtcctcaaggagagaagactcacttggtagacagatgtctgttcagccacttgacaaatgacagtaatattgatcaagctactgccctggatggctgggctggagggctgaggagaaggttgaggctgaaagatagagttgtgtgggcatgtttatgaaggggtcatatacctggacagccgggggaggaaatggaggaggcaggtggaaatccagatttgaggggtaattattgttcaactcctgcaagacacttagttcttttttttttttttttgagacagagtctcgctctgtcgcccaagctggagttcagtggcgccgtctcggctcactgcaagctgcgcctcctgggttcaagcgactctcctgcctcagcctcctgagtagctgggactacaggtgcgtgccactgtgcctggcttattttttgtatttttagtagagacgtggtttcaccgtgttagccaggatgatctcggtctcctgacctcatgatctgcccgccttggcctcccaaagtgctgggatcacaggcataagccaccacgcctggccacttagttcttaaagaaaggagagtaggaagaaaagtacaagtgagaaagatgaacaaaaacggggattgtaagagtacatttattgagacagttttgcatttgcatttgctcggccagtcttatatataattagatgttgcttaccatgacatcatttcatttccaaggagcaaacccacaatgtgaaaatggacccactgttatgtcccagataacgtgccttaggtaatgttctagttgaaggaactagaaagggaattaaaatcattgttatttacttgcataataaatgagtggaacagcagattcctgaattgtccattaagaggcgtggactaaaataattcaaatccctttatttatttatttattttatatttttttgagatggagtctcactctgtcgcccaggctggagtacaatgacgtgatctcagcccattgcaacctctgcctcctgggttcaagcaattctcctgcctcagcctctcgagtagctgggattacaggcactcaccatcatgctaatttttgtatttctgtagagatggggtattttgtagagagcctgaccatgttggccaggctggtctcgaattcctgacctcaggtgatccgccctccttggcctaccaaagtgctggcattataggcgtgagtgcccggcccctatatttatttttaataatcgatgctgttcgagttgagtatgctatttattattaatgtcataggtagaattctaagtggaatacgcttgtagatttttatgttctttggtgtattatctgtttggttctaacataaaacagtttctaacccagaggtatctggaaagatggtattccagtgggatgtaataacctcagaaaatttgtattatttcagaaggtcaagctagacgatgtcacattgaaaaaacttacatgtttcttaaccttagagcttttctgaaaatccacagttagagaaacccagtcttgccaaaggatatttgtaagatttggctgagttttccatcaaaaacatttgaactaggggttgtagagtcctgtttcaagtggtaaataaaatcccgtgaggtgaagctgctatttcttgccaaattttgagattaaagtcagtaggtttgaaaggaatttggtatggggtgagtgaatagcaggcatctgaaagccgttccactggaaattgaagccttccatttggtcctctgcaggttttgtttatcgtttgtcacccttgaggtaattaagatactttcttctttaaagcagatattcccctcactgcttgatcacgtgttttagcagacagcaggaaactgacaccaaagacagtcatgagattaatgggcaggtatggggaggtgggttgattggctgggtttgtctgacttcttcaggtaaattagcttcttcctccagccttttactcgaaacataactgagagtaaaatttgggaatttatgcccagctggtttattcttgtattctttaaacatatgtgctagatttatttcaaagagagcttggaggaagggcagagaaagaagagcctggctgcctctaacctgcctgcacccctccaggcaacaggtgcctggggtgactgggcccaccccggtcccttaaagggcatggtccctcccgtgcctcctgggggagggattgccccctccaccccaagctctctttcaaagaaattgtttaaccaaatagtatcctggcttcctgaaatgagttctggttaatacaattttctctctccccaattcttaaaaaaaaaaagttaattgtgataaaatacatataacataaaatttgccattttaaccatctttaagtgtgtggttcagtggcaaaatggaaaccctgtacccattaaacacacactgactccctattttccgcttctccctagcccctggtaatcagtctttctgtttctatgagtttgtctgtctaaggtagctcatgtaagtagagtcatacagcatttgtccttttgtgactggcctatttcatttagcctactgtcctcaaggttcatctacacagtagcatgtatcagaatttcctttctttttaaggctcagtaatagtccatgatatggatggaccgcattttgcttttccattcatctgtcacactggagttgctgcctccttttggctattatgaataatgctgccacgaccatgggtgtgccaatatcttttcgagacctgctttcagtttttttttttgatatatacccgggactggaatggctggatcataagctaattttatttttatttttttgaggaattcagactattttctgaagtggctccacattttacattcccgccaacagtggacaagagttccagtttctccatatccttgccaacacttgttatattctgtctttttttttcttaaatagtagccatcttaatagatgtgaggtggtggtattcacccttttaaaaactttcagtgcttagtttaaggcaggcccagggtgtagatgttgagttcctaggaacagacaaaagactgccaggtggagcccatgaccctgtcacttgttgagaattattgagaagatttcctgctttcaaatccaggtattttcagatttgcaaagaagttattcaatagaggggacagctaaagatatcaaagcaccactaatctaagctaaagccacagctgatatcaaagcaccttctgattctttgcggtaggaaaatactccagaccaatccagtgggaaggtcacagaagaaactgtagtcttggctctgtctttgccatggggggagcttcgctaagtcacttcctgtttctgggcttacttttaaaaaatgaggttgttggaacaacaactaaggatcccttagttgagaacaagagagcagagcaacgattcagttattaaagatgcttcttcagttgctaagaactaaggagtggagcctttgtcttggaacggatagagctggaattagaccttgcaggtcactcaggccaatgcgccccctttacagaggagaggctaggatgcagagatgtggtaatgctatccagttatgagctagctagcttgctttctttcttttctttctttctttctttctttctttctttctttctttctttctttctttctttcttttctttctttctttctcattcttgggtgtttcttgcagagggggatttggcagggtcataggacaacagtggagggaaggtcagcagataaacaagtgaacaaaggtctctggttttcctaggcagaggaccctggggccttccgcagtgtttgtgtccctgggtacttgagattagggagtggtgatgactcttaacgagcctgctgccttcaagcatctgtttaacaaagcacatcttgcaccgcccttaatccatttaaccctgagtggacacagcacatgtttcatggagcaccgggttgggggtaaggtcatagatcaacagcatcccaaggcagaagaatttttcttagtacagaacaaaatggagtctcctatgtctacttctttctacacagacacagcaaccatctgatttctctatcttttccccacatttcccccttttctattcgacaaaaccgccattgtcatcatggcccgttctcaatgagctgttgggtacacctcccagacggggtggcggccgggcagaggggctcctcacttcccagaaggggcggctgggcagaggcgccccccacctccctcccggacggggcggctggccgggcgggggctgaccccccacctccctcccggacggggcggctggccgggcgggggctgccccccacctccctcccggacggggtggctgccgggcggagacgctcctcacttcccagacggggcggctgccgggcggaggggctcctcacttctcagacggggtggctgccgggcggaggggctcctcacttctcagacggggcggccgggcagagacgctcctcacctcccagacggggtcgcggccgggcagaggcgctcctcacatcccagacggggcggcggggcagaggcgctccccacatctcagacgatgggcggccgggcagagatgctcctcacttcctagacgggatggcggccgggaagaggcactcctcacttcccagactgggggcagccgggcagaggggctcctcacatcccagacgatgggcggccaggcagagatgctcctcacttcccagatggggtggcagccgggcagaggctgcaatctcggcactttgggaggccaaggcaggcggctgggaggtggaggttgtagcgagccgagatcacgtcactgcactccagcctgggcaacattgagcactgagtgaacgagactccatctgcaatcccggcacctcaggaggccgaggctggcagatcactcccgattaggagctggagaccagcccggccaacacagtgaaaccccgtctccaccaaaaaatacgaaaaccagtcaggcgtggcggcgcacgcctgcaatcgcaggcactcggcaggttgaggcaggagaatcaggcagggaggttgcagtgagccgagatggcggcagtgcagtccagcttcggctcggcatcagagggagaccgtggaaagagggacagggagacggtggggagagggagaccatggggagggggagggggaggtttctgttaatgctgcccttatgtctctcgctttctttttcttgtgagtaaaaaaataccaacagtagttcgtagatgtgctggcctggggttggggcctcactgctggggaggtggtctcatcattcggtgacaaacatagctcacgtgcaagggtgatgaaggcaaagagatgggggggacatgagaaggagcttcacagaaccgaaagagaggtcacttcaaaatccaaagacctgggttccagtttggtgaaatggggcgtgtcaatccagagagcccctcttcaccagccctgtgatcttcattgcactttggctgtcttctggttttaccatctgaaaggctgcattcctacagggttttgtgacagtcagcatgagataacgtatatgaaagaaattgtacaaagatgttattaatactgcttgcacgtagttttagagttagagggttacctctcttaccaaacacacgttaaaatctaagttcaacgtggaaggaataagaagtattagggttacaaagaatcatttcttatattgtacatcttttcaggaaccatcccactgcaccttttttgcatgaagttaaacctgcaccacttgtaaacttagaaaaatgtgtgttttgatgtttatatatatgtgatgtattagcaggacagatcaagggggagctgggctctggtgtttactcccaggtgaaaaggaaggcagatgtgtgttcctccttgagtgtgtttactaagggctgggcttgtttcctcggttgagagaggaggtgtatcagtacagagagcttcatttaaaattgtaaaatgaacctgggagggcttcttgcattctttgtaggtatcattcatgacttctggttctctggcctgttctaaattagaattaaatccgcagttcttaccagcccctgcatgcaggggatttgaccactcttgagcctcatttgcaaatgggtgtgctgatctcacttttgcttatttcataggggttgaggtaagatttacaaaaggtatattttgtttttttaacttgaaagaccaaggctttatccttggccttaagaatgtagcttataaaagaacaaacaaaccatacaatttcctctactctcatacacgcttctgacaccaaacgtgtgtgtgtctcttgcacgccaagcagttctccagctctcggagcacaccaactgggtgcctataattcaattcaattctgacaccatctacctggagttagtatcagattccacaggttaagggctcgttcccacaagctgtccctcacttcagatgccagtcacagtctgggcctcctgtgcttctgcttgactggctataaatcgggggttcccatgaccccctcctcgcgttcattcctttgtggatcggctcacggaactcagggaaacagtttactgattgtcactggtttattataaaggatgcaactccggagtagccagatggaagggtgcacagggcaaggcggtggaggcggcggtggtgcttccatgccctctctagcaccccagcctcccagcactgccacgcgttcaccaacctggaagttctctgagcccctttctttcgggttctatggaggctttattacaaaggcgagattgattaactcatcggccattgattacacttaatctccctcccctctccctccctggaggttgggggtggggtggtgggtgggtggggagtggctgaaggcaccaactctcattacagatttgttcctctggcagctgtggtccagcccccatcctccgagagtcctctgattaaactttggtgtgggtgaagagggcttatcatgaatgacagaagacactcctttcacctttattgctctggagctaaggagctatttcaggagcaggggaggaaaatgaaatatcataacaaaagacattcctatcactctgatcacttagaaattataaggggtttaggagttctggcttggatctggggatgaagaccaaaatatatatttcctattacatcataatatcacagcgccactgaatgataggaaaagctcccagaaccaacctttctacacagcaggtttgtgagccacaggttcacacacgtggtgtttcctggagtctgtaggtgacctgaggtgggggttttgtcagtgtggtcacatgtgtcctgggatagttgccttgaagaatgggagcagtgtggaccaggaggaggggtgaagtctcggggtggactggaagttacgtcatgcaaatccttcctgtttgggcagtatttgcaaccacgtggcttcacgagtccgccaaaccatcaggtgaataaacgggagaggagaagagagtctaggactcagccctggagtataagtcagagctggaaaagaagaggctccagagactggacggccactgagaggtgccacgtccctgaagggcctgaggagggttgatggcatgaccccatgaagcccagcaaggagtggagagaggagggctggaggactcccgcctgccatgacccagtccagggataagatgtgagtgccatgggccagtcacgaccgccggttagcacagcagggcacagtgacggcagaaggctgggagcggagagccgggcagagtggacagtgatgtgggcaggtgtggactgcaccaggtggtcagggatccagagctacgaaaagaagggcataacacggcggcagctcgcagtccagctgcttgaacccagaatatctcttggcctgtccctttccctctttttcgtctgtccctacctcctttccaggcggggaaggaatcgtttctctcctagtcttcctgccgtcaggtttttttcttgccagtctttacattgttacggtgatgctttttctaaatcttggatcaaagtgtcattttgttccagaatccgatggcttcacacagcagagcccgcatctcctggcacggtttcgcactctccattcttccctagtgcacattctgtgttctgggtgcagctccctcttccagtctggtggttttaagcttccatgcttctgcatggacctctcgttgtaccctgtccaccttgtcgtctgacatctgagggtgtccctgtcctccaagcccgcctccagcgccagctcctctgatgcaccttctttccttgatcataactcccttagtgtttacttaaaacaaattcggtgacactgacatatattttagtgtgtgtgtgtgtgtgtgtgtgtatatatatatatatatatttggagatagggtcttttgtccagccagagcaagatcctatcttcaaatgtgtgtgtgtgtgtgtgtgtgtgtatatatatatatatatatatatatacacacacacacacacaacgactaaaatatatgtaagtgttgctgacatgcatttatatatgtcatatatatggtcttgcgctccgtggctggagtgcagtggcacgatctcagctcactgcagcctccacctcctgggttcaagtgatcttcccacctcagcctcccaagtagctgggactacaggtatgtaccaccacgcacagctaatttttgtgtttttagtagagatgggattatgccgtgttgttcaggctgatctcgaactcctgggctcaagccatgcacctgtctcattctcccaaagtgctgggattataggcatgagctactatgccccgctagttccttgtatattacctgtgtttccttcacgagcctgtgagtctctccaggggacaggactttcttctttatctctggtgtggccccaggccctgtagaggagagatggcctgaatgtttgctaagtggattgcagttgacagctggccagcagcccagagcgctggtgttccctggagcagtggagagaagtcagacaggcaggcaaaggccacatggaaattgtcacaaacaaaaatcattcatttcccttctccagtaaaagcagtcatttgtttttcaactaatatcaagtagctactatgattggcacgatgggggatcctacgctgtatgaaatagtctctttcctctacagtcttgagatttagtgtgcaaaacctgtccatcatgacagaagaaggggcaggtggcagtggtcctaaggacaatataaaaaagcttcatgggactgcagaggagacagggcctggggacaactgagattagacatcatggggtcaaggctctctgtgctggactctgggagagtggagactggtgggcttgctgtgggagttggggtgataggccgtgatgggccatgatgggctgtgatggatcctgatgggccgtgatgggctgtgatggaccctggtgggctctgatggtccatgatgggccatggtggacactgatgggccgtaatgggccatgatggaccgtgatgggccgtaacgggccgtgatggaccctgatgggctgtgatggtccgtgatgggccatgatggacactgatgggccatgatgggccctgatggaccctgatggaccctgatgggccgtgatggaccctgatgggctgtgatgggccgtgatggaccctgatgggccatgatggacactgatgggccgtgatgggccctgatgggccctgatggaccctgatgggctatgggggtggatagaacacattccggaaatgagaggagctgaaagttgagtgtgtaatccacgtttttgaaatggtgaggagttcattttgattggctcttccttggattaattgtgtgtctgtgtgtgtttttttttgtctgttttccaggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggtgagctctcagggcacggggacctggcaccggctctccttagagaatgcccttgtactctggtgatgccacctgtcttgaactctcagacccagagttttaggtcttcgttggaaatggccagtcacggaactgacagtgactaattgaaattattctagttagtatggctgtgtaaattaaagtgccgtggcacacaccactgtttattaagctcctgtatctgtgggtcaggaatttaggcagagcacagtggggtggtttgtctctgctctctggggcctcagctggaaagctcaaaggctgagggctggaatcatctgaacactcacgttctttgtgactggtggttgattctggctcttggctgggctcttcgctgaggctttggtcataccaactacccatggcctctccacgtggccagggcaccccacaacacagtggcagtggtgaggtgagcatcttgagagggaggaagacaggcagatgctggagcttatggcctagccttgcaagccacatggcgtcacgtctgctgtgctctactggttggggccatcacaagctgcctgggctcaaggggaggagaaataggcttttcttggtggtgtcaatggaagaaggataaagttcataaatttggagaggagaactaggttgctgcctgcagggtggccaattctgacaggctgggaagtgtagcctcctgccagaagcagaaacagacactttgaggaaggggcaaagagaccagggatttgtgctgtctggggtcacagaatctacatatttaataagccacaggagaggtcgtgagtgttcaggagaggaaaacatgcacacgtgcaactgagcttctgcctgtccatgggacccatgttcaaaacgtgatggcactagcaccagccaagggtggagttttctggtgtctaacatcaaagggtggagcagaggaagggaaaaccctcagggcacattctccctaggtgggccaggaccagttcctgggctcttatcaggcaaaaaacaaacacaaacaaacaaacaaacaaacaaacaaaaacgcagagcagcttcttttgttgataccagtgcacagtcttttgaaagggctggtttctgtttggcccttagggaggaaagcgtaatggtggttactgaggtggggtatgaggaagcctgtcctatctcccattccatcatggcctggaactcagttcttaaggtttctctggcatctccttgtcccagagggggtccgttcagtcagttgcgagcttagaattttatttctagtttattttcaggagtggcgaaggttctggaagagcaggtaggaccaggatattgatgtggctagttttagaagacaatctgccacacaaatggaaagaaacaaatccttgcaaatagacatttcatgcccccacctaatgtggattttgggatgatgtctcctgattggtcctttgagttaagttcaagaggaaactcttccttgagtatgtgtgaaggatcccagccaatagttgatgagttttccagggtgtaatttctaatgtctggggctggggaagctttgattgcagcttgaactctcaccagccatgtgaccctgggctggttactcctcttgtctggcctcagctcctcagccaaaaaaggaggagctagaccaggtggtctcggaggaatctttctattagcttgctgcaaaaataattgcagtttttgccattatttttaataattataataatggccaaaactgcagttatttttgcaccaacgtactgttttgggttccatctttcctggtcagggacctgccctcccgaacccagaactcctccagtcctcaagtgacagttcccttggatgggacggcctgactgagactgggagttgtgtggcacttcagggtgtatgcgatgatagcgtatctgtggagacttggccgtccccatgaggtctcctgtcctggtgaaggcagttcattcttttcttaaccatgttttcccttcaggttgacatagaaatcaatggggaatctgtggatttgcatatgaaattgggagataatggagaagcattttttgttcaagaaacagataatgatcaggtaaggaagcctgggtggtcagggttacttcctagttttgagctttgagtaatggttatctggaaacacggcagaagtttgtgcaaagtaataccggccgtggctgtgtggacgatggggcagagaaaagtgggcgttgatctgtgtgggggatttgagccagacggcctaggggtgtgctgagtccacacagactcagctctcctggctggcttcagtttgctgactgcttcccaggagacagagggatggacttcacacatgggcctggaccactgtcagaggtgtatagattacatcggtgtgtcaaatctcaaatgcccaatgttcttttatttagtgagtggctgaattactttaaaaaatattttaaaagctttattgagatatacatcacatatacacaatttacccatttcaagtgtacacgtagtggttttagtatatttacagataggtgcaactatcaccacagtcaaatttagaaccttttcatcaaccccaaaagaaacaccataccctttaggtatcgcctcccctatactccaccttccaactgctgagccctaagttaccactaaccttcctatctctatagatttccttattctgaacttttgaatggaattacagtatctggtcttttgtgcctgtttttttttgactaatgtttcaaggttcatccaggttttagtatgtatcaatattttattcctttttatggccgaatagtattccattgtatctatagaccatgtccattcatctgttctattcatcattacaaacaacttggggctgggcatggtggctcacgcctgtaatcccagcactttgggaggtcgaggtgggcggatcacgaggtcaggagatagagaccatcctggctaagacggtgaaaccccatccctactaaaaatacaaaaaattagctgggcgtggtggcgggtgcctgtagtcccagctactccggagactgaggcaggagaatggcgtgaacccgggaggcggagcttgcagtgagccgagatcgcgccactgcactccagcctgggtgtcagagcgaggctctgtctcaaaaaacaaaaaaaaagaaaccaaaaaaacccaaaaaaaaccaacttgggttgtttccaccttgtagccgttgtaaacaacatggctgtgaacatttgtatacaagtttttgtgtggacacgtgtgtttgatttttcttggttacatacctaggaatggcattgctgggccatgtggtaactttacatttaacatttgaggaactgccagactgtgttacaaagcagctgttccattttatattcctgccagcagtgcacaaagagttgtgatttgtctacatctttgccaatacttttctgattttgtgattctagtcattctagtgggtgtgaagtggtatctctttatggttatgatttgcattttcctaataaccagcggtatctgacatctttttatgtgcttattggccatttctgaatctttggagaaatgtctattcagatcctttgctagtttgtgtgtgtgtgtgtatgtgtgtgttgtttttcttttttactgctgccttgtatgccttcattatatattctagatacaagtcccttatcgggtatatgatttgtaaatattttctcccattgggtgggttctcttttcactttcttgatggtgttctttgcagcacaatagtttttagttttaatgaagtctaatttttttttttaaagtttgtgtttacctttttaatgtattctgttttttcttttgttgtgcatgcttttggtgtcatatgcataaagagtcctttgccaaatccaaggtcatgatttatggttatgttttctactaagacagaccacttccttaactcttttgttcacagatgaagcaccttaaaggggtctgatgtagggattcctgaatgaaatcgacttgaactagttcctttccaggaagacagctatgattaaaaaggaacggttctttatagctccaggttttaaagcaagtgtccataattgcagcttcgggacagaacagtcccaggcacagcctccatcctgcccgcccagaatggtggtgcctggggaggacccagcatctccccttccatgttctggagcaaccctgttgatactggggatccctgcatacctgctcttcacttctcttagatgggaagactccaaaaatactaattggttcctaatggcctttgacagaaactctttgcactgcatgtggacacctgcatttttaatttctatttgtacctggctttagatagatttttggccatcggagctgaggaagcattttgggccagcgtgcagcgggacctgtatgggggctgcttgctggtcttgctggcctgacagggtgcctgtgggtggggtggggccttggaggccagagtatgttcagctccatacagatgcctcttaggacccctgggatgctgctggaagctggagagcccgtgtccttcagcactgcttggtactgcatgtgcctgtgggggtctgcctggctgcccattcccttccagcccacggacagcaaagggcccttctctgctcttgatctgagaatctgtgctgcttctctagttgctccagtccagcagccgggtgagatgacctctcactcccttccagcctcagctgtgtgtctcaggtgtagacattctatttcagcatgtctgatgctctccaaacctatttgaatgatcagcagcacacgtttatttatcccctctgttttatgtatattcttattgtcaacgagtttctcatacaaaatgaggcattcattaataaaatgattactagagttttataaaaactgctgaatcattacaaacaactactaaatggacaggttgtgttttttccttttgtctttaaggagaggatcagtatctacttcctcgatgttcagggccctccttgggccctggtgcaggcaggttcttgggcggggctatcggttgttttacgtgtttttggtttttagatggttattatcttaattcattgcatataaaaaatacacaatacacattctctgtctttctctcacacccacccatgcacacccacatctacacagaagtgcaagagtgcatccaattcccagcataatatggtgagtcaaagcccatttttttcctctgtgctctgggtattacagccaaagttgaattttgggggcttgagatcactgagaattacctcccattgttaaaattacataaatgcaggattgagtacaaagtggcattcaatacattgttggctttctgatcttctaccagattgggcagccacatctccaggtcaccatggctgtggcctctagctgggccatctgctgtggccctccccaggaggtgcttggcctctgaagtgaatcctggaggcctctggcaaggccctgcttcttatacctgaattaacgaggctctttttagaaaatgtgttcttttcttaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcaggtaataactgtccagggtggaggggctgtgccagaatcagacagttaactgttcaagattatttttatgaacttttcccccataattccttattcttttatgtgttttagaccagtggtccccaacctttttggcactagggaccagttttgtggaagacagtgtttccatggaccaggggtggatggttttaggaggactcaagcatattacatttattgtgctctttatttccattactattacattgtaatatataatgaaatacttatacaactcgccatcatgtagaatcagtgggagccctgagcttgttttcctgcaactagacggtcccatcttgggggtgatgggtgacagatcatcaggcattagattctcacaaggagtgcgcagcccagatccctcacatgtgcagttcacaacagggttcgtgctcctgtgagaatctgatgctgccactcatctggcaggaggaggagcttaggtggtaatgtgagggatggggagcgactgcaaacacagatgaagctttgccagcttgcccgccgctcacctcctgccatgtggcccagtttctaacaggggcatggaccccaggggttggggacccctattttaggctgaattttggaatcatgtggacccaatcctagagtggtataaagatttgctgtgctgtagccaagagacagttggtgatgccaaacctccttggctgatcgctttagcagcctggaatggagtcaagaaacaggaactgagcaaattaatagttcatgaccaaacccattttcttggaacctatttattcttatttgagcaccaacgatgcacaactgggctgatttataggcaagggctgatttcaggcttaaaagtgaatgaagaaaatgctgttttctctataagccaactttttcctttttaattttgacttaggtccaaagtttaatggaaattttgtttcctttttctttgcttttaacagtgtggtgaaattctgtttgtatgtattactattttggtgaaaaatgccagttttaaaagataaaattcattttgaaggatatttgatgtttcagatttttacataattcggtataatttttgataattttgttaacataaagaagggataaggggaatcaggagtatcttcctgtgtcattatttggaataaaatatatcttttttcgtggtgaaaaataaatgtcaactggcaacgaatattgcttttcccaactacagcctctatctaacctgtgacaggcttagaaccagcgtcattgggcttcttataattgccttctctgcatggctgttaagtacaaaatttagtggtaggtgttccaggtaacatcaacatatagacagatggcctctgcatgattgaaattgtgaattgtatttagtagtgagtgtgcttatacctgaaacgaggtcatttgcagttattctgtaatcgtaaggcatgtttggttgatgccatttatttcttctgctagacaaaatgtgatcagcgtatggtcattgagttattcagcagttctgcctgtacctggcaggggttttataccgccctggggccggtttggggccactctacctcccaggcttttggaacatgaccgtgtagggtagcaggaggtggcacgatgggaggatccagcagtgtgatcactgcatgtgtgtctgagtccaaatgctgaaacaaaatcattttacaattagaattcggccaaagcattagcacatagacacgtttatggatgccggtatctcactttttccccctccactgcctggaacagatctgggtgtttaaagagatcatgttaattacaaagcacttagagctaatcaagaaaaaattggaacttgattatgaatctatcattaagaattctttgactttaatctttttttttttcctccagaactcttcctaatgatatacctccattccaagatgatattcctgaggaaaacctctccctggctgtgatttaccctcagtcagcctcataccctaattcggatagagagtggtcacccactcccaggtaagctgttccctgttcccctggcccagtgcagaggcttagaagtcagtgataggaagcaattctaagaaaagaatgaaatagaaatgaaaagtgaaaataattaggaccaggaaaaacacggtgtagagtcggaggtacagattaggatcaaacacagaacatgttcagatcatacacttatatctggtgtcagaatccatctgcagatatggctgttagctccctggaggtgaacttgaaaggaaaaacatgtaaattacatcatgctaattgttaataggagaaaacacagtggcagagcctttcttgatacttagccctaagtaaaattcaaaaacagacgttgcttcaggagctgctgaggtcgttcagggctattagaatggtgcctccgccacacttaatccattctgccgaattcaagaatatttatttccctgaaatgaactcacaagttgccctagaggaaaacttggagaactagagctgctcactgtgcagatgccatcctgatgaccccagagatgtttacatcagtgaaacctctgggaatagtgagccccctggctagttttcaaaggacttggggaagagggtagagctaaatcctgtgttctcaacacaggaaataatataacccccattgggatgaaaattcattcttgggtggtgacaaaatcttagacgttataatggtttgtggtctctaaggggccacagcattaaaatctcatggtgggtggagttgggctattaatttctcagaatgctcaggggcatgttgataatgaaaaagagactgagaaacgctgatctaaatgccagtgacatccttgggttattcgtatacctcatgctttagattcgcttctggttcatggtgccagcccttagaaactctgggttcctacctgaagccggtcttatcaaaacgccacccctggttccagtttgatcagggtaaccttgtgaattagcaagcagcagtccccagtgtgtgctgacatggaggttggagagaaaatagatatgtcccatgcctggtttccagccaatactgatgtcgcgggttagtccagcaggctgaggctgaggcctgtgacaaagtccctgcatggaggtcttcctgcgtcagagcctagccctgttcaatagaaacgtaataactagctccatatgtaattttaagatttccagtagccctatttttaaaaagtaaaaaaaaaaaaaaaagatgaaattaattttaaagctatatttcatttgaccacagtatttccaaaatatcatttcaacaagcaatcaattttaaagaattattaatgagatacatcacatttctgtttacataccaagtctttataaactccattatgtatttcacatgcgcagaacatcccaatttggacaagccacgtttcaagtgctcaggagccacctgtagctggtggtttattatattggacagtgcagatataagacctttctagattctcattctttctctaggtctgtggagataaaatagtggagggaaaaatagtggtttaggaggaaaataatgtagaatatttagaacccaataatagatgaaaaaatctgttcaagcactgtatgttaattttaaggatttaaaagaaacactttaaacacaactctgagcgtgtttaatgctcaaaacatctgtaatgttttgcctcatgaatgcagcataatgactgagtcaggttatgtagctctgactatcaccaaatggaatgacaaattaggataaatagctacatttccacatttggaattaggtattttctgtaaagagacaattgacagcacacacgagcacatttttggattatgtagtttgattaagcacgaaagtgtgaccagagatgatcagttctacacatgggtgaaacagaaagtgaaataggtcatttggcagtttcctgcttttgtgtctcagaaaattcatgctgatttcttagcaatttcaatatccggtgctctgccattatcagatgtctgagtttctttattttcttaaaaatgtcgttgttgagagtagtcaaatactttacgtaatatatataatctttatataaagtatatatactttgtaattatatataatcttatatataatctttatataaagtatattatatatactttatataatcttatatatagtctttaaagtatattatatatactttatataatcttatatataatctttatataaagtatattacatatactttatataatctcacttgatgtaattgacctctgattttgtctttcttttaatgtgtatcacgtggtggtatccagtagcctggtagattgcaaaaggactgcccctcatcttgcagttgcggccgagggaggtctgtctagttcttgccctccacagtcttccctgttccatccttcggaaaggtagaggagttattttccccattgggatatattcaataatgaaaaatttgatctaactcttactataagtctattttaccattaaccaaattacttatgaagaaaatacctgtagattatatgaagtgaaaattttgatttaacttttacaaatcgatttcactaaccaaattacttatgaaaaatatgtatatagattactcttttcctttcgttataagcatttgtagatgatcagatttttttttttttttaattcctaaatttgactctctggaaattatggttaagcatataattttacctaattctgtgaagtgctttgaaaatgagaataatgaaatatagcttgggaatatgatcttctgttttctgtctcgggttgtttgacaaataagtttacaagatatttttggaataccactttaatttattataaacatttaagtagtttattgggctgtctgaataatggagtcagacactttccacagcatttctagaacagaatcttggagaatggcctgggctgggtctcaggctgaggatcaaaggttggtgtgttcactcgatgtagtcatctcagatttctgccttcattccctcagttttgacctacctactttgtggacttacatggtttactttgtaagccttagcaaatgaagctacgattaatttgtacgtggaaaaccttttgtctttttgattaaagatccagacctcaggatgtacttcattcagaggctacatttgcagaagaaaagtccgtttaaaatgaggaaaacaaagttgttaatagttaaaactaactagccttattgggactggcaaaaatactgaaaactttgataaggctaataaataccttgtttatgaacatcagtcattgaccttgtaagcttacttttttgaacaacccttgatcttaaaataataatatttcatgacggagcactttggagtcatctttctggtaaatcccacttggcagtgggccccattcctgcgtcctttttggtctgtctgaattccctcagtgacggtcggcagaaagcgcatctgtgtttgtgcacgagacctttggagaagggttgctgtggcctgaacgggcagcatttatggtggtggcctgtttgctgttggggagggacttgcagcagactttctcgtagggctgggctccttatgcgtgagttgcacgcctgagtgcctctatgggttttgtggctcgtggcttttatgaagggaccagaatgttaggaactctggagttgggaattgctgcaggagaaccgtgttccgcatttcgttcttctagagcagaggttggtaaagcacggcccatgggtcaaatctggtccaccatctgcctctgtcagactttcccgggcataggcagttggtttacatactggctgtggctgctttcacaccaccacagcagcgagtggttgcgacagacgtcgtaaaacccgtaaagcccgagatatctgccactgggctctttacagaaaatgtttgccgacccctgttcggagcaagctttgtctaaaggactttatttcatttagtgacagtgagataatttattgctgcaaagaacttatagccaaatatgttctattttgtctggtgaaacagaatggcaagagctttttagatactttgaggtttgggaacagcaccgttgagggtgagaagttggttttgatggacttattccatgatgatgctggagaaagagtggattgcggtcacacttgtaggtactgaggcccctcgctggaggccacagcctgcgcttttcccattgcagtgataccgaacacgtgactgtagacgcttcagtgccaccaaagcgttgtctctttggagaagtccagttgtggaactggaagagcaaggaggttgaaaggccaggagcctttcccacatggacgtgggggggcccacgtgccttcttataggactgctccctaaagggcagaaatgtgtgtctgttgggagcagggtgtcccattgcagaagctctcctaatgtgatgtcaggagcctcctctccccaggcaggcgaaagagagcgtgcaggctgccccgtggcagcacgtcattagaagggctgggagtcatgggcaccaagggagcagggaccaccctctgccccttggtgtgagatgagagagatggcacttggtctggctgctctatgcagcttgatcaaagagattcaggatcagtttagcccacaaggtccctgtttgttggatacaagttatgtatcatcatgaactcaccttgtattgacaggaaagttatattcaattggagttgaactctaggtaaatgagaccagaagcatcagtttccgaagaatagataaggtctgggaaagaagacggcaagggaaactgaaagctttatttcctgctttgtctgaaaaaccctgccgccttcctctagaggaaatgatgtgggaaaataagcaataattaaccatgttattatgcggcaataaataattacaagaattgctgctgtaaataatatttctctaagttgtttagaatatggtgaggatcttgtggataagttaatgacttttggatggttactttggctgggcagaagtaagaccttgtttgggtcttcagagtaaaaattcaggaaacatggaggtggttactgagcgagccttaaccagttggtgagtcccttgtgaagtattcctggaagacataagatcttagaaaatttcaacttgtaggctcctgcccaacgttatcgagtttatttgtggcatccagcatctttggtaaaattggcacatcatataatttccctgtttcccaggccagtgcagatgataaatatttaaaatatggactctaatgagtgcctgcccgagccaaccaagacccttttgcagccctctgacagcagaggaacttgatttggaaacagattgcaggagatgcgagtgcagagtggggtggggaagggtggtctttttgaggtaagaacagactatttttccctttctctttccatctctttcttttgtattctgggccacttctttttctcctctcccccgcggtgcaccaggcggcagggtggggcgggcgacccacgtggagcgccttccatgggaggcgcttccctgccccctggtggccggaggagggatttgtcatgaggctccgctcagagcgaacgacagctgggggtgcattttctgggctatttgagccatggagctgggcccaaaacatttacaaaagtttcttttcccaccttaattttcgctttgtgttttccttaagtccttccggttcccgaccttcaacacctaaaagtgattcagaattggtcagcaagtccacggaaaggacagggcagaagaacccagaaatgctttggctgtggggagagctgccgcaggctgctaaggtgagagtctcttcaattctgccacggaccgaagatttctaactcagcttaaattacatggaattagtatcatagcatagccaagaaacacagctaccaggagccagaggtaaaccaaaatatattaagggttagccttgaatgttggaattactttcttccacgttaccaacattatagagaggtctcattgcttttgtagattttaaacctatgggattcctcttaggatttacttttttttttttttcttgagacagagtctcactctgtcacccgggctggagggcaatggctctatcttggctcactgcaacctctgcctcccaggttcaagcgattctcctgcttcagcctcccgagtagctgggattacaggcgcatgccaccacgccccactaatttttgtatttttagtagagacggggtttcaccgtgttggccaggctggtcttgaactgctgacctcaagtgacccgcctgcctctgcctcccaaagtgctgggattataagcgtgagctgccgtgcccagccaggatctacattttctatcacagctaaatgcaaattaaattaaagaaatacaacttacacacaatcttgctgtcttgaaactgtaaacaaaaatagcttccagctcttgagtctgctaggtcattgatgagtggagcaaagccacagggagagagttgtggactcttggcccattgaaaaagaagctgagttgtaagagctggaatccacatgttcttgtgtccctcacacagagagacatctgggagagccctgggagagggaaaggctaatagaacagaaatgaaagatttcagcctaatagataaacaaagtcagaaaaccttaaggttttgattcatcaagtagtaagtatttctgggccctcattgttggtgggaccctgaatttgaccctatggagatctccaaaataaatagagaagcagctgagggtagcggagagaatgagggcctgggaggcagcaggttattctgggtttgagtcctcactgcaccgcttgctaaaaaggtgaccttgggcaaatgagtagacttccctgaacctcagtgtcttcatctgtaaaactgtgagaaaatgacagaattgttgtgaggttagaagggctaatgtaggtatgtgaagtatctggcacctgtaggccctctgaatatttgcattctttctccttggctgtggtacatgcacgctgagccccagtttccctatcttggatatgcagtgggtttacatgtaggtacataactggttcagcaaatatgtttctaaaaacatgaaatgaacacaatcttttctttcaagaaattttatttggtatgctaatgtattataagcatcttgaattatgttattatatcacaagctttaaaaaatattgtaaggtccttagaagatgctatagcctcttgcatccccaataaatgtttgtaatatgaatgaatgagtgagtgagtgagtgaatgactattgaaaacatcccttataaagagtcaagatgggcagctttttggagagtagtctgttgaggccaaagttgtggatccatttcctctctaggttatatttagatttcatagaaaatgctgatttacctgtccacagctatggtgctgacccagccaactctctttgcaagtttatgtcgttagttgctggagaaacagcatggaagtgcaaatccatcacttcttctggcaaaatagttgtaaccacagattttctgtagcattgtttttatttgcaattgaagctgtttgatcagatagagaagtgaatactttctcccctctttttagcccatgaattgcattttggtttttgtttgaataaatcttttctgtaactggaaatccctctggcggtagaatcagaaatgctaatttctcactcatgtgaaccaactgtcaccaaatctttacttattcactcatgttttgggaataaactttattgaaatatacatacagagaaatacacacattgtaaatgtatagctcaatacattttcacagcaggaacagatctgtgcagcgtgcacccagaccgagaagcagagcatgaccagcagcatggaaacccccactctttgcggtcactgctcagactgacccctctgctccctgcaaggggaaacttgatcttagcaacagagattagttttgcaagattcattcatgttgttggtgtagctgtaattcatttattctcatggccactgagaatcccagtgtgtgtgaaaagacttgtaatctaacagcatttagggtgctcctgcctgttggcattgctaatctcacttctctttggcagttgatgtttcacaggaaagttcatttgctttggacctaatattcttggtttctggactttttggcaggtatagaaatcaccaggtgattgttgaggcttaaaagtccctgcctacttttgattacttgttctccttgggtcactcagtttttctggttgcctttgtgctgaccttgtctctctctctgtccctctctcctctttgctctagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagaggtaccaaggctggggcttcccggctctttttctgttcatagtttgtgctcactctacacatgacaggtcctttccaaagttccaaggaaactgaggtagaaactgaaccgtgacaatgatcatgttcagtctgagctcttcagcagaatatattaattatcggaatttagtcataggaaatcagacatgaagaaggccttgaggatcatgtagcaaacttcattttacacactgaggctgctcgctgagacctgggagagttaagtcctttccagcacaccatgggacccataagtgtgacttttataaagctgattattaggttaatcctggccacctctctccttgccctgcgttgctttccagccccttacccactgtaatttctgcatatcatttatcatgatttcaaatgatcattattttattgatttatttttgcctgactcccccatagaatatgtgctgtctgagatcaagagtcttttctatctaacttgcctttctctcctcggcgcttggcatagtggttggcacacagtgggcgctctgtgttggtttaatgcactcctggctgtgtgttagtatcaacgatgccaggcctgatctccatccacccagcagcttcgtgtggttttctagaattatatggaccaattacatcattttctgctagaagtaaagaggacatttgaagtcatcatggccagtgtctgacaatgcacagtgtgggatgctttgcctcggggtattgatggggaagtgcctaataaaagcttttatcatttcataataagtgtaataataatggtaatagcctcaatgcgtttagtgctcagtacacttcaggcactttacagaggaggaatgaggctcagcaagttaactaacttgatccaggccacacgatggtggatgacggccctggtttgtggaccttggtggtctacggtcacgttgtactgcccaccattttccaatgggaaaagcgcaggctgtggcctccagcgaggggcctcggtacctacaagtgtgacctcaatccactctttctccagcaacatcatggaataagtccatcaaaaccacctcaccctcaacggtactgtgcccaaacctcaaagtatttgtctaaaaagctcttgccattctgttttaccagacaaaatagaacacacttggaactgttgtggttcttgggcagtttgagtacctgggagcaaatctgcacatagtgtttaaatgctgtttctatagatacaaggccatgagctcatttctagaagagtggttttctgacttgagccatttgccgttttagataaacgaagccgacatcttggtgctgacggcgtctacttggatgacctcacagacatggatcctgaagtggcggccctgtattttcccaaaaagtaaaattcctgttaattcctcacatcatttcctataatctgaatatcattctgtgtgagaccagtttccccttatgtttgattagaaagtgtgcaagacagctgggcgcggtggctcacgcctgtaatcccagcactttgggaggctgaggtgggcggatcacttgaggtcaggagttcaagaccaccctggccaacatggtgaatcctcgttctactgaaaataccaaaattggctgcacgtgctggcatgcacctgtaatcccagctactcgggaggctgaggcaggagaattgcttgaatccaggaggcggaggttgcattgagctgagatcatgccactgcacaccagcctgggccacagagtgagactccatctcaaaaaaaaaaaaaaaaaaaaagtgtgagagagaggcagtgggaggctcccattgccttgtgaaatgcgcctgctctatggacataagggtgcgggtactgggcggcgccccacctctggacaggggcgcagcaccgggctgccctccctgcaaagcctgaggtcatgttgtccacagtggtcgtggtccacagcccagtaagtggcagctgtgcagcccttttttcccccaggagggtctcccgtgatcctggggacccaccctcagtccccctgcgatctagggcagggctggcgcctggaggggaagggcagggaacagggaggacagcttgcttcttcttcagtatattttagggggatacagggagatgcagccagctgagaagtaatggttttctctcctaagctaaggcgtttaatgtctctttccttgtcgtggtgctttaataaacatctgtgctgagatgcagccgtctgcggctctgagggtggccgcgtgccagagcatcactggatggtgatgtaggaccctgaactgggacagtcctcagccggtctctgccgcttttcctccttccagcggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaaggtaccgcgggcctcgcgcgggcgccctctggtggccgccggtcagaaggcgcagaggcttaggcttctccaaggagtgcgtgtcaaggcagcttttcccttggttgcggttaatgatagcacagatgatagcaccgaactcataatcccgatgtttctggcttgcagttagtcggcctcagagttctgtgggtcacccatggctcgggccatcgttgtgtgtctcctgtgccccaggctagcactgcagagatggcctccagaggcctgcaggctagagggggtgtcagtctaattaaattagagggtgtcggcagcgagagagaagtgcgccggcgccttggaacagggaggtctgagtttgtcggaggagggctgggaacttttcccagctggattcaaagggcgttaatcgggtgggcttaggtgattcattcacagcacctgccacattcgtagcaatgcactcccagggcctcctgacagttccatggcagggtgtgcccacgccccccagtgggtgcagtcagcagttatcagctggggactagacacagtggccctgcacccctcccgccccctctctcaccactgcctcttttccatcccctcgtggtatttctagcagggaaggggccgaggctgtgtacttcttccctctacctctcaggagccacccccatctccccttccaaccagggctgccatgtgagactcctgcctccaccctggtcccttcaaggctttgggaattttttcttccgcaaagattgagacctttttgttctcacgcccgtgccagccagtcccttgagagcggaaacaagattgtgtgctgggtcccgccggctccattcattcactcagttttcctagggccacacattaatacccagcctcactgtgtttctgaagtcatgggggctctctggacactggcgtgaggagtcccctgggcgttccctccctgatatacatgagctggtgggggtggggtggcagcactgacaaggctgggcaccgttatctgagtgttatctcatggggccaggatctgcagctgtccagtccttacaggtgaggccagatcgtcacagtcaggagaccccaggagagtccccggaggtcctgattagggctctgagggtgcatgttgaagccagtcaggctggcatcaagacccagggactcttttcctggacggaggagattctcagtgtctgatgtctgctgggtttcggttcggttcagggtaaataggagctcccagggaaggagtgggcgtggctctgggccagggagatggtcagaaccgcggtcaaggcttaaggtacagcccagctgccagagcccgtcaaagaactgagggtccggggctgaggtctgggcctcctgaccctgccaccttctcctttgctctgatcctggtggggctgccccaccatgatgagaacagtgccctgcctgcttctgattgtggtggaggcagccccatttttgaaagggccctgtgctttctatttacgacattatcagtccccatgaccaccctaggaagcagatgtggttattatccccatgctagaggagggaactggggcctgggaggtgaaccgcttgcccagggttacccccgtaatcgtgacttcagccgagggagcctggcttctgcgccatgcgtagccatgactctgcctgtgcagatgcacgtgtgtgctgttttcacccctactccctgtgtgaacgtatgtgcctcaactaaggtacacgtcccccaacatcctcagccttgccctggcctccctgcattgctgcacagacgccgccttccaggtaaaatggtgcggcctttacaaatacattttataggattgtctgcacagttggaatgcacaaactctcagaaaacacttgtgagtgagcaaatgaaaggtaggcctaattttgaactgaattttctttttgtttttccctgatcctctgcaattgctgtcacagatgcattcctggagcaagctgtgtcatatcaacagtttgtggacaaccccgctattatcgatgaccccaatctcgtggtaaagattgggagtaagtaagtacctcttgaaagtcactttggcagtagcatgatactgtttctgtttcatgttttcaaatagacctagacattaagccttagaaatatataaaataaagactttgctacattgcattattgcattatcttcactgtggtcagggttccatgccaatagaattggcaatatagctgataggttcagatagctctcagtcttgtgagttttcttttcttttctttttcttttttttttttttttttttgcgacaaggtgtagctctgtctcccaggctggagtgcagtggtgcagttgtagctcactgtagccttgaacttgtgggcttaagagatcttcccacctccgcctcgcaaagtgctgggatttcaggtgtgagccactacacccagctcgatgttcttattgaatgtgaatagtcacactctgcagtacatgggtatgtcagagtagcctacatctctacccttttgaaaaacttcattatcggctgggcgcagtggctggcgcctgtaaactcagcactttgggaggccaaggcaggcggatcatgaggtcaggagatcgagaccatcctggctaacacggtgaaaccccgtctctactaaagatacaaaaaattagctgggcgcggtggcgggcgcctgtagttccagctactcgggaggatgaggcaggagaatggcgtgaacctgggagtcggaagttgcagtgagccaagatagcgccactgcagtctggcctgggtgaaagagcaagactctgtctcaaaaaaaaaaaaaaagaaaagaaaaacttcattatctgagggcaagggatgtacaggtatttttgcagactgttagcaagcttttctcccttaagccatggatgttttacacctagttgcctttaccttgacacgtggcaagaaataccccaagcacgtcgtggtttggtgcagcagctgtacggtgggatttgggctgctggcatgtccaactgtctgccctgctggcacggctgctgctgggccctcaactggccgctggggtgaggtggggggagcctctgcctaggggtgatatggaggagggctgggggctagcaagagtattgagctctttaagggcctcgctggagtcccgagctttccttgactactttatatgacattggaaaggttttcagtctgagcctcggttttttgacatatatttcattgttttgtgttagatattataactggacaacagcagcacccctcctcctggcaatgcaggccttccagaaacctttgccaaaggtgagctttaacatgagaaagaaaaggggatgctagaaatgatgggtagcttaatctggggtggttggaatttcacttttattttggaaactacagagttaattccactgtgctcttttgaagttcatgagcatacaggccaggagtttctgatctctctcttgcaccttgcacgtggttgcccctcttccttatcaaggcaaaacctcccaatcatggtcgagcggaccgaagattcctttctcaatatctgccatgcaaggggtacaggtggaggctgagcagacaggtgccaggacctcagagcccagtgaggacaaagggagatgattgtcaccctggaaaggtggagcaggcatcagggtcaggtgcaggtgccctgtgtcaagtgtcaagtgtcagtgtcaagtgctgctcagccaggaagccagccccatgcctgagtctctgaggccagagccagtacagggcctggacagctcccagtctgcaggggagagtaggtaagtggccgtagggaggagttaggagggcagccacgccacctgccagtctgcagtgttctcatcctaccccaaacaattcactagacagtcagcctggagttgttaattttttcaatgatagatcttcctgctagattatacgttctttgctgcagagactgccttaggcttgtttgtatcctttgtgcgcttagcaagcttttgtatggcttaggatgttgccgtcggtcagccagttcaaacacttgagattcttgaaggtctaattggactttgttgagtctaggcttgctgcttcctgggtttgtgtgtgtgtgtgtgtgtgcctgtgcctgtgtgtcagtgtgtgctcatgtgcatgtgtgcatacgtgcatgtgtatgcatttgcatgcgtgtgtgtgcgcatgtatgtgtgtgcatgcgggtatgtgtgcatgcttgtgcaggtgtgtgccttatgtgtgtgcgtgtgtgtatgtgcatgtgtatatgtgtggatgtgcacgtgtgtgcatgtgtggatgtgcacgtgtgtgcgcgtgtgcatgtatgtgtggatgtgcacatgtgtgcgtgcatgtgtggatgtggatgtgcacgtgtgtgtgtgcgtgtgtgtgtgtgcatgtgttgtgttttgaggaccgcagtctcatcctgggtggtgctttatctgattatctttgtggactgggctgagggcatgttctccagagtggtttttattttgtccctgccatggtatccatggcctgggacacatttttatgtcaccgttctcaacacttacaaatccgtaagaaaaaaggccattgcaatagcaatatagctaaaggatttatttattcactgaagaagaaatccacatgggctctgaaacttaaaagacattagtccttgtgatatgcatgctaaatctttctacaagtcagtaacttttgactatatatggcatttctctaatatagaaattatttttaaatgtagaatttgcccatcttatcttttatggctgttgggttttgtatcacacataaaatggccctgcttccccatttccaaaacttgtgaagataggccctatattttctttttgtgctttcttgtatatggggcatatttttacaagttttggaaatttcgaaagatcttaaaatctttcatccatctagattttgtttcaagtgtaatgagaggtattaggaagcaaaccagtttttttctcaggaagttattgaattggtgaagatgatttttgttttaggaaacagaatgactaaaagtggcttaagtaatgatctcatatgatgaggatcttagaggttggcagtttcaggcttgatgaatttgggttagcttctttgtgattttctcagcttttccttgatggtcacaaggtgactgccgtacacatcgtctgctcagactgccgcatctgaaacgggagggtaggggcagctctctcatagttcaagacttggtcacatgatcaccactaaagcacttcttggcaaagcaatgaaatgactgtgaacggcttcgaccattgaggtgcatcctctggagttgagccagtcttctccgcatgcattgcagcctgattcttgaacagagtttcagatctgtcagcaagaaaggggaggcagatgagctgctcacagggtctgacatggctactgaattatcccaggaccgtgtattaactaaccctatcctccactcagaggcagttacaacttcaccctctgttacgtgtctctgtgaatttagatttatttctggacttcgttttctgttcctgtgatatgtgtccttgtataccaacactgcattcttttagttaccatatattttggtatattttaatacccagtagtgcttgttctacttactactcttctgcctgagaattttctgggctatttttgtttgtttttcaaatgaacattagaatcagtttgtgaaggactgaaaatactcctgtttgtttttttcctttctttggcctgctttctttttttaaaaaaaatgtggttttgttacatttatgagtggatttaggggaaatagggtcattcacagctttgtcaattgtcctatttatgagctggatgtgagtggtttgcattttagtgcagttgggttttcttttgtgtcagatagggatcttttaagctacatagtaaattacttatctgtctgcttcccttagactgaatctttcagcttaaatctttcttttgttactagctgaggtgtcagcttcttgaaagttctgtaaactgaggaagggacattacctaacttttaccttggtcctggaattaacctcaagatagataggtattttgttctttggaaaaacgtagaaaattatcaattcatatttaatctccccattaaacccatttacctaaaagtatgaattttctttttaatactcgagattttaaatcaaatgtacctattaatgcaaatgtttagaaatttacccttagtaaaaatcttatgcattttaccttttgttgaaaactgttttatcctctatcccatattaatcatttcatattttatttgataatcatcatattgagagtaatgatatcttaaccagttagccactttaatttgaaaacttccagtcttactaatcactaatgatttctaatgctttctttttttgttgttgttgttgtgttgtattttatttgttgtttgtttattcctttaacatcttcttaagtcttcatgcttaagttaccttcatgtaattttggacgccattaggttttgcttctctaaaatttttaacgcacaaatagtatgttgtgttttctctgatttttttttaaatcttactttaatttgcatgtatgtttcttttggtttgaatgtgctaagttgatctttttttgttccattatttatgttaccatccatttaaaacaggccactgtggaatctatcatgagggataaaatgcccaaaaagggaggaagatggtggttttcatggaggggaagaaacaccacaatcaaggaggtaagcccagaagacaaagcagtgctcacacttagcaagtgttggttttgtgtagtgagattggttttcatgtacttacatcagagaaatgaagataggccctagtgctgagtttccatgagccagctctgccatgaagtagggcgagtgctcgtggaacgtggggaaggtggggaggaaggtcaggagccagcagcataggtgtcacctcctggctctgtaactgttgggagactgtggtccagtcactccctcatggtaagatttcgtcatctataaaagaagggattcagcctgggaattcagtttcttaagaaattaaatatcttccttctgcttgtggagacaatttttctttttctttttctcccctcccctcccctcctttcttttttggagacgggcttgctcagtcacccaggctggagtgcagtggtgcaatctcagctccctgcaacctctgcctcccgggctcaagcaatcctcccatctcagcctctagaatagctgggattacagccatgcaccaccacgcacagctaagttttgtatttttagtggagacggggttttgccatgttgcccaggctggtctcaaactcctgggctcaagcgatctgcctgcctaggcctccgaaagtgttggcattacaggcgtgagccaccatgcccaggctgtgaggacaattttaatgaggcatactcacagcagttgactaattctctgagtcctttcactgaaatggcatgtctaaaggtccatggctttggcgttcatgtctatgagtgcctgtgatttctttcagatcttcgttgccctctcctctatttcttgaagcgcttgctttgcttggctcccaggcccctgtgtccacctgggtctcctcctcccagcaggctgctcctgctctggcttagtcacctctaggagggtcctcaaagctcatgttaggccaccttttctccttttacttcttacttttcccttctgcccatgcgatgactccatttttgtctccaaaccagacattcttttctactccacatccacttatcaagtagtcgactaagcagacatcgtcctgtggatgcctcaacgtatttcaaacttaacgcttccagaattgaactcatgggattcttgtgagttcttccatcattggggccatagtcagaaaatggcaccactgtccatctgtgggtgagattcatgcttttagcctcactcccacaccaggtcctatcagttttccatctgaaatacttctctgacgtgtccatgtctctccagctctgctcccacaaatctgcattaccatcatctctcccagaggtgcttccagatggtctctttgcacccatcctcacccttgcttcttcattctctgtactgcagatgcattggtctcttcaggggactgctcctatttttgttgctccttaaagccttactgtggttccccagggctcttataatgaaggcttgtgtccttaccacggcctacagtgcttgtgtgttctagctcctgcctgcctctttaatctcatctttgctgttctctgctctttgtgcattagcttcaatggctgaaggtaccttctaccctgggggctttgcacatgctattttcattacttagtattctgtggacccctctcccctgcttcgcttagctaactagcagatccagtagccctttccctgcagatgagtctggtctgctgtcctctgcctgtgaacttttccttcataaattttgtcatagttgataattatgtaattactagcgtgactatttgatgaacctctcctttctgtctagacccgaaacttcatgaggcagagaccatatatggctttgattgctttggtgttcttggtctccatattggacccagagtaggggttcagcaaatatttgttgagggcacgctgattactctgggaaagtagtatgaagaagccacagggacaacagtcaagttggttattttaatcataaactgccatgaactctatttatgccattagttgaaagggaaaatgtttgctggaagagttttatcaagatataattgttctttgacattttctgttagcatatctgaggtctactcatcagttttactaatctccaaaggttaccgataaatgagttcaaatatatatgctttacactagaggccttaaagcatgaagggcctctctggttttcttactagagagcagaatgttctagaatttaagatggaagtatatttcagtgacttctttgtagaatatccaaattctcaccagtttgcattaagtggagtgccgctataaagtaaggaacagttatgaaattaaatgtttctttaaaaatctgaaatatacttatttcagttagatacatatttgggaaatagtctaagaagaaattgctaatagtgatggctaagttacatgataaatagataaaacataactggacatattatatcaattatttgtgtggtaataaaaaaacctaaaggatatttgaacttagttcatgctagtcatatgttaagacagtcagcctattatatagtttgtattgttcattttctttattaaaggaccgtagatttcctctcctgacgaaacgagcacagagaaagagatttagtcgttcaccctcggtcccttggcatttctctctggtctcttctgtccttggggccagtgcccatctccgtcctcctttgcctgctatgtgcctggctttgtggttcagacacagtctcctttaatccccatggcagcgttaggagatggagaatttcacccgtttcacagatgaggaagcgaagttctgaatagttaaatgacttgcccaaagtttgtaagcaagagaaacaagactgggcccaggcattctcttagaaatccaaggttctttccagtacaccaacagaggattttctattaagagtatgtcatcttggaaaagaagaaaatgctttcacatcttccccaagcaaaatatggtacaaaaatattttcaagcgtttctatcagcaattacaagaaaatattttgaaaggcccccagaatccaagcagcccttgatcaagcatttgcataagctacagtgatgatggagtttggtttggtgccacaaacacttatggataacagattcgtttctgtcaaaaatatttcttggtttaatcgtacacttcttagcaaagttgagatcaggacccaccgaaacaaacacagccagagcctcctgggcgatcgctagggtgggcgtcattggggaatggtctatctttaggggtcctgccttaaggaagcccatgggaaaacaccggctgtctgcaagccccttctctgtggtacttctgtgactctttcttttcttcttttctaggaaagtaagccagagcagtgcttggctggcaaggcccatagcaccggagagcaaccgccgcagctcagcttggccaccaggtgcggtaggaggcttcttgggatgtttgcagcccctttccgcatccaagttcatggcgtgtgctgcctggatgcagatagggttcaccacacagttccaactctggctctgtgattcacttggtgacctggagcaatttatttaacttggttctcccatgagcaaaatgcatgcagttgctcccttagatagctaatttgcaaaataaatgtgagcctttagtgagataatataactagagcatttctcatggtcctggcatgcaatagtcctttatacacagatgatgatgatgacaataataacagtgagaataatgacagtgatgacaggaataaatagtagccctaacaataacatggaaataagtttcacttctgaaggaacttgcctttctctgtaatttaaatactgaccaggacttacgttgatacttttaacatggattcatattcacttggcataggagaggttagattttgatgatactgatccgtatttgtggtgttttgtcttcaggttaatcactttgtatgggattggaggtgactctgaggacagtcccgttatacactaattatgatggtggtatcatatactgacactgaatgatttgcgctgtaccatcttttacttcttacttcatgtttacagtattcctgtgcttaagaaatccaggattccatttcttatttagcagacagaaagtgctaacagattaattggggccagatccacatcttactcatttttgtatcttggaggccactgccccacagagtagtcgtttccaaagtgttgctcaaccgtcactgaaccactgaggttttctccatgtgttgttgatttatgggagaggcaggcgtggatttccattcctctgaatcccggccatggctctgtgtcttaaacaattttacatctaggattctttgctacaaacagaaacccacgtgggaggcaggtgggaaatgacctgatttctttattgttctctgtggagaagaacagggtggagacgagtgtgcgggacctggtaggggtgagtttgaatgtgactgtgaatggcctggctcgctctcgcctgggatgctcttgaaacctttctgtttcccctggtggtgtcccaggtgcctccccctgacccaccgctggtctgtgcttcacaggcacaagaaagaataggaaggcaccagggtatcgatatttcccagctgggaattctgagtttggctgtgagtgtgcttggaagggagaaggcaggtgtgttgaggatggagcccaggccaaggacatgccaccctctgagcagccagcatggaaagcagacatttcaaaataagtggttgtttactgcacaagctgtagcggaagcagtcgacattggagtcaggcaagtgtggtttggaatcccagctttgctcctcggtaaccattggaccttggggaagctccctgacacatctgagcaaaggtgccagtgccaccgtcagtgcccagacaggctgggatggagctggcctggaggctgcatgggaggcatgctaccccaaaagaggcacacacaacaaagatgcgaaactgcgtgctctcagcaacttaaaccaacttaaatagctacactagaaatgccccgctttcctggaattcattttaacaaccttctctgtcttggcaataatttctaaacacaagaggtagcacagagcaggatgtacagcagggaccttgtccaacagccttcagtgtgatctttggcaaattaatccacctctcagcgtctccatctgtgaaatggggttaagaataacaccgatgcggtagaccccgtctcactgggtcttcgaggcaacttcatgagaaaatgatccagagtgcagaaaccaattggggaggatggctctgtggtcacctggaggacatgcgttcaatcccaaaccatacagtttctgttggctgaatgcaggatgtctgccaaatccatcctgccctctggcagtgcccaaggctgtgggagcccacctcttacattagtgtgacctggatgtgagacatggagtcaaaggagatcattttggaacttttaaatttaatgactgccctattggatttcacacttgcatggggcttgtagccccttcgttttggccaatttgtcccaatggaaacaggtgtatttacccaatgcctgtaccccaattgtatctaggaagcaactcacttgcttttgattttactggctcataggcagaggggacctgtctcagatgagactttggactgtggattttgagttaatgctgaaatgagttaagactttgggggactgttgggaaggcatgtttgattttgaaatgtgaaaagacatgagatttgggagggtccaggggcagaatgatatgctttggctctgtgtccccatccaaatgtcactttgaactgtaatccccataatccccaggtgtcaagggtgggaccagttggagggaattgcatcatggggccgtttcccccatgccgctgttctcgtgatagggagttctcacgagatctgatggttttacaaacatctggcatttctccggcttgcactcactccgtcctgctgccctgtgaagaaggcacctgcttttcctttgccttcagccatgattgtaagtttcctgaggcctccccagccatgtggaactgtgagtcaattaatacctctttcctttataaattacccagtcttgggtatttcttcatagcagtgtgagaacggactaatacagccagtcttagacctaggggaagatgggcctgagggtcagagagttaggtttacaagggagggaagaggacagcaactgggaggggcccgtacacagtgggcacagtggcattgctggtgccagcactgctcttactcttactccttctagacatagcaggcaggaccccaggagagtgtggagagcagcgagatacttctgcagctcttcccacgttggaacctcagctcttgcagtttacttggggtgtcacggattttctcactgtccgatacaatcatattcaaatggggcaaaaaatgctttttcccatcaaatagaaacagctggaccattcgccattctgagttagtcacagtatggttccttatcaaacctgaaaaattaagaattgactcttgtgaaaactcagattttgaaaagaatataaagttctcttgaaaaatgtaaaccttttaatttatactggcatctcagactttgagtctccttattagagtcatgcagttgactaaaaaaaaaaaaaaggtgtcagaatgttttcctaattgacagacgtgattgacagaatagtccccgaagtcccataattgagcaaacagcttgtcaccatacaaataattaaaatagcgtttgaaaaacgtacactgacaagtgctaacttagatgttgttcacagctactcttctgtgcacacattttcaaatgacatgagcccttttgttttgttttgttgcttcttgcagatactgtaaagcaagcaacatttaatgagccattgtaaggggtggggtgggggcctccgaaaaggaggcattttattctgtgcagggtggcgcaatctgagacgtggcagccgcaaatgaccgtgtacttgccctaagccgaaaccaccaacagccaactgcgcatctcgcattttagtctttgtatctgtgttttcctttctgtgttccttcaaacatggcatgctgcacaaatttagtggattttttttttaaagcagcagatggaaatcacagctattccgccttgcctcctcatcccgccggcagaggtacacatcaatctgttgtcaccaagagctttgcttcacatttggatctcatttcactccaaactgtttggttggaacataaacattttcccattcaatgaggggcctgtagcctcgttcttcttctgcttgacaaggaaatctgcaccaccctcccctccccgttcccagcagcatttgccaggctgtaccagctccaggaccacatttaccccatctgaaaacctccagattgttggttcagaggaaccagcatggttcataggatccgtaggtgttagaactggaagggactttggttggatcaggtcattttacagatgagcccactgaggcccagggaggaatttcctaggatgaggcctttgctggggcttatgtctgggtctcccagtccaggtctctctagcctgttacctgcctccatcctgaagttttgggtggatgtgattcagttgttcctctgcattttaagataaagaaatcaaggctgaaagataaagaaatgatttctccaaggtaatgtagcccgaagttaccatgggctggaaacctgtgtttttcagagtctaactgctgtaccatctccactctacctagaatcaggatcagcccccaatgtcatggcgttgttccatccacgtgtagcttagctctgccacagaccaaccacagttctagccgatgctctgttttccttcaactcagcctcctgttcccatggcgtattcccccagggctctgtcccagtgatctctaaatctttgtcttcagcccaggtctctgtgttgtgatttagacacaagccctgcgtgagtgggaataggttgtttgctgtgccatcgatgcctggcatggtatgcttgagtgtcggttgaatgaactctgggccaccatcccaaagcccaccgacctccctttcctggggcccagggagcaggtgcttagggaggggctgctcattctaggactggaaggagctgggtctccacataagtgtggtagaaacaacacagaagtggaggtgctgtgggacactatcctccttcatgtctccccagtattgggcagtattgggttgtagggatctcttttttttcttttttgagacagggtcttactctgtcacccaggctggagtgcaatggcgcattcttggctcactgctaccttcgcctcccgggtccaagtgattcttttgcctcagcctcccaagtagctggactataggcaagaaccaccacgcctggctaatttttaaattttttgtagagacaggttttgccatgttggtgaggctggggatcacttcttaaatgaacacttatggggtcagaaagctgtaggttgcataggagatcttaagggaggcaggggcgggggaaacaggaggcagtaaggcgagaggaagttagcactgagaggagagagtttattgagataaaaagataaagacaatcctggtacttcttctcttatgaaattcagatcctttccccacttttaaatgggatgattggtttctctgctgttgagttgtttgagctccttgtatatatactgggtatcagcccctttttgaatgaggagtttgcacatatcttcttccatttaacgggttgtctcttcgctctgttgattgtttcctttgctgggcagtagctgttgagtgtgatatagtcccatttgctcaacatcactaatcaggaaagtgcaaatcaaaaccacagtgagatagcatctcaccccagttagcatggctattatcaaaaagacaaaaaataacgaatgctcacaaggatgtggatagaagggaactcttaaacactgttggtgggaatgtgaattagtacagctattatggaaaacagtatggagatttcttagaaaactaaaaatagaactagcatacaatccagcaatcccactactgcttatttatccaaaggaagggaaatcaggatgtcaaagggatacctgcatctccatgtttatcacagcactattcacaggagttgaaatatggaaccaacctaagtgtccatcaatggataaatgaatgaagaaaatgtgatatatacacaatggagtactattcagacataaaaaagaatgaatcctgtcatttgtggcaacgtgggtggaataggaggtcattatgttaagtgaaataagccaggcacagaaagacaaatatcacgtgttcttactcatatgtgggagctaaaaatattgatttcatggaggtagagagtagaatggtggttaccagagctgggaagggtagaggggagaggaggatgaagagaggttggttaatgggtacaaacatacagttagatgaaaggaataagttctagcgtttgatagcacagtagaatgattatagttaacggcaatttattataaatttcaaaatagttagaagagaagatttgaaatgttcccaacacaaagaaatgataactgtttggggtgatggatatgctaattaccctgatttgatcatggtatgcatgatattttgataaatgcaaatatatacgtttatcagaatattacatgcaccccataaatatgtataattaatatgtcaatagaaaaataaaaaatacgaaagacagtaaaaaaaaaataagctggagctctgtgtatactctaaccttgcctagaggaaggtgctgagccagaggctttgtaggaaggcaaagtaccggagggcttgggatgtgctgctttgggggccactcagccttttccatttagtctaaggcatttactaagtgattcatatagcattgaggcattttcaaagatagtggtcctgggaggcagagctgatactactgggttggggattatgtcatagcaggattttcattgagtgaatagctaattacagatatgcattatgtgagctatttaaagaaaacgagcctaattcccaccctgcacctcccagctccccactaaacaaaaaagtctagaagagttaggggcactgacctgtatattctgagcagggaagtaaggcgtattccttgctcatgggatgaccctctgggggatcctgagagaagaattggtgagtctttcttgctttcactggcacctgtccgtaagtcctagaaaggccctaattgcttggagttgtatatttggcgagctttatatagggaactgatggatgagtgtggacttgtagaaacttggactcctagcgcttggcatgcagtctcagataggaagagaagagagacagagaagacagcatcttcctaggccaagagggagtttaaccctgcttgtcatgagtaggaacctgttggcttaaaatagtggtggtagctcatcaataggcaagtgaatgaggagaggcagcccccacacgtgtaatgcaagagatgcatgaatggggatgtagtgagagttcattgataaatttaacgtcttatggtaaatgaccacccgagagacgggactcaggagagactggattgacttagtcattgattaaaggctaatgcatttttcatggctacccagatgcattttctaattggtgatgacatcactgtgtgttccagggtaaagcatgaatcatcctccagtgatgaggagcgcgcagctgccaagccatcaaacgcaggccacctccctcttctgcctaatgtcagctacaagaagactctccggctgacttccgagcagcttgtgagtctcccatgcttggcgcggctgtgttgtgagcacatgaggtttctgcagactcctaaggctgtgtgatggttgggatgtgcccgttacttgtcacctttcatcccagggggcctgcaatccctcaactgggtacccgctgtttccaccccaactccagcactatccaggctgggtccccaatatgaccttgccttttgtcttctccttttgctggcctggccctggaggatctagtttactagagttaggaggaaggcagcctggcggagctaattcgtcctaaggtgtcaatcacagatagacttgaaaatcactcaagggtgtttttgcttcaagagagagatgtttgttaactcaaatgcatctcttaagttggtggaaatcaagcagttgtgatagaatttagagaatttcaggtaaccaggggcatcacctggtcatggtgtccttttatttttctgtgtgtgagaccagttttaattaaaagccctttcttggatcccgttggtcatggccagtgagcacctgtccttgcttttttgtgaatcaagtcttgtgcatttctcctaagagttagtggggagcctggctcaagtgtgagggtgtttactaggaaaagataaggaagaggcccagacacccactcaggccatgtgtgggaccctgcagcctgggggtctctgtgtgactcactgctcccactggcgacactggggacacctgcagtcaggcagcctgggggtctgaatggccagctggtgtgcaccaggagtcctggcacagagactcaaaactgctcaaaagtcactttgtattttgaatttggtgtgatttctttgggtctagactatattcttctggatatgaggcatgactgataaccaagacttctctttttccaattcgtgtcagtataataataatttaaaaacatggttatttagggaaatgtattttcacacttggcttaaatttgtctccctgaatgatgatcttcctatttagtcctagagtggtaagtgtatcctattccaaacttgtgatttattacgccgtgtagccccgtcattgaatcctggctaatgactgtaatctgaaaatacttgatcaaattagcactatcctgggaagtagaacaactctgtagcaagtaggcaagttgcattacaagggggcctgagagagctgaggtttcattttgcctgtccagccccggaaagaaccagaacaaggaagggtggggaaagaaagaattatacaagggcccagggcagtcacttgtttttaaagccgaatcctgcttctcatagaacagaagccaaatgcccatcaatcagggcctttccctcaagcagacaaatactaatggttcatgtttttcagaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccaggtaggtcctgctgacttggggcccatggtagatttctttgcttcaccgtgggggtctctgggcctggtgttggcacctctgctctcctcatgggacttgcacggttcgaattctggtgcagttggagctccttacgtagtttcagctccttggtggcaatcattgtgtttagggcttagttgtttccttctggggtattattatctcttcgacttggttgcttctgtgggggcttctcaagaacgtctttttgaatggcctttacctttgattgaacaagccggtcacctcgatgcatgatcagactggaggcgtccttctgtggattacctgtccctccgtcagcatcaactttgatgacttgagccttgggctttctatccagaaagaaagttgtgggtcttgtttgtgttttttttttttttttatgaggcatgaatggtgcaatgaatctgaaagggatttttactttatttttctcttttcctcttcatttagatcagatactcttggccacattttgcccacccttgggaaggattggacccatcagggcatcgctaagctgtaccataaagtgagccagtgagtacagagttcctgtttcccgcctcctgtgaacgctggtgtgtgcaccgcactctgcatatggaatctttcctgtcccagcacggggtgacttgcagagagggctgcacctcaaccagggaggggcagtgggggtcaggggtagcagtggagtccagagtgaaagtgaatcccagcaactccaaatttgaattcaataccaagaaacaaggggcgaagtataggggaattgattactaggagaacacagatggtggcagcattaggggtgagactgaggtttagttcatcccgagggatggcagaggtagccagttgaagaaataggagcttatatgttatatatgccaagtgattttctgtagactaaaaagttgcagattccaggcaagttttggcggcgttgcagaccctgcgagccaaccagcagggcacatcatgtctacctggtctgtggagtgctccagcaagtggcccaaaacagaacagtgcccaccgtgggaccctcagccccagacatcagatgggagaggggttctccgactgctctcctgtgctgggtacatgggttacttcacttatatcttacagagattctgaaaagcacataatatcatttctgtatttagatgagtgaaattaactaggagaactaaagtgatttatccaaattctcattgctctcgtctgcctccagggttcagagccctgcagggattctccatgccccgccccttccgaaacacccccattctagcttgccaggcccaagcctctctcccgctcagtcatgcctcctccagccttttgtggcctagagtctcccatgcgagtgaaatctccccctccacagcattctgttctccagccagttagagctggaaggtgcctctgcctgaatcaggacagtgcggtctctccgtgggtgaggtgggtgagcaagttacattcacacttagtgagtgtcaagatagtgtcaagacggaagtgtcaggcccatggttcccaaccttgtttgctcatctctagcccacagtggtgatggtagggaatgggccaccatccagagctgtttctagaactctgtgaacacagatgaatgaactgtatttccctgccctgcatccgttcatccatccagcattccttgagtgcctgttagtgcctcatcctagggcaggtgcctgggattgctatgaactaggtaagtctctgacctgggactttatgatccagtagaaaaatggcggcttggagagagaaccttaatcctggtgggattaaaagcttcagattttgttgggcacatgtcgatagtcccagctatttgggaggctgaggcgggaggattgcttgaacccaggagttcgaatccagcctgggcaacatagtgagattcccccccatctctctaaaaaaataagtatgtacattaaaaaagcttcagatgtcatcttagatgcccaagctcattggtttgactttacttttctagatttcatctttaaaaaattattaatacaaaagttatgcatacttcttaagacataaaaatactaataaaagaggctgagattatggaaacagtaaagcgcagaggttgtatcaccctcctgcctgcccttgctgcaagctattcccttccttaaaagtagaactactatgaacagtttggttctatcttgctgaatttcaaaaacttatttacatccccacacacatacactcacattatttaattattcatcatatcttttttgtttcattttatgtaatatttaccttactctttttgctactgggcagaatcctgtcgtctagatacaccatactttctttaactcgccctctattgatgaacgtgtaggtagttgccactttttcccctattgccaacagtgatgcagtaagcgttcatagacaatgcttatgatatataatgcatgtataaataaataaagaaggcacacacacttagggaagtcccgctgtaaagtagattcccaggagtagaattgctgggtcaaaggatgagcacatttaaagctttgatcaatattgccgaattgccctctcaaaaggttatcccagtctgtgctgctgtaggtggcgtatgtgcagcgtcgcctccccacagcctcaccacgggctgacctttcatttagaaggattaatctactcatgaggtgccttgacttgtgtgacactgaaaattgcatctatttttagttgaaggaaagaaaccctcatgggtcaggatgttgagtagtgcacagctgattcatttggtttttggaacataaatctatttctgtccttactgtaacattaaacaagccctgttgctttttaattttttttttttttttggtcttgatttgtctcttggttttctcagaagagagatcttcttgaaaaataaagctgtgtggcttactgaagaacccctgaccattcttttctttgattggttggtttagaatgagtgaaacctgtttgtctggacccgcagatactgcccggagcatgatgtgacgtggagacccaaacctttgcctgctcattgagttggatatgtgtgttgtccgcgcacccagtcaggcctgtgtgatttgcaggatggccagggcttctgaaaacccatcttcagggcagctttctacaaccttcagggctccctgctcagcactgtaggaggaggtgccagctccttgatgtggcatttgaaacctggcactttcaggtcccagtcttctgccaagcccttattttcagctgctgtttctcagcccttcctgctctaatccagcgactctgttcctcctctgcactccattcccttcttcctgcctttgctcatgtggcggcctcagcttgacatggcttcccctctgattttcgcttctccatatttttatagcctttaatgcctggctcaaatgccacagtcctcaggccacaatctgtgaccctagtcagctctggtctcttccccgtccccggacttgctggactctatgtggatatcggagggcttgggcctggcttgttggcctcggtccccatcatggaggacagtctggacacgatggcagcctccagagccaaccactgatgaaagtaattcccatcctagcaggctctctcaagcctcctcacacgagggccttagcagccaccactgggagacctgtcaggctaagaattgaccaaggcttgtgacccactgttctagtgactcccatcatacttttgaatctgtattgtgatttctagagaaacagagaaatgattctcatgctagggtaccagggaaaagatgccgtttacatgagggtttgtggactttttcctgattttgcttcccttaaatttgggtacgacttacattttatgcactgtagtatttgtctaatgaaaaagccaatcttcagctgggcacagtgactaacacgaatagtccgagcactttgggagtccgaggcaggtggatcacttgaggtcaggagtttgagaccagcctggccaacatgctgaaaccccatctctactaaaaatacaaaaattagccagggatggtggtgggtgcctgtaatcccagctgctcgggaggctgaggcagaattgcttgaaccctagaggcagaggttgcagtgagccgagatcgcaccattgcactccagcctgggtgacagagtgagacaccatctcaaaaaaaaaaaaaaaagagagagcgagagagagagaaaaagccaatcttgcagttagccacttgcctgaaacaacagtgaataaggacaattttgttttctgctgaatttaatgacttgtttggatctagtcagcccatgaggaatgatccataaggctaattgtcaccttgttcatagagagggtataaagctggcttgagtattgatgaaacagaacaaatgcaaatggaagatacaggaacccctttcagattcaggtgcattcaaaactagaaggaaagtcaagaaggactgttgcctaaaagatctagatcattcagctaatgggtcctttgaggcctaaatttgggcaataattgtttgaatttttgaccttatttcatacatgcttttatattcatgtaaccagaagccagtgtctttgtgacttagaaaaaagaacacttaccgtgtttcccgaggttcgttagctccgctggggtctaggtatgcggtgtcccaagccagtggactgaaaatgagaggcatctgtagcagacttgttagggtcttttttttttggagatggagttttgctcttgttgtccaggctggagtgcaatggcatgatcttggctcactgcaacctccgcctcccaggttcaagcgattctcctgcctcagcctcccaagtagctgggattacaggcatgtgccaccacgcccgggtaattttgtatttttagtagagatggggtttcaccctgttggccaggctggtttcgaactcctgacctcaggtgatccatccacctcagcctcccaaagtgtggggattacaggcgtgagccactgcgcccggcctagatcttttttcctttcctgcccgcagcagttatttctttcatgtcagcacttctttgtttattgcagtcattgccctctgccagtaagagataggatgatgcgagatgataagagataggatggaaggtctgatcaggagtcgggccaggatcccagaagcggcagccattagctcaccctgggccctgggaccgagtaccttccccactctgagctttgttttcctcttctgtaaaatgagattaggctagatgacccctgaggtcactgctaacccaggaatgctctgctcctggctgtgtggattgcacaagggtgtgttttgtttttccaagccaaacctcagtccaaactcagagggagcccctagactctggttgcaccaggagctgtcctaggtgccgtcgggggtgctgagcagtctctcccttcaagaagcttgtggtcttgtgggaggagacacttagggctccctgtaataaggcagtgaggggcagatcgagtgtgaaagatgttggtttttgttggacatacatcaggaagttaattttgattgaccagaggtgtcagaggaggcccctgtgagaaggtggcactcagctgagtctccatggaggagcagggtttcaaaggagaggaaagctcaccacaggtggaagtaggagcgagaggggaggctgggagacgagcaggtactgggtgggctcactgaaagggagactccggtgcagacggtggggtgggtaaaagatgaagcaggaaagtaggcaggagccaggttgcagagcgcctgggaggcaactcaccaagcctgagtggtgctgagccttcctttctcaaggtggcttgtgaccctctctccccttaggatggcagatggggccacagagtcctttttctctacagcagtggctctcaactgacggacatatggcagtgtccagagatgcttttgatggacataaaggggcatgctgttgactcttagtgggtggacccgggatggtgccgcatatctgatgaggtggcatcgtgggggcctcggtccccaacagacactcctccaatctcagatgtcagtgttgagaaactgcagtctagaagcttgcaaaatgctcccgaaggtaatctttccaaactatttaaatctccccgagtcagtgtcttaagagggatgcagagattaggcagaggagaaaacttgtaccaagcctgggcatggatccctcttttttttttccttcttcccattctggtgtttctccagagccctgttccagttgctgagaatgctagaggaacaggggtgatgtgtgtatcgcacctttatccactgacacctcctattcctgggtcccacctgtccttctgggtattgttggttttccccaagcaccctctgcttctgtggggcagggctgtgccatgccctgtgcgtaccccaagccccgtgtgcagcctggcataggagtgctcagtgagtgagtgtgcactgaagggaccgtggaaggagcctgtgggttgagcagggacttgggctgggctggcctgtgtggcatgtcctgccaccggttgtccttctgagtgaggggtcttccctgtgaggggcaccatggagacttagtgctgcctgagcatttggtggggcacttgttggcattgcagacagcttttgttgaaggcaggagggaaggctcttccaccagcagcaaacattttccccattaggtcactctcgagctggctttccagctaagtttagtcaggcaagaaggctggcatgctgacagtaactcagtggcatggcccaactgtgaaatatatttgacaatccagttctgagtgagattagcatcttagatctctgcaggtggcagcttttaggactttgatgtgaagagctatacatggaaatagtgatttctttttaaagattgtatgaattagatggctaaaatacaaagatatttagaaattaaaaagattggctgggcgcagaggctcaggcctgtaatcccagcactttgggaggccaaggcaggtggatcatgaggtcaagagatcgagaccatcctggccgacatgatgaaaccctgtctctactaaaaatacaaaaattagctgggcgtggtagtgcatgcctgtagtcccagctactcaggaggctgaggcaggagaatcgcttgaacccgggaggcggaggtagcagtgagctgagatcgtgccactgcactccagcctggtgacacagcgagactccgtctcaaaaaaaaagaaaaaaaaagaaatttttaattttgtttgattttcagatgcatccctgtattccagacaagctgatatttctagattctttttgtcttaaaactttctcatttcttagttttaaagaacatgttattgagcaattttcgaaacaaatccattggccattataaaatattcatggtagaacaatatgttggataggaagtgggtagtttattcactcattcagcaaatattcactaaatgtctgctacatgccaagcactgtttttggcacgggggttgtagcaaagaatgggacaaagtccctgtcctcatggagtttatggatgaatgagagatacagtcgaatgaaggactataacgtcatattagtgatcagtgctaggaggagagggaaggcagagcaagggccagtgcctgggtgaggagtgagggggtgtgtgtttcatcgcatgggggaggtcaagggaagggccttctggagaggtgagatccagcagagacctagatgaggtgagggtacaagcagtccctgcagactgggggaaaggtgctctaggcaggaggaacggcatgggcaagtgccagcgcagatgagcgtggcgagttggaggaaggatgggaacacctgtgtggtttgccaggagtgaggagttggacagtcattgcagatggggttggggttggagagaaaggtgggggccaggtcttgttggtcttataggccacagtgaagggtttggacgacgtctgtgagaggttgcagcctcaggagggctctgagtgtgagtgggctacgctttacattttcttagagcaccacgtggagtcgggatagcagcagggaggtcattcaagattgtcgcagcaacggaggccaggaggccatgcggtgtggacgtggtgggagcactgggtggtgccgagggtggagcagaggggacctgctgattgtgtggcgtgggggctgggggtaggtagacaccaacggggcccctgagggtttgacgtcacacctgggttaggagagtgccacttgctacttgcagtgccacttgcaacaggggcccccgaggagtctcggggtgagttggggaggagccgctgtggtgtgtgtggttttggaggtacccattttggagtgcgatgagtactgtggggtccacggtgagcacgtactgcgcagtgggtgtaatgtggagttcatagtagcctgcagcttgggagaggggtctggacggggtccatgcatttgggagatatcagtgtatagatagtgtttaaaatttttgaataatatgttttacttaatccaacatattcaaaatgatatcacttagacatgtaatcaatatgaaaacgattaatgaaatatatcataccttctttttttttaattaaaaagtaaactttaatgtcgaaaatgcaaacttggggaagacagaaaaggtcacacacagggctgtcacttcacacttggaaggttgcacagcggccgggcagaggtgctcctcactttccagacagggcggcgcatactttcttttttttataatagactttgaaacttggtatatattttatacttagagcacatttcattctagacactaaatttttgatagttaaaaaaagtgaaatggggccgggcgtggtggctcatgcctgtaatcccagcattttgggaggccgagacgggtggatcacctgaggtcaggagttcaggaccagcctggccaacatggtgaaactctgtctctataaaaaatacaaaaattagccggcgtggtggtgcatgtctgtaatcccagcaacttgggaggctgaggcaggagaattgcttgaacctgggaggcagaggttgcagtgcgccaagatcacgccactgcgctccatcctgggggacagagcaagactctgtctcgaaaacaaataaacaaaaaaaaaaagtgaaatggacctgctaacgcaataaagttgtgttcatagactagttgtttcttcagtctagatatggcatttggagctgtggaagtgggtgaggttcccaggtcctctagggagtgtggggggtgtggagaaatgaggcctgagaaccctgggcgcttgtgcgttttgaggctggcagagctgatgggagcaggcgagctgctgtgtctgggaagcggtggctgctgaggaggagaacacccggacactctggagtcctgggagctgagtgactcaggtgctctgggagaaggaatgagcccccgaggcagatgctactggggagtccattcctacaagaattgagagttgatacctgggtttggcaagatgggcatcagggtgacctgtgcagggacagcaaggaagggaacaagagaacaagagtctgctaggagtgtgaggagaggaaggaaagtgaagaagtggactcaatgcttgtagtcagctttttggaagaattttgctacaaaagggaacagagaaatggtatcttagccagagagagactaaggatgttttggtgtgtgtgcatgtgtgtgtgtgtgtgtgtgtgtgtgtgtgtgtgtgtggttgttttggcttggcttgttttaaggatgaaatgagagattgcagaatatttatgtgctgatgtgaattacccaaaagagaggaggaatttgatggggtgtgtgtaggggcgaatgaagcaaatgctggagcaaagtgtgtgaattggcaggtggctgtggtcttgtcgcaggggctctagccaagagctgggaccagggggagtacaaggggctcaagcgcaggcaggtgagccagtttcatccatctgaacctcagtttccatagcagtaaaaccaggggaaaatactcatccagccatgttctcctgaggattaaacaaagtggggaatgcaaaagcacttagtgaattacagtgaaatgtatttaagcctatttctcaattgcaagcaagattttgtagaatgtggacttttgtatgtgggggaacttgaaacagtgccattctccacagaacagatatggatcaggatttatgaatgcagaaaggttccattttctgatgccatgaaatgtgaatgttttatgtctttcaggaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacaggtaccaggcctgctccctgcacctccatctgtgagcctgttcagacccgctctcttcctaactgcaagttttgtaagaatagcctcctcactggtcttctgccccaatatccatgctccatagcaggcaccagaaaaatcattccaaacacaggtctacacctgcattggctcctcatggctttcaggccgagtccagactcaggagcttggcgcttggtggctcctcatggcctgcgcctcccctcctctccaggcgtgtttctctcgtctctacatctcagtctgtgtctcccagacaattgtctctgcttggagcctttgcacatgctgttccgtctttttgggtcactctcctgctccatctcttcttgagtggcctggctgaatcttaatgtccgttggacaatgagcctctatctcatctccttagggatccttaagtggcctgtctgcgaaccaccatcattcacctggcctttgacacccatcatacttgtcattttctgtcttagatttctgggaacactgttcattttacgggtcctctaacagaccactggccagtttctgattaccttcctcccttcacctatggggccatatcaaggtagctaagccagactaactctggccccttggagttggaggaagaaaacactggacgtccctgtagttggaggcccagggcaatttactagacacctctcaaagcaaaagctattgtggtcaaccataggacattggtccctgctgaaggctgattgtaaatatcataaacttggtctttatgaatgtcattgacgtgattctgcctgaatttgaagaccagatgaactgtttgctgctgctaatcatgcaaacagtggaagaatctagatgggccccaaatgctgtgttgattcttgtgtattttcctttagctctgtaggtaccttttccatcacggcgttgttttgtgtaagcagtagcttttttcctgtagtaaaagatgtcaaattgagacatgcacattctaggggagaaaagtcaggcacaacctagtgtatttcaagtcctcagagctatcataacagcactgatctcaatagaaatcctgatattttagtgaaattgtgtccctaagctatgctgacaatttgcaacaagccattcatcagcctgtgttaagtagtaaggctttgctaggccaagcaaaaagtccacatcgttactccgacatcctaacactaactatgcatttaaagtgatccttttcatttccttatttaaatatcattgtccaaggtgtattgctttttccctgggaggaattattttaaaaaccctaaatctcatagttgatatgtcctcttggaaggccaaggtgctccagtggcagatggccaccggcctggtccttcctagggctgccatcaagccagagccgttccatgtgctagctgtcctgtggagttctctagaattgctagcgaaggctgccctaacacaaatgaccttccttttttttttttttttttaattttactttaagttctgggatccatgtgcagaacatgcaggttttttacataggtatacatgtgccatagtggtttgctgcacccatcagcccgtcatccaggttttaagcccagcatgcattagttatttgtcctaatgctctccctccccttcccccccaaccccctgactggccctggtgtgtgatgttcccctccctgtgtccatgtgttctcattgttcaactcccacttatgagtgagaacatgcagtgtttggttttctgttcctctgttagttttctgagaatgatggcttccagcttcatccatgtccctgcaaaggacatgagctcattcttttttatggctgcatagtattccgtggtgtatatgtgccacattttccttatgcagtcttatcattgacgggcacacaaatgaccttccttagcacaactctttaactgggtgcagttctgattttactgctaggttttgaattaggatgaaggaggggaaggtagtgggtggatatgcgtgtggtgcagttggcaaaaacaagccctcagcacaggatggtgatcacttagcctttgtcaggagtgctgcgaatgtcttttcccagttcatagcttttaatgaaaataaacttagttttatgtcattgaatgtattgtttcctctgtagttgtgctttttgtgtattaccaaagtcttctctgacctgtgggcatgaagacagtcctcctggattttatctgaaggtgttgctttcacatttaggtctatagtccactaagaatggatttatttaggtagaatgaagtaggggtgcagtttaattttttttttcctatatggatattcatttgtccccacaccatgtgctaaaaagactgccctggctgggcgcagtggctcacgcctgtaatcccagcactttgggaggccaaggcaggtggatcacgaggtcaggagatggagaccatctggctaacacggtgaaaccctgtctgtactaaaaatacaaaaaattagccgggcatggtggcaggcacctgtagtgtagtcccagctacgcgggaggctgaggcaggagaattacatgaacccaggaggcggagcttgcagtgagccgagatagcgccactgcactccagccttggcaaccagcaagactctgtctcaaaaaaaaaaaaaaaaaaaaaaaaaaaaagactgccctgcccttgctgctccgagatgccattgtggtcataaagcaagtatctgtgaacgtgtggttctgttttggggctttctgttttgttccactggcaaaggcctggacgaattggccaaggccatagtgtcccagctcccacagctgcagaagctcctcaccttcccagcatcggaagtgctaggcctggctttctgctcgttttcgtagcttctagactcaaatttcatcaaaacacccaagactctgttatgagtttgattgaaattgcagtgaatctgtagagcaatttaggaagaattaatatctcaaaattatattggatcttccaattcaagagtatagtctattcttcatttgtttaggtctttcctaatatatttcagtaaagttttataattttagctgtaaaggtctggcacatcttctgttagatttatttctagacattttatattttaaaatttgatttaaaataccatttacacaattaccttttctgcttgtttctaatgcatgaaaatgatgcgattaatttttgtactttttttttttggtacattgacttgttaaccttattagagtctttttaattctggtaattcatgtgtaggttcatcttcttaatgtgcatatttgttttttgtgatgacaattttttcccctaattctttctagtatgtataacttttatttatttttcttacattattgcatttgataggacaggcaatacagcagtgaattgccatgatgatacagaccacccttatttcactgttaataagatgttcactgtaggtttttttagtattcccttctattcctggttggagttctcatctggattagatgttaaattgtatcaaatcctctttttaaatttaagtattttaaaaaatgaattttaatttgggaggtaactggtatcaaataccctttttgtatctattgagatgatcatgtttttctcttttaacctgataatgtgttatattgattttaaatattaaattactatttcattcctggaataaacccagcttttatacattgctacaatttgtatacacacatacacacacacacacacacacacacacgtgtatatatatattttagaatttttgcacgtatattcacaaatgagattggtccacactttgcccatactttctttttttaggttttgtttttaaggttatgctagcctcatcgaattaatttggagatgttcttttttgtttttatgctctgtcattctttgttccctggatgaccaggataacccttggtgaaatggctcatccttggtgttttcttttgtagaaagacttgaaagtacgggtttactttccatctcgtgcttttctgggatgtctcagctgcctgacacacactaaacttttgaagatttgagttttctcagtgttgcggcagctttgtcagctaaaaacagtttgatgctaaaggaagcttagcctctcatgttaatctgttatttatttgtttaacagagaagtgattgaaaagaagccagaaaagtttaaagtccagtgtttgacagacatcaaaaacctgtttttccccaacacagaacccttttatgctgcttttggaaaccgaccagctgtaagtagtagattgggtatagaagaacccttgaaatgactgccttttctggttgctgtcatctgaaagccctatccgagaaccatatgtagagtcagattctcatcccagaagcagtagcctggtgaagagccacttgcccacatctaaaggcaaggggattacaaattatcttatggcttccagggttctttgaaggttggcgggtgggtcaaagcttgagatatgggacttaaaactccaaatttcaaattactcattaaagcagtaaagcaagaacatttaatcggattagtttctttctaccagaagggaaccgcaaaatcagtcctaaccataatggcgaattcagcatctcacgttttaagtgtctagtgttgtctcgtatcatgaaagaagcgctttgagattttgcatgtattgcccgcatttactggaaagctaagtattctagagaatgtagttgggtactaactgctccatcagaaagtcctacttttgaaagttacgagagattttcatgaagtaggaatatgggtcaaagaataacctgaaggaatgttagaattgcggggacgtggtaggttgtcttttcttcaactcagtccttgaacagatgagggaattgaggcccagagagcaaaactaattgaatagtttcccatcaaaggatattctttcactgcaccactttgaggtagagctctggttaatgaaaatttgatatctcatcaaatcagaaataccatggacttgtttttacaatgaactcttttctaatgaacactttaaatcacctttaccaaatataggatgtgtattcatacaagcaagtaggagtgtctttgaatagaatatttaccgtcaaccctaaaggagagctggtacaggaacatgcaaagaccaacatctcttcgtgagtattgtacacattttatgtgattatgatatcagtactattatcttaaaacggtgcttcccagtttgcggtgtaccttttcccctttgctgcctatatgttaatctgtaattcttataatgaaaaaatgtattttaactccttgtattttgtccaaaacataatttttagacaactggaattaaatcagatcccttctgggtctaaaatttaaactcgtggttagagtctgctacagaatggaattgaatgaatttgaaaactagtagtttagatttgccaagttaggtttgaaagcctagaatgtgaatgagaaatataaccaaactgaaatatgtgaagttatatttaaagatgaggaactgtatatctcttcacataccaaatgtttcttaccagagacattgctgtgtaattgttaagaattcccttcatatttttggtcaaagcccagtttttctgagtcggtgggctaaatgggattactctttctaatgaggcatccttgtgtgcttagaatcactcttgactttatcctgtccccctcgggttcctaacttattaggatggagagcatttcctcattccatgttgttgggaggttggcccactgggtgacatcagcccaggccgacccttgtcttcctgccttgtccatttcagagactacacctcttctggtctggtctgtgcagacctggaaaagagcctctggcaggccaggcacggtggctcatgcctgtaatcccagcactttgggaggctgaggtgggtggatcacctgaggtcaggagttcgagaccagcctgaccaacatggagaaaccccgtctctcctaaaaatagaaaaattagccaggtgtggtggtgcatgcctgtaatcccagctactcaggaggctgagacaggagaatcacttgaactcgggaggcagaggttgctgtgagcccagatcgtgccattgcactccagcctgggcgacagagctagactctgtctcaaaaaacaaaagagcctctggccttagtggccccagatagcccgaggggttcctctttatctggaggagttagactgggggagtttggttctaggagattcctaaggattggttttctccatgtagcttctgtggttttagatagagagataagttctctctagggcagatttttactttcaagatggtccttaaactagttggattctaactgagtgtcaatagggcagttctaggctaacaggagtcctggggctgccccacaagactcctctcaccctgcagtcatgccagtacccaagcagtcctcaaggtttgtgcagagagaggggaggctggagccaaggccctgttccctcctgcagaaggcgaggcagtgccaggctgcttcctgattggcagaaaaacagcaggaacttgattcctttcttaacccttccttgcggtttctgccacctccactgttctaagtggctgactgtgacaatgtctcgttcccactcccctctcattccccaggctggagaggacctactgggtttctatttaggatctgtgttatagtctgttttcatgctgttaataaagacatggacccaaggctgggtaatttatacaggagaaaggatttaggctgggcacgatggctcatgcctataatcccagcactttgggaggccgaggtgggtggatcacctgaggtcaggagttcaagaccagcctgaccaacatggtgaaaccctgtctctactagaaatgccaaaaaaaaaaaaaaaaaaaaaaaattagccaggcatggcagcttgcacctgtaatccaactacttggaaggctaaggcagaagaatcacttgaacccaggagacggaggttgcagtgagccaagatcatgccactgccctccagcctgggtgacagagtgagactccatctaaaaaaaaaaaaattaaaaaaaaaaggggagacctcacaatcatggtcaaaggaggcaaggaggatcaagtcatgtcttacatggatggcagcaggcagaaagagagctcgtgcagggaaactcccccttataaaaccatcagatctcatgcgactttatcacagggacagcatgggaaagacctgcctccatgattcagttaacttccactgagtccctcccacaacacgtgggaattcaagatgagatttgggtggggacacagccaaaccatatcaggatcaaaaagaactttgaaccaatgagacgctgtccaggaatgggaaagtggcaggtcttgccatgcacgcatggaaagagggactccagcatctgagagggtttggctaggtggcctctgcggtcattgcattgactgaggctctagggttaaaatgcacacctcgcccatggcttggcctagggtggagctctgcagactttactcattgccaggggatgttgacattttacacctggactggaggcggggttgttcctgtgagagagtaaatctcctcccccaggaagctcacatttctctggcgctgaacttggtatagctatttctgagccaagtagatgcttgtcattcagaactgggacagtcatctgaaatgtcttcagaggctggggccacacagcgggagcagctcagttctttttccctttcgtttgcgagtgtctgtgcgtaagctctgcctgcttgggaggagcactgtgtgtggaggtcggtctgggggaggcgcgcagatggaactcggcctggccgctcagggagtgtgagagtgggtttggttccagtgcaccgcggccttgtagtcaagcctgcagggaggggccctgctgccgcagccacaaacctcagacaaataagccttaaagccgggaggtattttaaaaatctgtctgtttgtttgaatcccaaggaaagacataactcttggttttgtattaggagacgtcactttcccattttgtgcaagcacactgtttctcataagtcctttggaggtcctttattaaatatacacactcggcttcatttagtacattattttatacctcagaacatgcacacttctggagtctggattttggaagttcctttaggttcttagcaatttggaactagacagtgatcagtgactgtcaaggaggaatctggggatggctggcagtgggctgggtgtgccagaatctcagtttggaggtgcctggaggtctgaacatgcatattcaatatagcaatagcaactttcttttcatagtataagccacagaaactaacatgcaacatatttttgggcatgcaaataaaagagagcaagagaacgttgtaggaagcattgggaagccctgctctaattcagctccacagactataaagacgaagggctccaagagggcaagacaattgtccaaggttacagcaagcaggagagcccgggtctcttgaccgtcatgccaaccagggcttttttctctaagacgtgttgataatttgtcatttagatacatttgagcacccagtatacattattttaatgttgcatatgttattttatttaaattatccttaaaactgtggcatagtttttattttcctccctttacagtggaggaaattggcttagagaggttacgccatttgcccacgatcacgcagctagtaaatggcagagctgaacatcaaattaatgtctctttaaccccaggacccagctccttttcactatgcaatgaagcaatctctgtcaggtgctccaaagatgtgccttgtctgtgattcttcccccgatgtcccatatgtgacccctgcagcaggcgctatcccatggccatggtgacttcctcctgccgtcttttgcttggctgtatctcctttacctgtccttcaagtgaagtcaggtcccacccacctcttccccagagccttctctgatgccttgtttgcatactcttcattttcatctctcattttcaattaatcgataacaaattattctagaatgacttgagtcgtgtcgataagtaggcggtctgctccttgaggttgtagatctctcttgacttctacgtgcagccctgggtgcatagctggtatcgctcagtgccagtgacaatgtccctttccttccaggtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctgaaaatcaggtgtgtgaattttaaatagtttttggtaagttactaagttgttgacttttctggggtgtgttatcaagcatattctaaaaaaaatcttcaggctatgaattgttcactatttggaataaatgtttttcctgatgttttagatttaaatgggtaaaagaccagccttctctatgcacttgctggggacgggag

SEQ ID NO: 19 - DNA, 5334 bp, Homo sapiens
tggagagtcccagctgctgcgcctctggccgcccctcccctctcccgggcacctggcgccggctcccgcgtcctttcaggaattcacgtccgcctggaatttgcacttcaagtctggagcccccaaggaacccctcctgaccctgaacttctatctcagtttcaagcttcctagtcttccccacacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacaggtatgagctaatcttgaatgtgaactttttttgattgctagagattgccagcttaggaagtaatgttctacacctgtcatttgatttttctcttgctcaagccttaaaagagctgccaaccgcactgctgtttttcctgaaagacctggaatttcacatggttacttctaactttgccattggcttttaacattttcgtgttaatgttaattttcattttatgttaatgactctgcctatgaaatagtgtttctttattcttgtacaaataaaggtcagtactacaaccaaatttaaaatcttccgaaaagattaaaggtataagcagattcaatacttggcaaaactattaagataatagcaaaaaaaaaaaaaaaaacccacattttttacctaaaaaccttttaagtgattggttaaaatagtttggccgggtgcggtggctcacgcctgtaatcctagcactttgggaggcagaggcgggtggatcacctgaggtcaggagaccagcctggccaacatggcaaaaccccgtctctattaaaaatacaaaaattagccaagcatggtggcgggcacctgtaatcccagctactctggaggctgaggcaggagaattgcttgaactggggaggggaggcagtgagccgagatcgcaccattgcactccagcctgggtgaaaaaccgaaactccctctcaaaaataaataaataaatacagtagtttgtaaaatgattcatcggtaacatgggatgcagctattttttaatccttatatgaaaattgtatgcaggggaaaacatgtgaaatagaagataaaagacatatacctacttaaaattaggtacttatgtgaggacagggcctaagaaataataatatatattaaaaagacttggatattggtgactttttttcaacatttttctttgttacatgaattagccattaaaaaaagaaagatggtgctctacaatttcttttcagtgatctgtggtcttgtccttgtgatgagaggacctgggtgttaacttgtaaggttttatttcctttgtttggctaactcatgtctgacttcctcttcctagtgtgatttggatcatggccatttctaaagtctttgaactgggattagttgccggtgagagaccttttgttcttttgatcactctcaatttttatgtggcctaaaatacagactccatgaattgattttgtcgttaagggctgggccatcaggaatttgctcgtccatctcggggatacctggccttcagagatgacagcatttggccccaggaggagcctgcaattcggcctcggtcttcccagcgtgtgccgcccatggggatacagcacagtaagaactgcctgacttcgatgcttctgccctggcccttcatgtgtctcctgagtatctttccaacactctttcacctaaaagggcacctggttctggaactgtgcaggtgctggactgcttttggttttggaagtgagacaaggattgtgtattttacttccctagagtgcagttttcctcccctgagtccacttcacactggggaacccagaaccaccactggcctatgcatgaaaatgacttctctgctcaaaggcacagagacttactctgatacaacacattggtgttgtattaaccttcgcttacaggaattgcccttgcacttttccatccctacaccctcagtcatctgttcttacctttcaggtaaggagctaaacagaacctgctgcctgaatgggggaacctgcatgctggggtccttttgtgcctgccctccctccttctacggacggaactgtgagcacgatgtgcgcaaagagtaagcaattcagaggggcggggagccgtggagaggagagagaaagggaagtggaaatttcagacccaaggctatcgccttacctgttcattctcaggaactgtgggtctgtgccccatgacacctggctgcccaagaagtgttccctgtgtaaatgctggcacggtcagctccgctgctttcctcaggcatttctacccggctgtggtaagcggaggttctcctctttcttttgccctttgaagttacgtagttgccttggggggtgcttagttagcaggctctccttgtacctcttgtcttgctagagcctggcagccaaagttctgcttataaaagcatcgcagactcctgatgagatagttgccttggcctctttgatatttatttcctcgggaacctggctagtcctgctgcctttcagatagagatgtatttcaagtctatttgacattttatggtctgaacttctattgaggaaaataaacaagtctcggtctcttgttaaaccaagagatgttctctggtgttcctttcctttgggtagggggacccaaaccaggatgggcagctcatttagagcccaccctgacgacaaattctatcagaggcttggccccttgctagtcctttagaaacttccagagtcctaaaagtccctggtaaccccctccccataccttaccatgactggtcacagaacccttaccatgactggtcacagaaccctttcaccttcttgatttttactgatttgaggaatacaatgaaaagaagggcagcacctggagaggaaaagaggcgacagtcctctctccaccctagcctgagccaggtttctagggccccccaaattcagagacctattatagttctgggccttggagatgttagaaatggaaaatattcaagtccaggaagtaaatgaaagcaaacatttcactgagaacaggaaggaattccccaatccagacagggattgtgtctttgccatttgcatcctgggtgtcaggctcaggataggtgtttgataagtgtgggttgggtgattggatgtgtagggaacatgttctcttcctggaacatggggcccaatcagaatctaaccaggttgtgctcattcctgcaagtgaaggcatcaccactgggctaggttccaggtgtgagtgtcctgagaagagcaggttcacagtagcgtatagatatgccacatttgtgggcagcaggatgaactgccagagaggtttgctttaatgaccaagcatccctaccttccagatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtata

SEQ ID NO: 20 - DNA, 8757 bp, Homo sapiens
tgtatgtgtgtgtgtgtgtgtgtgtgtgcgcgtgtgatgtttattcactcatttatttattcattcattcattccacaaatatctacccagaccctcttggcactgcaccaggtgctaggggtagaacagtaacctggaaagatgaggcaaatggttgatttcagattcaaggctttggactccagctgttctgtcatccagctcaggcaggccctcataatcgcttcaatcagggagaacacaggagagtttctctggggtgtcggcagctcagaggagacccaaatactaggagacccctttttcccatgcttcccagtcctccagtttatttcccccaggagggagggagacaagacccaggagtcagggttgtagtggctgggcggcccaggcaagtctgcttgttacaggcacttgtgccaggacaggatttcttccagtttcatattcactgaactgccttttcctgggtttctgggggtggtgctggagtgggctccagggttggaacgggcccttgggtggcggcagctctctgctgcccccacctgagtcctgcccggaggtggcaggtgacgggttaggcccagccccctctgggcctagccactcaggtacgaggcctttcccccccatcccccggggctgggatctcttttataaaaggccattcctgagagctctcctcaccaagaagcagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtgagggtcccccctgcgtggctgactgtgcccgcagcccctttctcctggtagtcccggtccctatgcacatctccagcccccagctggcgtcctgctgggcctcacccgccctggcgacactctcccttccatcctccgactcacccctcccgtgcaccttggtttgggctgggtgagggtggggagagggtctggacagccgggatgaatcctggggcttccttcttcccttttaaactggagggtcttggaagagagagacaacttaagggtacagcctagttcccaccacccctctctacaaatcccgttcttcctcaggtcattctgtccccaaattataaaaaataatagcggttattgttctcaccccaacccgagttctgaccgtcttttaagctatcgccctgcggcagtcccagctgttcggggactaccctcctccaggttcgcctcttcgccagcactaccccaagggctccccagtggtgcctttgtgattttttttctttcttttcttttttttacataggggtttggtgtgattctagcattctaggagaaggaagtgggtgtctcggttcaaacgggcaaatattgattgaggcctttggcgcccggaggcctgagtgcgggggtcacagaatgagtcataccccggcccctgcgccggcagcgtgggcggggccgagggcggggtgaggggctgcgggcagcagtctcgggacgctctcctccacctggcggagctcggcgtcgggggcggtgtgggtggggtggggtggggtggggtgggctggggtggggtggaggaggcgccagggcctggcctcggaaagcccatgcaggattcaaagtctgcgggcgtgggacgccccgcccggggtttacgtcctgttaagtttatggcttcagataacgcggtcgcccaccaacgcccctcgcccattcagcccgtgtccctttctcgcgtcctgtccctgctccgccccagcggcctggctccactttcacacagcaggagccaggccgggttttgcagccctgggactccgctgcctgaggggccccgggcccccggcggccccgaggattgggcccttcacgctgactggctcctgggaggcattgtgggaacgggaggagggaaatcctggggcagagtaagccgggaggaaccggagccccaggaacccagtggtcgggggcccttggcgctccaagcgcctggacttgacttgttgactgcgttttgctagccctggggtccttatagagagcagctaagcataggctttggaatctgaattcttggttcgcactgctctgccggttcctggttatggactcccttgccaagtcttatttcctcatctataaaatgaatatgagagcccctaaatccatataggcaaaagtttttgcctattcaaacttacatatgtaaagagttcagcagtgcttggcccacattccattaggataagatgttataatcacttttttttaaaaaataattttggggcagaatgacctggggaagaaagcgatttgcagagagtggtggagggaactaggctgtacccttaaaagatttctgtcccctccagtttagaaggagttacaagtttttttgtttgtttgagacagagtctcactctgtcgcccaggctggagtgcagtggtgtgatctcagctcactgcaacctccgcttcctgggttcaagcgattctcctgcctcagcctcccgagtagctgggactacaagtgcgtgccaccatgcccggttaatttttgtattatttgtagggacagggtttcaatatgttggccaggctggtctcgaactcctgacttcaagaaatccgcctgccttggccacccaaagtgctgggattacaagcgtgagcctccacgcccggcctctttttcaatcttaacatctttagaaaggttggctatttttggccgggcgcggtggcttacgcctataatcccagcactttgggaggccaaggcgggccaatcacaaggtcaggagttcgagaccatcctgcctaagacggtgaaaccctgtctctactaaaaatacaaaaaaattagtggggcgtggtggcaggcaggtgcctgtagccccagctactcgggaggctgaggcaggggcaggagaatggcatgaacttgggaggcggagcttgcagtgagctgagatcttgccactgcactccagcctgggcgccggagactcccaaagaaagcttggctatttttattgatgtgtaatatacaacctatgtaaatgaagttaggcctattggtttgcaaatgcagctttaacataattaccttacctgtctccttcccctacccaatgctgagggacattgctccccacctcaccatcatgccatgctttctccccctggtcataggtgatctttccagaacagctaaccaggtgcctggggtctggagaccttactgcttgaggagtgaattaagagaaaagactgcttgctttcctccagactttgagccctggcctgatgtagacctttttgctctctcctccttcgtataggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtgagcaactcccaccctccacccaactgaagtcaccgtgctctcctccaccccttgggaccttgggactaagtccccatggccctctgttgtgggaagtgcagtcctatctaattagggtgaccacctgatgaggtttgctcggaacagtctgtgtttatgcccaggttcctagcacaattgttgatagtacccaccccctttcaatctcaactgtctggatttgaagaacaaattatgtgtcaatgttgacatggtaaacctgagacgggagagataggcagcctgtgggcctcacttttgtacttaacattctggcccctctttagtcttgacccttgacctctagcaaactctagaaagttctgtctgaggtctcatgtcaggccctgctgttaacactctcaaggtgtccaatccgatgtgtattcatggatttggagagagatttcctgcttcccacgggctaagggaggggtgagggtggagagggcagctggggaaggcagaaggaccagccttctcatatcctgcatctctgtgaactgaattttcctgattttcacaacgcccctgtctcccaaaagaccaagggcaacctcccttttgccttcatcctctaattgtaagtcttttcctcacaggtatgaggatgagatcaataagcgtacagagatggagaacgaatttgtcctcatcaagaaggtgagggagtctcccttctcctatctggacactggaggctggggctcagagactcagaccaagaagctttctgggttttgtccctaaatattcctaagtagtgggacaaactcatttatgtaaacatttgggtgcacagaaaggtagacaaggatggagtggtaggtgcatttggacagaactcttgacatcggtgttgggacatggttcagaaaacagagcagtagaactggagatctggctctagaaggctccctagagaaggaggtggaagagggtgtgttgcaggaagcagaggtgaaggtgtgtgggctgagaatgcacatgtgatgggcagaggctgggctggaagatcaatccacaaagtgggcaactagaaagtcctgtgaccaggccattgggtggaccttgggagccccttggttggggttgggtgtggaaacccagctcaggctcccctctcctcatcccccaggatgtggatgaagcttacatgaacaaggtagagctggagtctcgcctggaagggctgaccgacgagatcaacttcctcaggcagctatatgaagaggtatgttcctggtcgcaggagagtgagggtcccccagccttgtcagcgcctccaccctgagactcaaccagaggctcctcccagcccccagcacactaataagacaaaggcccactgctgactaattacagccaccaatatttgctcggctagtatttattgggtctatatgttctgtccctcgcatgagggatgagtcattaccccatttcacagacgagaaagtgggctcagagaagtgaaataacgtatccaaggtcatcatagggtgtggtgattcagcagcaactctgtccccaaagcccttgttcctaatctttgagctgcattggatccctctgtgcacctagtattggtgcacccagttcctttttcaggaactttgccctctccctgaccctgactcccacctgctcctctcctctgctgcccctgtcttataccctaagaaaggctgttgtggaaaagggggctccctgtgtgcagagacagggcctcaccacttgccctcttcccccacaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccaggtatgggccgggttgggggtgggaggggttccttggacacatcctggtgagaggagataatgtaggaagagtgaagtttctgggagtcggggaaggaatcctagaccagggttcaggagttggaggggcagccacagttcagcttctcagtctgcttctgagaagcaaagggatgcagggaaggtcccttgggccaggacagaggtgaaaggggactggggcaggtatgttggggctcgtgatacatgctcccaagcctgctttaatcagtcatatgcatcagggtaaggttgagctctgctgctttaaggaaagtctagaacccagggatctagtccagttagggtagggggaccttacagtgtcgcaggtgagaagggtgtggaggggaagcacctggaaactgctcatgtctccctgatctgcttccttagtctcgtttatttatttatttatttttgagacagagtcttgctctgtcgcccaggctggagtgcagtggcgtgatctcggctcactgcaagctccgcctcctgggttcacactattctcctgactcagcctcctgagtagctgggactacaggcgcccgccaccaggctggctaattttttttgtatttttactagagacggggtttcactgtgttagccaggatggcctcgatctcctgaccttgtgatctgcccgcctcggcctcccaaagtgctgggattacaggcatgagccactgtgcccggcccttagtctcatttaatttgagctggggggagtcagcctaggtggtggtggggaggaccctgagggagggtgggagcacgggagaagagaaggcatacccaacctgacctacttacctgtcccctaccccacagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggtgggtgtgggtacctctgaccggacctgcttccctatccctgggacctggggtggggacggtgggagccccctgaagccccttgggacttggggtcctgttgttctgggccaagaagggctaggagttggtcctgacaccccatttgtctgggtacaggctggagtctgggatgcagaacatgagtattcatacgaagaccaccagcggctatgcaggtgggtgtcccagggccctgggatgagggcgggaggcagggcccagggaggcctcagctccagggagggggctgtgctcagtcgctcacagtgacctcagcctgagcactcatgttcttgggagaatcctagggtggggaggcacatattcaggaccccagtaataactttattacttagtaactttactattagaaagcacccaaataaaccatagctgtgtgccaggcactgtgctaagtatcctacaggttttatgtgatttattttatttattaatttaatttaatttttttgagacgaagtctcgctctgtcacccaagctggagtgcagtggcgtgatctcagctcactgtaacctccacctcctgggttcaagagattctcctgcctcaggcctcccaagtagctgggactacaggcgcataccaccatgcccagctaatttttgtatttttagtagagacggggtttcactgtgttgggcaggctggtctcgaactcctgaccttgtgatcagtgctgggattacaggcatgagacactgggcctggctgtaatttattttttatatgacacctgtaaacgtcttcagttgaggaagctgaggtgcagctaaatgtccaaggtcacacagctatatatatggcagctgttttccaccctgctcctggttttccctgacagttctggagtagtgaaccatgcaatcactgatcaggcagagctgggttaacctcccatccctggggctatgttgggaatgagcagggagaaggggcatggagcctgccatggggtgggcttctgtactcatgtggctacctctgtccctcaccaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaatgtccttgcttgtgtgtgcatctgatgtccactggggtgggagggaggtggtcaggaggcctcttcttgggactgagaagctgggaggggtccaggaagcagggggtgcacagcgggaaagtctgaccccctcagctgttcctaaagaggctcctttattgaaacctggttgaaaccttgcttgttgccatagatatc

SEQ ID NO: 21 - DNA, 32123 bp, Homo sapiens
  misc_feature (12425)..(12425): n is a, c, g, or t
  misc_feature (12661)..(12661): n is a, c, g, or t
gcaggtttggagggtggtagtatgcaggtggtatgcatagttggggatgtgtgttgagtttgctatgtccggtgagcttcccagtggagatgtccaatgggcagacggatactcacatagagagttcatggtagattcgggctagaggaaagcacctgaggcctggccagagacgcctagaggaacagagcctggttaacagtcactcctggtgtctcagatattctctgctcagcccacgccctctcttccacactgggccacctataaagcctccacagatacccctggggcacccactggacacatgccctcagggccccagagcaaggagctgtttgtgggcttaccactgctgttcccatatgcccccaactgcctcccacttctttccccacagcctggtcagacatggcgctaccactaatggaatctttcttgccatctttttcttgccgcttaacagtggcagtgacagtttgactcctgatttaagcctgattctgcttaactttttcccttgactttggcattttcactttgacatgttccctgagagcctggggggtggggaacccagctccagctggtgacgtttggggccggcccaggcctagggtgtggaggagccttgccatcgggcttcctgtctctcttcatttaagcacgactctgcagaaggaacaaagcaccctccccactgggctcctggttgcagagctccaagtcctcacacagatacgcctgtttgagaagcagcgggcaagaaagacgcaagcccagaggtaaggtggtcagactcggcttccttccccggagctgagagggaggggaacgtggggcagatgcacaggaatgtgctctgcccagttgtctgcccacagctctggccaccttctcttgcatttctcttggaactggtcatgagcagcgatttcccactggaactgtgagcttccagaggtcagagactgtgctagactcctctctgcagccccagcgtgcacagctcagtgtccagagcaatgggtgctccttagaggagtagtgacctaaatagcaagatcagagagggagtgaagactggagactatcccaggctgggaaaggcgtggaaggcaactagtcgtgggcagttgaggggagaagactggaagaggggaaaagaggagaaaaagagtgaagaaggggagggaaaaaattagaaagaataaataaatataaggtgggaggaaacctataaaaaagaaatgatgaggaaaaacataaaaacaagaaaaagagcaaaagaagtggaatctagtctagagaaaattcttgcaaaaccaattttccttaacgggacaatctccaaaaattgacaccaaatatcatacttgcagcatttcataagtcgcatgatctatgtaatagtctcttttaactaccttttgtgtttctgtgtgtatttttaaatttttgtctgcttctttgctcttttaagatttttgaacaatgtctaaaggcacttctactctagttagctttaaaatgattcatgaaataggaaagctaaaattctcagaaagtgttgaaactgagcttttgcgtatgaattgccctaaaagttgcagatacatatctttagataaatatgtcatttaagaaacggattcgaaaagaattggtggtaggggtctcatgaggccgggagagttacagaaggatgtgcagcccctcctgggcctggcagggtgtgagggagagtgaggactcactgtccctcctgaagggaagccctgtgccatctcagcctttccgccctcagacctttccagcccctgagacctcatggccttgaagccgtgctatccccagtgtcctctgctttcccctcataggcttcttctgggagagaggtttcctggggtacgttctgatccctcaaaacggaaaggccctgttctcaataattcaaagatttcactctgagtgggatagtgcttcctgaatgccctgctcttgtggtggacatttttatcggggcaaggctaagagcagggcctgatgggggaagtcactgctacttcacattttgaccaataattccttgtgctgtatcagatgctgtaggctgatacaaaatggccgccgccctcaaagtcagatgaaagagcccctgaggacagcgttagagacactcgggagatgatttccctctttcaatgtgggagcacttacataggagaggtctatatctagataaaaactcctcccaccactggtgctagacagagcttgggggcagccctaggctctgaccctggccgtaatggcggggtggtgctgagggcaattggctagaccaattgtcttgcacgttttattttttattattatttttgagacggagtctcgctctcttgcccaggctggagtgcaatgacgtgatctccactcactgcagcctccacctcctgggttcaagcgattctcctgcctcagcctcttgagtagctgggattacaggagcccaacaccacgcccggctactttttgtatttttagtagagaccaggtttcactatgttggacaggctggcctcaaactcctggcctcaaatgatccgcccgccttggcctcccaaagtgctggcattacagacgtgagccaccatactgggccagtcttgcacattttagacactcaataaatgtttgttgaatgaaatacctgtgatgggccgggcgtggtggcccacaccagtaatcccagccctttgagaggccgaggcaggaggatggcttgaacctgggagtttgagaccagcctgggcaacatggtgaaacccccatctctacaaaccccacaaaagttagctgggcatggtagtgtgtgcctgtggttccagctacttgggaagctgaggtgggaggattgcttgagcctgggagacggaggctgcagtgaggcctgactgtgccactgcactccagcctgggcgagagtgaggccctgtctcaaaataactttgatgaaggtggggaatcagaagtaggtgggcaggggtctgggtttgcaaggctctgagtttgagctctgttctgtacctttgaggggatgagggaaggagggtgggcacggttcccccgatgtgggtgtctgaggcgaagaagaggatggcggaggttgcagccaccaaccacaagagttccttagaggggtcacagtctctaggaagtttataggaagctagtcagcagtagagagggtgaacgcggtggggcacatcccgcggctgggcttgagtgggctgcttgggggttatggggagaagataaaagtgcctgtgggaccacagactctcgctgtggtggagctgggccctcttaccctcccaagcctcgcccctcatcccatccctgggggccaggggtgagggcggcaggaacctcaaggctctgagaaagtgcgtggtgtgtgttgccattttggtctcttctctttctcagtctctctttgcctcactttggatctatgctctgtgcatctgtcttgcttctcagaatttcttcttttcctctttttttgtactaccctgcgctttgtgtgtgattgtggattgtgtgtgcatagctgttgctttaacaagctgctccaggtctctctctcccacatctttccctcccctcctcccttgaggctctgtgcattctggggaactctgtccatttccctttgtccatgtgtccctcccaccctgcagccggctccctcacatccaccctgggctgcaggcgtgctcggcaggctccccacagatcaaagcttgtccagggtctgcattgctgccaaaggccaggaggactgtgtacagaccggaaggagctagagcttagtggcagcctgagaggggaagctgaaaaaggagaagaggcaaggggcattccaggggagcccgggagagccagcacggccgcctggtatatgaggcaaagaggaagacagacacagacacagggagctgcaggctgggggcataagctgggggctgggaagcatagatacagaaatgcacagatgtgagctgagaagcaaggagggagagagagagacagaaagagagagagagacgtgccagggcttgagggaccagagagccctcccagcctctctcggagtgctggtatacaggatgctaccgtactagggtaagacacctctgggggcgctgagtatgggaatcaaaggccagatctctggggtggcagcggaagcccaaagcaccaaagcaagcatgctggaaacccacagcctcctccacttagcagagccttggggtgagatgaggcagaacagggagctggaggcagggaggtggctgtctgcacatacctcaggaccatggagctgggggagtcaaaacagccaccatatggggaagggtcaagaatgcctctagtcttccccaggcatcttatcagggtaagctgaatttggaccccagagaagggatatcgtttatggagacttcccctctttcatcccctgctcaccaaggacccagtcagtctgggatgggggacagtgggaaccactctttggtatgaggctactcctattctactcttctcactgcagccttcccctagatgcctcccatctgcatgctaacctgtaaacacttcaccatcactggtggctagtctcccttcctcctttttcagaaacctccttcctgacctcttttcttcctacttccccggtttaaacaaaattgtatctatctatcatctatctatctatctatctatctatctatctatctatctatctatctatctatcttttttttttttgagacaaaatctcactctgtcgcccaggctgtagtgcagtggcactacaagtaatcccaagtagctgagattacaggcgcccgccaccatccccagctaatttttttgtatttttagtagacacgggggtttcatgatgttggccaggctggtctcaaactcctggcctcaagtgatctgcctgcctcggcctcccaaggtgctggattataggtatgagccaccacacacgacacccggcttctatctatctatatctatctatctatctatctatctatctatctatcacctatctatctaatctatctatatctgtctatctatctttatgtatctatcttatctattgatctatctatctttttttttttttgagacagagtcactctgtcacccaggctggagtgcagtggcacgatctcggctcactgcaacctccgcctcccgggttcaagcgattctcctacctcagcctcctcagtagctgggactacccaccaccactcctggctaatttttgtattttcagtagagatagggtttcactatgttggccaggctggtctccaactcctgacctaaagtgatccacccaccttggtttcccaaagtgctgggattacaggcgtgagccaccgtgcctggacatatatctatcttttttttttttgagatggagtctcgctctgttgcccaggctggagtgcagtggcgtgatttcggctcactgcaacctccgcctcccgggttcaagtgattctcctgcctcagcctcccaagtagctgagattacagacgtgcgtcaccatgcccagctaatttttgtatttttagtagagatgggatttcactatgttggccaggctggtctcgtactcccgacctcaggtgatccacttgccttggcctcccaaagtgctggaattacaggtgtgagccactgcatccggccttatatatctatcttgtctgtctgactgtctaatctaattcatctattttatctgtttatcttatctatcatctatttatctaatctatctgtctgtatgtctgttttttttttgttttttttttttttttgagatagagtcttgctctgtcgccgaggctggagtgcggtggcgcgatctcagctcactgctgaacctccgcctcctgggttctaagcgattctcctgcctcaatctttggagtagctgggattacaggcccgtaccactgtgcccggctaattttgtatttttagtagagaagggtttcaccatgttggtcaggcttgtattgaactcctgacctcaggtgatctacccgcctaagcctcccaaagtgctgggagtacaggtgtgagccactgtgtctgtccctaaatgtctgtctctatctatctatctatctatctatctatctatctatctaatctatctttctgtctaacctaatctattttatctatcttattcatcatctatctaatctgtctgtatgtttatctaatctatttacctaatctatcaatctatcatctaatctatctaatctgtctatctaatctattttatctatctatctatctgtccatccatctatctacctacctgtctatctcaagcacctaccacgtattaagccctggctacctcctcttccaggcagatggagtaactggaggcagctaacaaagatggagtcacttttcttatcttctcctaaaccaccgtaagaggaccaagcccccacaccttctgagtgccccattcctctccacagattgtgtcttagtgcccagcaggaaacacagtccacctcccatggttcaagagattgtagaaagggggttattcacataggttaagggaatcaatcaatttgaagcacagacactattaacagcaggaagagtcctgaagaagtgaaaatggtgtttctggaacccagagagtgcttgcactctggataaggggccaccccacagaagctgtggaggggcagggctgcaggtgaggatgaacacacagctattgacagaaaatatgcccagggcagggatagagtaggaaaaatatcccagcttctttcccccacccttccatctcatctctgaaaggcacttcccactggccagccccgactggtgctggagggcaagagagcctatgagccatgtgtggctgtcagccccttggtggagagccacagacaggatggagagtggctggcagggccccgtggggatgaacagcttggattggggcgactgggcttcatccaggctgggctggatgtgtgcatacatttcagtgacccgttttagaaacagaattaatatggtgaatagagaaagaagaaatcagtgactttcgctcctccatacaattcaatttggcttaagttagccaaagccataccaagtcctctctctatgtctcagctgctgccaggcttgtggtggccacacagctggctagactgtcatctctgtcctcaaggggctcaagctagaggaggagagttgagaaaccaaatcactatacacaaagtagaaggtggaacacacccaggagcatgtcaacggggtgctgtgggacttcagagtaggcagatcgtcaccaagcttcaacggcaaagatgccactgggggaaagaaggaccaagcttggaagacagagtaagtctggaggcaagatcttgtctcaccagcaggggccaggtccatggtgacaccttccccaggcagtcacctctctgagcccactttatatcctaggcctggattcaaagacacttgagccctgctccagccttcctttgaggtgctatcttggtgcctttcctataatcactgctccagtcccatgtcatctggtccccagttaccacatcaagcttcccgaagctccacacagaccatgccacatctttaccaaaaaatcagcagtgggtcccctcacctccaggacaaagctccagctcttcgacctgcctgtcaatatttgcaatcactgcctgcacaaattagctgggtgttgtcatgaaaggatcacttgagcccaggagttccaggctgcaatgacctatgattgaaccactgcactctggcctgggtgacagagtggatctaaactaaaaataaaaagatttacagtcaagcctcaaaggcttttcccataccttcttccaccatcacctccctgagccctctctttcctccgaagcctcctcgcacatccctaccacctttgcacacctcagaatggggacacctctcccctttcctctccatctaacttatggttttcaaacttgagcgtgatcagttacctggagatttgtgaaaacccagatgactagacccacccccagtttctgattcagcaggtctggggtggggccgaggatctgcatttctaacaagttcccaggtcatgttgccgctgctactgatccaggactttgggaatcgctcctctaatctacagctgtccattccccatggtccattcagagcctctctgccctgcccccaccacccccagtctcgcctgtctgccaagcgcacaggaaactctccttcatccaaaccctggaccaacgccttctgcttggcccactcagaggccttgtagggttggtctgatattggacagagaaatggccctctgctctttctcccctgacctctctgaagggggcctgcccctccacacctgtgggtatttctcgcaaggtggagacaagagactgagaaaagaaataagacacagagaaagtatagaggaataaaagtgggcccaggggaccggcgctcagcaagtgaggacctgcaccggtgctggtctctgagttccctcagtatttattgatcactatctttactatctccgcgaggggaatgtggtggggctatagggtgaaggtgaggagagggtcagcagaaaaacatatgagcaaagactctgtgtcataaataagtttaaggaaaggtgctgtgcctggatgtgctagatttatgtttaactttacacaaacatctcagtgtagtaaagagtaacagagcagtattgccgccatgatgtctcgcctccagacataaggcagttttctcctctctcaaaatagaatgtatgatcggttttacaccgggtcattccattcccagggacgagcaggagacagatgccttcctcttatctcaaccgaatagaggccttcctccttcactaatcctcctcagcacagaccctttacgggtgtcgggctggggggctgtaaggtctttcccttcccatgaggccatatctcaggctgtctcagtggggggaaacctggacaatacctaggctttctcgggcaggggttcctgcggccttccacagtgtattgtgtctctggttaatagagaacggagaatggtgatgactttcaccaagcacactgcctgcaagaacttttctttttttttttttttgagacagagtcttgctctgtcgcccaggctggagtgcagtggcgcgatctcggctcactgccacctctgcctcccgggttcacgccattctcctgcctcagcctcccgagtagctgggactacaggcgcccgccaccacgcccggctaatttttttgtatttttttagtagagatggggtttcaccgtgttcaccaggatggtctcgatctcctgacctcatgatccgcccgccttggcctcccaaaatgctgggattacacgtgtgaggcaagaactttttaaaagtgcatcttgcgcagccctagatccattaaaccttgattcaatacaggacatgtttttgtgagcacagggttgggacaaaagttacagattaacagcatctcaaagcagaacaatttttcttagtacagatcaaaatggagtttcttatgtcttcctttttctacatagacacagtaacaatctgatctctctttcttttccccatacctctcacgctgtatcaggccccaattcttgggaacgtcaccttagaactgtcccacacatttctacagccacttggctcaggccctttgctgaccaggatggttgcagttctgcctttggtgcctcgcctcctccagttctttcactcagcagctgcaggggtccacgtggcaaatctaataatcttcttctctatagaaaatcctctgctggctctctagtgcccaggatccagtcccagcatctcagcacggccttcaagcatttccacgtcctggcctggctccatggtctccccgccaatttgccaccttctccatgcatccttttctgatcccctcctcactcatcccagcaaagaaccccctcctggcctgagcatagcatttcgtggtgtgtatctcagagcatccagttaggggtgtgcaagtttactttgttactggctgatgttgtgaagtcccaagttgttggtgccgcaaacaaaaaattggacatgacacacacaaatagcaaagcagcaaaagtttattaagcacagtacgatccactatggatcaaggatgacctgcgaatggtatcagcatcactttgctatatttcatggccttttctatgtgttttttttctctttttcctcaagctgcctaagctttagccagcatgtgccttttggttgacaggtgggttgcttagtttcttggcctctgtgtgtttacgtgtcatttccttcccatagttttaagtacatgcatgatatgcactctgtaggcatgaaccttaagtagctaattactatacggggtcattttgaggatatcttttctctgtagtacatgtgcatctttttttgcagtggtgcaatcttggctcactgcaacctcctcctccctggttcaagtgattctcctgcctcagcttcctaagcacctgagactacaggtgcatgccaccacgcccggctaatttttgtatttttagtagagatggggtttcaccatgttggccaggctgatctcgaactcctgaccgcaagtgatccacccacctcggcctcccaaagcactgggattacaggcatgagccaccgcacccagcctagtatatgcccatctcttaggagctgctcctaactggtttggtttggatctagccagccatggggctccttattcacttatttatcttctgtttttgctcacctgcctctttctcttgcttctgctcctactcattccttccttaatccaacctccaattccctctgctattctcctgcctcaagttcactaggctggctgcaagggtcctgagggagaggttgtgtatcgcccctgtatactccaggtccagtaaatgtttgctgactaatgattggcatttccctcaggccctgccatttctgtgggctcaggtccctactggctcaggcccctgcctccctcggcaaggccacaatgaaccggggagtcccttttaggcacttgcttctggtgctgcaactgggtaagttctcagacctggggtctcaatgcagatgacgtgggaggaaaggcaaaggtggaggatggggtagagggggacagcggcgacattgagacctgactcctttcttttccacttagcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtagggttgcctggctccccatccagggaggaaaacacactatggagtgaaagcctttggtgtctgagatctggtcttagttaaactctgggatcccagagggcttgggttgacagaaactcagtggcattcttatccagagtttctctacaccaactgctggtggcccagggaaaggtggtatgtgaatttcaatattttaatatttaatattcatgaacttattttagtgagttttagaacaatcactatcacttaaaacccgtgatttcttgagtattgttgctacagacctatgtagataatactttgcacagtgactcatatgtataatcctagcactgtgggaggctgaggccggaggattgcttgagtccaggagttcaagaccagcctgaacaacatagtgagactctgtctctatgaaaaaaaatatatatatattttttttggagacaaggtctagttctatcacccaggctccagtgcagtggtgtgatctcggctcactgcaatctccacctcccaggctcaagtcatcatcccacctcagcctcccaagtagctgggactacaggcatgcaccaccatgccaggctaatttttgtattttttatagagacagggtttcaccatgttggccaggctggtctcgaactcatgagctcaagtgatccactcaccttggcctctcagagtgctggaattacaggtgtgtgtcactatgcctagccaaaaaaaatttttttaattaaaaaaaaaaaggccggctgtagtggctcacacctgtaatccagaactttgggagtttgaggtgggcagatcaccggnggtcaggagttcaagaccagtctggccaacatggtgaaacccggtctctactaaaaatacaaaaattagccaggtgtgggggtgcagtcctgtacttccagctactcaggaggctgaggcaggagactcgcttgaacctgggaggcaaaggctgcagtgagctgagattgcaccactgcactccagcctgggtgacagagcaagacttcatctcaaaaaaaaaaaaaaagctgcanatttattattattattattagtttatttatttatttttttgagacagagtctcgttctgtcgcccaggctggagtgcggtggcgtgatcttggctcattgcaacctccacctcccgggttcaagtgattctcctgcctcagcctcccgagtagctgggactacaggcgtatgccaccatgcctggctaattttttgtacttttagtagagacagagtttcacggtgttagccaggctggtcttgatctcctgacctcgtgatttaccctccttggcctcccaaagtgctgggattacaggcgtgagtcactgtgcccggcccagaatcatttttttctacttttttttttttgaggcaaactctcgatctgttgcccaggctggagtgcagtgggcatgatcttggctcactgcaagctctgcctcccaggttcaagcaattctcctgcctcagcctcctgagtagctgggactacaggcgtgtgccaccatgcccggctaatttgcgtatttttagtagagaccggttttcatcatattggccaggctggtcttgaactcctgacctcaagtgattctcccaccttagcctcccaaagtgctgggattacaggcatgagctactgcacttggccttttctcctggttttaaaactattatatgctcattacaaaatatttggtcaatgaagaaaagaatatggaagaaaatcaaatgcatgcatacttctatcactcagagatatcctctgctaacattttgattgattttcttccaatctttttttttttttttctttttgagacagggtctcactctgctgcccaggctggagtacagtggcatgaccacaacacatcacagcctcaagtgatcttcccacttcagccttcccagtagctgggactacaggtgcacgccaccatgttcacctaattttttactttttgtagagatgagacttcaccatgttgctcaggctggtcttgaattcctaggctcaagtgatcttcccgctttggcctcccaaagtgctgggattataggtatgagccactgcatgtggcctattttcttccactgttgttcggcgtggagaatattatatacataattacgtaaatgatatcatactgtatataccttttttcctactccttccttaagttatatcataatgagactaccaattattagactttttttcttttttttgagacggagtctcggtctgtcacctaggctggagtgcaatggcgcgatctcagctcgctgcaacctctgcctcccaggttcaagcaattctgcctcagcctcccgagtagctgggactacagacacgtgccaccatgcccagctaacttttttatttttttattagagacagggttccaccatgctagcaggatggtctcaatctctcgacttcgtgatcagcccggcttggcctcccaaagtgctgggagtacaggtgtgagccaccgcactcggcctagactaactatttaaagtaatctggcaatgtttaacgaatacaaaactctaaaacccttggacctaataatagctattttggaaagtctacttgacagaaataaaattgtgaatattcttttttgttgtttttttgagacagagtctcatttggacgcctaggctggagtgcagtggcatgatctcggctaactgcaacctccacctcctgggttcaagtgattctcctgcctcagcctcctgagcagctgggattacaggtgtgcaccaccatgtctggctaatttttgcatttttagtagatggggtttcaccatgttgaccagggtggtctggaacttctaccctcaagtgatctacccaccttggcctcccaaagtgctgggattacaggtgtgagccaccacgcctgaccagtgaacacttaataatatctatggaaaggtgttattataagaattgcttgtggggccgggcgtggtggctcacgcctgtaatcccagcactttgggaggctgtggcaggcggatcacgaggtcaggagatcaagatcatcctggctaacacggtgaaaccccgtctctactaaaaataccaaaaaattagccaggcgtggtggcgggcacttgtaatcccagctatccaggaggctgaggcaggagaattgcgtgaacccaggaggcggaggtcgcagtgagctgagaccgtgccattgcactccagcctgagtgacagagtgagactccatcacaaaaaataaataaataaataaataaaatataaataagtaaataaaggtcaggagtggtggctcacgcctgtaatcccagcactttgggaggccgaggtggacagatcatgaggtcatgagatcaagaccatcctggctaacacagtgaaaccctgcctctactaaaaatacaaaaagtcatccaggtgtggtggcacacacctatagtcccagctacttgggaggctgaggcaggagaatcacttgaacccaggaggcagaggttgcagtgagctgagatcgcgccactacactccagcctaggcgacagagcaagactctgtctcaaaataaataaataaataaataaataaataaataaataaataaaataaaaagcacacacacacacacacacacacacacacaatgcaaaagacccaccctactacaactaacattatatttaatggtgaaaaactgaattctttctccctaagtgcaggaataagacaaagatgtctgctcttactactcttattcaacataatactgcaatcccttgccagtgcaataaggcaagaaaaatgaaataaaaggaaaactgatcagaaagaaagaaataaaactgttcctatttgtggatgacatgattacatagaaaatctcaaagaatctgtaagaaacttcttagaattaataaatgaattcatcaaggttgcagaatataagataaacataaaaaatctattgtatttctatatattagcaaggaacatgtgtacacagaaattaaaactacaataccatttataattgctcaaaaaggccaggcatggtggctcacacctgtaattcctgcactttgggaggccaaggtgggaagattgcttaagcccaggagttcaagaccagcccgggcaacatagtgagaccttgtctctacaaaaagtaaaaaattagctgagcatggccgggtgcagtggctcactcctgtaaccccaacactttgggaggctgaggcgggcggatcatgaggtcaggagatcgagaccatcctggctaacacggtgaaaccctgtctctactaaaaacacaaaaaattagctggatgtggtggcaggcgcctgtagacccagctactcgggaagctgaggcaggagaatggcgtgaacctgggaggcggagcttgcagtgagctgagattgtgccactgcactccagcctgggtgacacagtgagactacgtctcaaaaaaaaaaaaaaaaaaattagctgagcattatggtgtatgcctgtagtcccagctactggggaggctgaggtgggaggattgcttgagccctaggagggcaaggctgcagtgagccatgatcacaccactgctttccagcctcggtaggagagcaagaccctatctcaaaaaaaaaaaaaaaaaaaaaagaaaagaaaagaaaagaaaagaaaaagaaagagagaaagaaatacttaggtgtaaatctaaaaaacatgcgtagggccaggtgcagtggctcatgcctgtaatcccagcactttgggaagttgaggctggcggatcacttgaagtcgggagtttgagaccagcctggccaacatggtgaaaccccgtctctactaaaaatgcaaaaattaggcaggtgttgtggcgcatgcctgatcccagctactttggaggctgaggcaggagaattgcttcaacccgggaggcagaggttgcagtgagccaagactgttccactgcactccagcctgggcaacagagtaagagtctgtctcccgaaaaaaaaaaaaagaaaaaagaaagcattgaattgtatgctaaaaactacacgatgctgattaaagaagtcaaagaagatctaaatatatggagagacatgctgtactcatggattgatggattggaagactcaacataagacagatatcaattttccccaaattaatatacaagtttaatccaattcctataaaaataccagcaagattttttgtagatataaacaagttggccaggtgtagtggcttacacctgtaatcctagcactttgggaggctgaggtgggaagatcgcttgagcccaggtgttcacgactgcagtgagctatgattgtgtcactgcattccagctggcactccagcctaagtgacaaagggagaccctgtctcaaaaacaaaaacaaaaccaaaataattttgctctgcaaaatccctattaagaagaagaaaagaggctgggcacagtggctcaccgctgtaatcccagcacgttgggaggctgaggcaggctgatcacttcagcccagaagtttgagatcagcctgggcaacatgaggaaaccccgtctctaccaaaaaaaaaaaaaggtacatacacacacacacacacacacacacacatacacaagtatatacacatatatatacacatacaggtgaatagatgtatatacatctatttattgtgaatatacatctatacacacacgtgtgtgtacacatatatttaaaatttatttttatttatttatttatttttgagacagagtcttgctctgtcacccaggctgggtgcacctgtattcccaacgacacaggaggctgaggtgggagaatcactgagccagggaggcagaggttgcagtgagccaagatgttgcctggttgcctgggcaacagagcgagaccctatatcaaaaaagaagaataataagaaaagacagtttacagaatataagaaaatatattcacaatccacatacttagcaaaggactggtatctagaatatgataaacaactctcaaaactcaaaaccaaaaaaatgaacaattcaattagaaaacaggccgaaaaggacatacagttggcaaataagcacatgaaaagttgttcaacatcattaatcattagggatatgtacattaaaaccacaataggctatcactaaacctatcagaatggctaaatacaaaattggaacaccaccaaatgctgatgaggatgtggagaaactgggtcattcttccaatattggtgggaggctaaaatggcaaagccactctggaaaacagtttgatagtttcttataaaacaaaacatgcggccgggcgcggtagctcacgcctgtaatcccagcactttgggaggccgaggcgggtggatcacgaggtcaggagatcgagaccatcctggctaacacggtgaaaccctgtctctactaaaaatacaaaaaattagccgggcgtggtggcgggcgcctgtagtcccagctactcgggaggctgaggcaggagaatggtgtgaacccgggaggcggagcttgcagtgagccgagatcgcgccattgcactccaacctgggagacggagggagactccgtctcaaaaaaacaaaaacaaacaaacaaaaaacatgcaacaatccagcaatattgcacccctaggcatttatcctagagcaatgaagacttatgcccacacaaaaagctgcacacaaatgttcatagcagctttattcatggtagccaacaattagaaacaatctagatgtccttcaactggtgaatgattacatccataccacgaaatacttttcagcaataaaaaggatgaatcatagtacacaccacaacctggatgaatctccagggaattatgctgagtgaaaaaaagccaatctcaaaaggtaatatactgtattaatccatttatataacattcttaaaataactaattatagaaatggagaacagatgagtgattgccaggggttaaggggctcagggatggggaggggaaggggtatggctacaaaaagcaacaaccttatggcgccggaaatgttctgtattctgattgtgtcaatgtgagcatactggttgagatatagtgctacagttttgcaagttattaccatcagagtaaactggatagagggcacataggatttctctgtattacttcttacaactgcaagtgaatctacaattatctcaaaataataagtttagtttaatgctaggcgtggtggctcacatctgtaatctcagctctttgggaggctgagacgggtggatggcttgagtccaggagttcgagaccagcctggccaacatggcaaaaccggtctctactaaaaatacaaaaattagctgggcgtggtggcaagtgcctgtagtcccagctactcgggaggctgaggcaggagaattgcttgaacccgggaggtggaggttgcagtgagccgagatcacgccactacactgtagcttgggcgacagagtgaggctctttctcaaaaaaaaaaaaaaaaaaaaaaaagcaggcaggcagggccaggaaagcgtataatttttgtagttcaaatgactaacctaaaaagtgaagattggccaggcgcagtggctcacgcctgtaatcccagcactttgggaggccaaggcgggtggatcacgaggtcaggagattgagccactctggctaacacagtgaaaccccgtctctactaaaatacaaaaaattagctgggcgtggtggcacccgcctgtagttgcagctacttgggaggctgaggcaggagaatcacttgaacccaggaggcgaagttgcagcgagccgagatcacactactgcactccagcctgggtgacaaagtgagattctgtctcaaaaaaaaaaaaaaaaaaaaaaaaaaaaaaaagtgaagtttacctttttttttaaatttttcttcttttccttccctactttgtgagataattttcttctttttaaaaagccaagagcttacttctgtaagtaaagattatcttaagacaacttagaaatgtatattattagtattttctatttcattgtaagttatttgtaaatattggttttggtgctaacctagaattccatcaaattaattgtcccctaatatatggccattatcattttgtctaacattgtatcctattaacaatgctgtaagtattatttttgtagctaaattatggtttgcattttaaaattattgttttaaggataaagttccagaaatgaaattaaggatatgaactttttgagcacatcttgtcagcactgagtagtattatttaaaacttttggggggggcaattttataattgaaaaatatatcattgttttaatttgcatttctttcactgcctatgagattaaaacaatgcactactttccaaaaattcttaagtcttttgtgttgatgcttttgttctgtttctatggatctcatcttccttcagaacagctccccttcccaacttcctgatttctaacaataacagtatcaccctccttgttctcccaatttctgaaacacagagtcatgtttttttctctgcttcaatccctggtttcctatcgtcatcaattatgacctttccttgctttgaaagtgttttgggccgggcatgatgtctgccacctattgtaatcctagcactttgggaggctgaggcggctggatgacttgacctgaggatttcgagaccagcctgggcaacagggcgaaacctcgtctctacaaaaaatacaaaagttagtcgggagtggtggcacatgcttgtagtcccagttacttggggggctgaggtggcaggatctcttgagcccacgaggtagatgttgcagtgagccgtgattgcgccactgcaccccagcctaggtgacagagtgagaccctgtctcaaaaaaaaaaaaatgttctagtttcttcctcttctttgttcccatgggaatgccaccatcaccagccaaggctcacatacctcccacctggattacagtgagcttccaggtaatttggtctgctactagtctcgcctacttggatttcccttccccctgctgcagcattgccttccaaagccatgctttgcacatgccacatcctagcccattagactaagcctagaagcctctgcaggacgttcaccctctcagcgccactgctcagtttcccagtggaaacctctgcacccaggaggtttccccacagcttgcctgtgctgcctctctggagcttttctcccttcctgtaatgtccttgctgctccccgtctctagtccattgcctatacctctttttttttttttttttgagatggagtctctctctctcatccaggctggagtgcagtggcgcgatctcggctcactgcaacctttgtctcctgggttcaagggattctcctgcctcagcctcccgagtaactgggattacaggcgtgcaccaccattcctggctaatttttgtatttttagtaaagactgggtttcaccatgttggccaggctggtcttgaactcctgccctcaggtgatccacctgcctcggcctcccagagtgctgggattacaggcgtgagccaccgcacctgccacaggcccatacctcttttaagtcttcattcaataccagttgtcccatgaatttgtcccagactcactcatatgcttagacctttcatattatcttgccatagctttttcaaagtatgggacagcatggacaagcaggccatggttttcttttgaagagaagcaaggaggcagagttattttaggaggagggttatacatttcattttgaaccaattgcgtttggggtgatggcaggatattaacataaacttatttcttggaccattggaaatgtgtgcctagaactgaggagagaggtcagggctggcagtaacaacttggccacaatctgcagagctgactggggatgaggtggaatttagaatgtctgtagaaacggggaagagaaccaaagacagagtctgggacaacacctaaatgtagatgtcagagcaagagttcaagacgaagaaaaacgaatcatacttagaaatggaggggaggaacaaaagaggcggagcaaagtggggcagaaccagagtaggccacgcttttaagaagtttggtaaaggaactgtgaaaggaatgtagttgaatttcagggtaagctggggaattaaagcagtgtgtagatccagggcaaacagcaagtagggcaggaaccactgaaggaacaaataaagggggaggttgggtccaggttgtcttgagtagggaagtttttttaaaaagtgtgaaactgaaggtgtggggtggattgggtgcctgccgtgctctgaggaagcttggggcaactgtgtgctgaggctgtgaggttgtctggaaggggctcctggacagtaagagctgagcagtggggaagaggactgtgtggtctggaagaggagagaaaggagagtgagtgactgaactggtatccaggctcccacaccaaggcagaaagagggagaggacctgggcatctcagggaggcagaggcagtaccaagcagggtgagaggctttagtcttagccacctttgccccattcctccaaatatacattctaagtaaaaacaaaacaaaacagaactgtttgctatgtaaatttagcttctaaagccctgttctacagagattttggagcttccactgcacccagaaaatgcacagctaaagagaaaacttcccttggtgatggttattagattttacaagaagaggccaaaggagacacatacttatgccagaagaactttccagagatagcattgcatagcgaaatagcctgaattatttttattttttaaaacattttttcttttcttttttcttttctttttctttttttttttttttttttgagacagagtctcactctgtcacccaggctggagtgcagtggcgtgatcttggctcactgcaatctccacctcccgggttcaagccattctcctccctcagcctcccaagtagctgggattacaggcatgcgtcactatgctctggctaattttttttttctttttttttttggtatttttagtagagatggggtttcaccatgttggccaggctggtcttgaactcctgacctcaagtgatccaccgccttggcctcccaaagtgctgggatttcaggcgtgagccaccgcacccggccaaaaatttcttttctttaagatgaggcctcactctgttgcccaggctggagtgcagtgttacaatcatagctcactgtaactttgaactcctgggctcaagtgatcctcctgcttcagcctctcaagtagctgggattacaggcatgtgccaccacacccagctaattttttttaaaataattttttttagagacgagggtctcgattggctgcctaggttggtcccagactcctgacgggctgcattttaatcctagctccaccacttacgggagtcaaaattcaaaagatagaaaagggcatataggctgggtgcagtggctcacacctgcaatcccagcaatttgggaggctgaggtgggcgggttgcttgaggtcaggagttcgagatcagcctgggcaacatggcaaaacttgtatctactaaaaatacaaaaattagccagatgtggtggtgtacacctgtaatcccagctactccgaaggctgaggcaagagaatcccttgaactcaggaggcagaggttacaatgagcagagatcgaacactcgactccataaaaacaaacaaacaaaaaaagaaagcaggctgggtgtggtggctcacgcctgtaaccccagcacttcgggaggccaaggcgagcggatcacctgaggttgggcattcgagaccagcctgaccaacaaggagaaaccctgtctctactgaaaatacaaaattagccgggcttggttgcgcatgcctgtaatctcagctactcgggaggcagaggcaagataattgcttgaacccgggaggcggaggttgcggtgagccaagatcatgccattgcactccaacctgggcaacaatagcgaaactccatctcaaaaaaaaaaaagcaaagggcatatagtgaaaagctttcttcctacacatgagtattcacttcctcttcctagaggcaaccaaggttatttttgtgtgtgtgtgtgtgtgtgtgtgtgtgtgtgtgtgttttgggacagtctcactctctcaccaaggctggaatgcagtggtgcgatctcactgcaaactctgcctcccagtctcaagcgatcttgtgcctcagcctcccagtttttttttcttttaaatggggtctcattctgtcgcccagggtggagtgcagtggcatgatcatagctcactgcagcctcgacctcctgggtcaggttatcctcccacctcagcctccggcatagctggggctactggcatgcaccaccacactcagttaattttttttcttttttgagacagagtctcactctgtcacctagactggagtgcagtggtgccatctcatttgtttcactgcaacctttgacttctgggctcaagtgattctcccacctcagcctcccaaggcggctaattaaaaaaaatttttttttttttttttttagagatggggtttcgccatgttgcccaggctgatctcgaactcctgggcacaaacaatctttccacctcgatctttcaaagagctgggatgagagatttccaccatgcctggcctcattttcttttttaatttttttttagacattatagctctttttaatggcctcattttcttatgtttaattcgagaattattcttttcatatacaaagaatatattttctccacctttaaaaacaaatagtagactgtttaacatctcgctttattcagttagtgatgtttcttagatacgggtccaaattagtacacaaagcacttcctcattcctctcttacggctgcatagcagtccactgaatgggtgagctatgatctatttaacctattctttattgatggacatttggttttgtatatacatttgtaattctgtatagattacaaatcaccatccaaagaaattgtactggtttattctcctacaatgtgtgagagttgggtaattacttaatctcaatatgtgagagtttaggcagttacctaatctctctgagtctcagtttctctatctgcaaaataaacaaaacagtgttgacagtatctatttctcggaattattgtggagattactgagatgatgcctgtaaagtatttggcatgtaggagttggtgctctccaaataaggatatgattttatttgtatttgtgagctactgtcccagccaggtaaatggatatgatgagacctccttgccagaccgggtttctctgattagaacgaggagcagatgttgcaggaaattagcaactgatatcagaagagccgtgggcattctcttgccagaggtgccctgtctccagggcgcctcagtccccccccatatgtcttctgctcccaggtccatccaagctgaatgatcgcgctgactcaagaagaagcctttgggaccaaggaaactttcccctgatcatcaagaatcttaagatagaagactcagatacttacatctgtgaagtggaggaccagaaggaggaggtgcaattgctagtgttcggatgtgagtggggcaggtggggatgaggatacctcctgcctggttcccttccccactactcccacccctgcaccaaatccagcctgagctggtgataccgcagcagccccaagaggaccaggctgtcaaactggcctccaaatgtcttaaaacccttcttgatcaggtgagggatgctggtgggcggaggagggaagaggccttgggaaaaggaaagaaaagggaaggaggcaagggaaggagggagagagactggggaagagaggatgaggggagaggaggaaagaagagagagaggaggggagagggaaaccctatcttggctgggggtgcgcagctgggtgctgggaggaaggagatgttgggacggcgataatggagagatgttgttggtttcctgttgtctgcccttctccttggggatggtatgtgtgtgacacagctggcctttccctccacagtgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctaggtaagggaagcccctcttcgcgcagtctcctccctgccccaggggctgacagcccctccctctgctctgactgccctgtttctggttctggtgctgggaggtcaggagtggagaagactaggtcccctagagctgaggcctgtcttgaaggactcactggggccctcatcctcagggggctgattggcagccacccctcagtgtggtggacatggagaaaggaaaggctggggaaggtaaggatgctagaggcccgagtctcctttggaggccccaaaggaggaatgtcagggagcttactttctttgttgcctcagctccacacccctaccaagttggcaaatccacttactcagggacactaacaccagtaagccaaccctgatgatgttctatgttgtacctctggacctctaagccaggccactgtggggagaccaaggtcctaccccagatcctgtcccctgggtgcttatgtgacttaaggtagacataaggtagtgtgccagtttagtgcatgtacgctgattgaaatcctggttctgccacaaccatgtgaccttgggtgagttactaaacctctctgcaccttggtttcagcctctgtgaaatggggatgatgttaactgccatagtgactacctcgtattaagttgaggactgatatacgtaaggcactgaaaatggtgcctggcacagagtaagccctagttaagtgttcgctgttattttgtgaagggtgatgaatacgcctctaaggagtggaggccaaatggcttctgtggtccaggaatcctaaggacagcaaggatcccctgtggctgggctgctctgtgatggcttccgggaggagggaggtggcctgctgtaggaaaatgctgggtggaagaagggagagaaggctggagaggtaggaaggaactgaagtatctgaagtgacaaggtgggtgtctggactcgtcgggtccccttccatctccctgctgcctccacatgccaaccccactcgtgcaccctcatcttcctatctcctcacccagggtctctcccttcccacctccagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagaggtgaggggccaggccagggaggggtgggcaggggaaggagttggaggggcctggcccagggctccctctgaggcaagccaggccccaagaggggatgcctaggccctggtcacctggatgaagtgagggagggccctctgggtttggggctggttttgaactgagacatccatgagccagcctggggctggcttcactgaagatccccaaagcacttgggctaagaaccagggttccagttcttcctataaccaaccctctgtgaccctggctaagccccctcccactgcaggcctgcttcctgacctgtctaataaggataatgaaatctgctctctgtgtgatagtaatgatgataatgtcaagctccaaattgagtttctggcttccttatctccttatcatcataacgactctgcaaatagtaatggctaacacttgatgctcagcacgtgtcgggccccatccaaacactttacatgtatgcctgcctttagtactatctgggtgcaggttgttaagtcacttgcccagagacacacagctgctaagcagtggagctgggattcaaatccaataccactggaccccaaacgctgtttttcctcgtaggactgcatgaaaacctgctctaaaaggctaaaagaaggtcacccatatagagtatcattttaattgttctactgaatctcaggcctttgatctcagcctctcgttcctctgcagccactcagctccagaaaaatttgacctgtgaggtgtggggacccacctcccctaagctgatgctgagtttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaagggtaaggacccaggttccaaggcctctgcctcctgggctgcgggaccttcctgtggttggcagagaccacccagagtcccggcctcccaatgcctgagttggggggttatgggtatggtgtcctctgtggtcccagggtgctttggaggccccaaaaggaggcatagaagtgatgaagtgaggtgggttgtggtcctgggctctaggctgccagttgtaattctacaagttcccactccctcaggtctacagcctagggatggggtccacctgaccgagagcccccctccctggctcctggcttttctccaaatccagacgcacttacacacacactcacacacatacactctcacacacatgcacacactcccatacactctcacacacgcacacacatcactcacacactcgcacacactcatacacacactacacacacatccacactcacacccacactctcaccccatgtactcacacccatgcactcacacactgtcacacactcatacacacacatgtactcacacatgcatgcacacacacacttacacattcacgcacatactctcacccacacactgtcgtacacgtacactcacacacttatacactcacatccgcacacgcattattcacacatgtgcacacacgcgcgcgcacatgcatgcagtcacgcacacacattcatacacgcacacaggcacacattcacacacatgcacacacgcacacacattcacacatggactcacacgcgcacacgcgcgcacacacacacattcacaccattcacacacgcacacacatgcacacactcacacatgcacacacacatgcactcacacacacagcccaggagccagaccacagcttctctctctccagagtgccctggatatggatatgcccaaacataaaaccgattccccagcactggcggcctttgagagcccccaggcacccctcccctctcccccaaccccagggtcaaaccagagactggccaggagggattgcagggcagtcctcagtcccctggcccgtggaggagggcggtgcattgagcacatttctctcccttgcagttctgcccacatggtccaccccggtgcagccaatggccctgattgtgctggggggcgtcgccggcctcctgcttttcattgggctaggcatcttcttctgtgtcaggtgccggcaccgaagggtgagtaaccccacacctggtccccacaaggccctcaaacccctgagtcctctaccaggagatcctgtatatgggaactgattttggcccagctccctctgcccactcgtaagttcccttgctgccctgtcccagatcccactcaagggagagacaggaaggagcagagagttaattccaggatagatggcctgggccatgtaactgcttctcctgtcgcagcttcccccactccccccaccaaggggcacctcccttctggaggcctgggaccctcgtgactccctttcttgtccctggacagcgccaagcagagcggatgtctcagatcaagagactcctcagtgagaagaagacctgccagtgtcctcagtaaggatctgggaggaggggttgagagaggggaaagggggagggggagggagttagagaggagggggaggaaggggagcaaaggggggcaggaagggaggatggagaggaggaaggagttgaggaggaagagctgggaggggtggaggtgaggagatgggggctaaaggggtgtggtggagaggatagaggggtgggaaaagatggccaggagctagaaggaggcagaagtgggaggatggagctgaaggagcagcaggccaggaaaggccctgctggaaagccactggagctgtgctgcgctggaaaggccattggaggtgctagaacgcaaaggggttgcagtggggacagacctgctccccttcttctttgttcctgcagccggtttcagaagacatgtagccccatttgaggcacgaggccaggcagatcccacttgcagcctccccaggtgtctgccccgcgtttcctgcctgcggaccagatgaatgtagcagatccccagcctctggcctcctgttcgcctcctctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcccaggggagtgttcagggccagccctggctggcatggagggtgaggctgggtgtctggaagcatggagcatgggactgttcttttacaagacaggaccctgggaccacagagggcaggaacttgcacaaaatcacacagccaagccagtcaaggatggatgcagatccagaggtttctggcagccagtacctcctgccccatgctgcccgcttctcaccctatgtgggtgggaccacagactcacatcctgaccttgcacaaacagcccctctggacacagccccatgtacacggcctcaagggatgtctcacatcctctgtctatttgagacttagaaaaatcctacaaggctggcagtgacagaactaagatgatcatctccagtttatagaccagaaccagagctcagagaggctagatgattgattaccaagtgccggactagcaagtgctggagtcgggactaacccaggtcccttgtcccaagttccactgctgcctcttgaatgcagggacaaatgccacacggctctcaccagtggctagtggtgggtactcaatgtgtacttttgggttcacagaagcacagcacccatgggaagggtccatctcagagaatttacgagcagggatgaaggcctccctgtctaaaatccctccttcatcccccgctggtggcagaatctgttaccagaggacaaagcctttggctcttctaatcagagcgcaagctgggagcacaggcactgcaggagagaatgcccagtgaccagtcactgaccctgtgcagaacctcctggaagcgagctttgctgggagagggggtagctagcctgagagggaaccctctaagggacctcaaaggtgattgtgccaggctctgcgcctgccccacaccctcccttaccctcctccagaccattcaggacacagggaaatcagggttacaaatcttcttgatccacttctctcaggatcccctctcttcctacccttcctcaccacttccctcagtcccaactccttttccctatttccttctcctcctgtctttaaagcctgcctcttccaggaagacccccctattgctgctggggctccccatttgcttactttgcatttgtgcccactctccacccctgctcccctgagctgaaataaaaatacaataaacttactataaagatgctcttcgtgtgtgtgtgtgtgtgtgtgtgtgtgtgtgtgtgtgtgtgagagagagagagagagagagaccccttctctggggaccaggaatcttctggtctttggggtcggacccagaggagaggttgctgggcgtgccccaggaaggagatgaagtttccctggagagggaaaaattctgtggaggctgg

SEQ ID NO: 22 - DNA, 242981 bp, Homo sapiens
gttccagaaatgatagcgaaaagccaattccttatatctcacttataatgtaaaatatcagcctaaacttgcagaaagtatatcttttgaataaaagacagcagatgctgtagcatttctgccaaagaaagagtccagtataaacattctgcagtatgcaaatgtcatctcctctatgtgaatattttccccgagtggatgttgcagggttggaggcttctgcctatgatttaggttgtaattttatttgtggaaataaaccaatcgtggagctccaattgtcttggtggtgaggtgatcaatagcccattactggatagaacagcgactacaggaagagcattgaagattttaatgcatgaattatgcatgcagcgctcattctttagtctccgaacagaatgacagggtttgtgaagtcgcctcagatagtttcttgcattaagtgactgcagtgaaatgcttaatattttcaggcatagaagcagcattgactcgggccagccgaatttggaagatgtaaatctcccagctcacagcacggaatgctttatttgaaagtattgctatgtagacagccggcttttctgtcatctaacctgctctccccaggttggctgaaggatgggagcggctgtgcctgcctgtgaggtcacagcatgaagtccttttaacttgctttctgctgcaggagagaggcgtattgtggtataactgttgctgtatttattcaaatggacaatttgcaatagatattatacccaggacgacagataagtcaacacataaggtaagtccaaggttttttttataggttaggtaattgtaaactagaatatgctgagttaggataatggtgatgcgatattaataaggttgactcagaccttagtattgcaatgccagcatcaggactctcaattgttacgttaaacgagaggtgactttctatatttgatagtattggaccatagggtattttatcttgcatgcaaaagctttccaagaatgtactagagctcgaatgtgtagaagactgcaaactggggaggggcagcagtagaatgagctgaatcaataagtggaaattacctccttgtggggaagttttagcacggctgtggcatcgcgttggctcagattatttccttaatgtcaacattttcaaattctagtaaaagatgtgggtagacaccagaaatgctcaatccttctcccagaagcagaggaaagcaccgaggtactcaaactcaaatactgtgttgcatacaaattgagcagatggaattaaaacaatttggactagcatgtccttgagggaagaccttgctgtcaaacaaaccatttgacttctacctgtgctggtttggttttgtttttccctcttgttaagaatgccttactccaaaatgtatggatagatgacgtgttgtgacatttacccaaaaaagagttttatttcttgtttttttaaaaattacccctatacaattataggacccactacataagatccaaataaaatttacaaaaactctgtaaaactgaaaaacacagtactatacgagtatatttgtcagaagtcattgttaattaaagtttcttgcttaaatatcatggcaaatgattaattcctgaacatttctttaggatgagaaaacagaattaataaatataaagcaagagacactagataagtaaaattctttaaggctacttttcaatttatattattagtgaacatatattactagtgaatatatatactagtgaatttatattactagtgaatatatatgcacacacatacatatatactataattcatagtttataaaacataatatatgcactataatatataggtatatctacttcctcatgtatgtttattaatactgtttttaaaagtgtgtttgctaaatcatctatcaagaccaagaatagataaggacaagtatgttttgggaaaaaaaagtatcactttattttttttaaaaagaaagaaatttagagtaatgatgataataagagcacagcataaaatgctacattttatgcatttcaattctgctacaatgttgctatattatttggatttcctgttgtccaggtgttgtgcacagaactcccagcattacagaatggtttaaatcttcaaagctgatctagtttaggtataagaggaaactcacacctgaagtttttccttagggaggggaaaaaaggaaggagatattactacctatatatcttagaagtctcctgatgctgagtcatggtgttcagttctgctgaaatgcctcctggctgaggtggctgattaacagctaataaaatggaatctagaggaaaatgagaaagaatggaggggggcagaaacttaaagatatttattgcctaatgacacacactaaattctgagtaataagtagaatggcagtgctacttgttggatctggctgagttgacagtaggagaataaaagctcccgtgctgggtgacaagatcatagcagtagaattaatggcctaacaaggggagagtgtataaacaaagggattcaagaagcactgcccttgtacttatctaaacctctctgtcttctttctagtctcaacccaagccattagccaatctcatttaaaagacataatgttcagataaagaatagtttccagatcacgtaaggaaaatctagaataagatgtgctcagttcctgcttcccacggtggttataattaatttttataggctatcaattgggaggaaccaacaaaaaattgatgagaatttttaaatatcttgtttggtatatatgaggcaccaaaatgagtttagatagtgattattatggcaacatataatcgtattagatataattggaaatggagactgaatatattacaaaaatatatattaaaaaggaaacagggcaaatggaatgagagagtagtgaaacatcaaacataagattttgaaagaaaaatgtacttaaactgtagttgatatacattattagtgactcaaaatcaatgtataaaaaattctgaagtaacaggtttactaatataagggtttataatttctttaaaaataaattttaagggtgacttagagtgagaaataattgacaataatattttaaagtagaaaggtgtaatatttctttatagggaataaatactgatagagctaaaatatatttgtacttatgttgtaataaattgaagtagaaatctctctatatatattgagagagagggagaaagtatagtgtatatatatatatatatatatatatatatatatatatatatatactctttatctgtctacctaactatctagttttctacttagtaactactataagtgatctgtaactaccataatcctaagtggtagttacatatacatatacatatatatatatatatatatatatatacacacacacacacacactatatatgaaacatatatactataagttaatatatagtatagtatatatatttacagtatatatactataaatatatacaatacagtatatatactatacatatactatatatactatacatatatagtatactatatatactgtaaatatctatagtatatatactataaatatatactgtaaatgtatagtatatatatttacttatagtatatacatttacacatataattaaatgtatatactatatttacttaggattgtggtagttacagattacttatggatgattaggaggcctacaagtatttgaaaagaggtaatatacccattttcaacaaagcaagctaatatgaaaattgaggaaatcagagcttatgtttagacaacaagaaaatttcccatagggcacttcagtaaacagtcctgatgagttgcaagctttgtgaaattcacagaaaacttttgcaagtatgaatctacaacaaagagtgattgttgggagatatcatcttcttttctctcctattcgagaaaaatgattaaattggttccccctcaaaatgttttccctgagtaattaacatatgaaacatctttctttcagatatgctcttaagggttgactctgaggagtgcctcagtttaatatagctttatggatgcttcaccaatttattccctcttattgtaaatataccttttactccattttcattgttcatcaatctctttcttctcacaagacaactcagtgcaataaggaagcatttattgagaatcctcttgtttggttttgctaggtactctggttttgtagatgcaaaagatgaagggcctgtgctttcaatgggaacaaacaagtcaaatgcagggggaaaaagataaaacataggagcacccaaaaatatttggtaaaacgttctactgtcataggagaaatgaggaattatgcacaacattttttaaatggcacctggaggaagaatatgtataaaagtatggaggctaaaattaatagtatatattttaatgttggtactgaaacagagggattggatgggtggtgtagttgagaataaacaaggtggggcaggttattaggaacttagccaccagaataacatgtttagacttgacttaataggcagtgaacacccacagacattgtttaatctcactggaggcatttaatgataaagaagtatctgactcctgaatcagataaattctcagcatttctttttaatggctgctaattctaaattaaatagtcatgcaccacataaatattttttgattgcatatttgacagtggtcccatgagattataatggagcagaaaatttcctgttgcgtagtgatatggtagcccttgtaatgacatagagcaacacattaccttttttctatgtttagatacacaaatacttaccattgtgttatacttgcctacagtattcagtacggtaacatgctgttcatgtttgcagccgaggaacaataggctatgccatatagcctacgtatgaagtaggctagaccatctaggtttgcgttaagtacacttcgtgatgttcccacagtcaaaatcacctaactgctcatttctcagaatgtatcctcatagttaagtgatgcataactgtattgtattaaccatgtcttttattttctgaattctgatactttagctttgcagaccctggaaggaccacccttcctaggtgttagctgattactggagttagtatacaacttgcccctgagtacatttttcaaatgcaaaccaaccaatccagagccccactactacaaccaccttccttatctgggctctcacactctgggccactatccacttggctaatcaccccggggacacataccagacaagtgacaaatgaaatttttcaaactagccaatcctaagcacttacctgctcctgttcgttctggtgaaaaccacacagttccccctctctccctctgcctcctgaccagccccagttcttctccatgttgctccttgtggtgtgctgtgctctctgctctggtgatctgtgggtttaacaagttatcttttttttttgagatggagtttcattctgtcgcccaggctggagtccagtggcgcagtctcggctcacggcaacctcctggagtgcaatggtgcaatctcggctcactgcaacctccacctcccaagttcaagcgactcttctgcctcggcctcccgagtagctgggattacaggcatgtgcctccacatctggctaatttttgtattttttagtagagacagggtttcaccatgttggccaggctggtcttgaactcctggcctcagatgatctgcccaccccagcctcccaaagtgctgagattacaggcgtgaggcactgcacctggccaacaagttgtcttttcaatgacagttgtctccagatctgttgtctttaacaaacctaaataataaaacctacattaaaataaacatttaaaaattttctaaattttaatacaaactaacataaatagaaatattatattcccaggacatgaaataaattagccaagtcttttttcttaaaaaaaaaaatcattacctttttactaaactgttatcttattttgaatttaaggatcaattctgaatgaatctcctataaaaataagcttaactattttccaagttgtggttgataaagggagggtatatcctctagaaatgtgaatgggcaattagaagttttcagtcttatgtcaagatacataagtctaaagttttaaatattttcctgagattgctttaatttgtagtatgtcatatctactgcatggaaacaagcatttactttgtcaaacaactaaatcaatgctgagggaaaatgctatctttatacttgaatatagaaattttgaaactgtaactaccaaatgctagttttgtttacataatgtctttaatatctgatgaggaactacactacacatcctaacaaaaataaattctgttacattaagccacaaaattgaattgaattgcactctcttgagaacagtgtccaaggagagattgttaatcagtgaatgcaaaactttagaacaatgaaccaaatgcaattaagcagaagactaacaagaatcataccacacagaaaaccgtgctttgaagaatatgtatcacaagatcgtatcttttggtggtgcactccattattttaaaacaccatcactgaaagaagagaacagtaaacgattttaagaggtagaataattcaaatattaaatgcatgtttgatttttacggccattaactgccctttcacccgttctgctcctagattgcattataagttattactgtaatcgtaatagccctttgagaaataaacttttgaaaaactcaagtggcaaattgatggcttaggttgggaataggttagaaaagatactagtcatgatagcagatggaagggcagcaaggtaggtggctgggagggaatctggaggcggagctgtgccagaaagaacataggaatttaaacagatggaagatgatatatcagttggcagggagagccgctgggtgacaagcagacgaatctattgaagaactgggtggataggcagccaataagtgaattagatgaaccagtaataaaagaaatagatcagtatgagggcatccaagctccagaacaaatcgacaagaacaatagaaaacaactacaattgtccctttgcttgaacctgaggaaacgacttttattgtaatcttttaaagtgcttagaagtgatgatgaataaatgatgataaataagatgatgatcatcttctatagaaggaaaattttagtataaaatttaaagatgcttaccactaaataaatatattctataaaattattatgagcatacaatttattttatgtcctagttttgggtttcctataaattgagttctggccctggcttggttaatgtatgaggctacggggacctggctggaaaataatactgatgcatagtaaaagtggagaataagaactttaattcctttcaaaaaagagaatttaccagactatggcaaatgtgaatatgatattatctttataaaaatagcttatgttgtttttgtctattaaaaatgataatagcagtgtctcaatgaggataaagaagaccattacaagtcatttggtctctcttctgccttcagacttacctacccttaaatcaccatattcttaggcaattattcatacttgcaagcacttagtataattgtgtagtgcagttttgcactttttaaatgacagctgtcattatgggttgatagaaagtaccatacccaggaatatttgtaggaaggacttggcttaataggaccattctgattgaccttcagataattacatggtttcttagcagagaagatacttcaatttgccacattataagcttaaaattcacattctttttattcttccatctaacctataaacttatttttctggtactgtcaactatgtttctcaggccagtctattactttctattttactagccaaagcccatatgccattatgcctgaaactgtgttgttttactgccaatatgatcatttctaaaatatctgtattcccatcaatcccacacacagaatcagggatcatttatctcaagggttgtctgagttatatgaatattcttttcaagtgaattttttttagctgacactttaatctcttgaattaaacttctgagcccaggctagtagcagtgtcttccgaaattctaaatgctatttatacacacacacacacacacacacacacacacacacacacacaagttggagcaatttcctaaagaaccagatgaggcaaattctacacatatgccaggcactaggccagacactgagggatacaaggataaataagatatgaaccttttcatcagagtttatattttggtggatgaacaggtatatatatgtgtgtgtgtgtgtgtgtgtgtatatatgtatgcatatatatatacacatgtatgcatatatatgtatatgtatacaggtgtatatatacgtacatatacaggtatatatatacgtacatatacaggtatatatatacgtacatatacaggtatatacacatatatgataatatataatcgtatatatgtgtatatatagtatatatgtataaataatatatatgtatatattgtatatatgaatacataatcatatatgtatatattataatacatataatatgtatgtatatataacacatatatgtgtatatatatataaaatcagatactatggtacactttaatagatgcaatgatattatattcatgtaatatatgtgtatatcatcctccataattgtaaatctcttgaggttagggaacacactaatttattaattagtaaatatttattaagcctcttttatgtacaatggttatgcaaagggaagatttttccctgttgccatgggcaaaacagtctattgaaaaagggaaaagaaaggagcaaactttctgtgaaatatgatggtacacagtatgtacaataagtgcatataaattgggctctaaccaaaatcaggagaggacatcaaggataacttcctcaatgaagaaatcaaaggatacataggatagtttttaaactatttaagtatttgtataatggttaattcattgttgttataaaataatggtgttgactgtaaacttcagatgttcagactaaaaaagatacatgtatttaatgaacacaatttgaaaggaagccaactatgtgtttggtgttgagataattatttaagtattagctcacttaatcctctccagaacactatgatatcctcacttttaagttggatgttacgctattactaaaactcttcagctcaggattaggagattaaagtttctcttccatatcaccataattttgctaaattttcttggcactttgcagaaattttaaatgtcaatgcatttatatattcagtgatatttcggaacccctatattcattagattgttcatctccctttccttttaactaaaatatatataatggggccagtacaatgttgcatgttaatttttattcagatgctattgattaggagattggagtggggcctcaagatggctgactagaaagaagcctttcatgcccacctcctccattttaaaaaccaaaatagtgtatagacagtcacatattgaatatattacctgagagacggtggtggaattcaataaggaagtgacaaaaacaccaaaagcaggaaggagaagggagagagagacagtctgcctgcccagaatcagctggaagctgggagtgacttcccagcccagggattaggtgagcaagacacatccaatggcccacatcactatcatggaattatgcagtcctgactataggagaaccccttattattctcaacccctgaaactatcatagggagttgccaatagactgcagaaagaaggaactgctccagggagggagcttgcactgggtcccacaccctttctgagacctaagtggctacagcaaggtgccatttttaaacctagcttttgacaggctttctgttgtcctggggtgcagcagcgttgagtctgaggtgttagggaaacttgggctgtccctgatgggactgaggagcaagccgagaatgttcctacagccaaggctaagaagcaagtgaggtgtgggctgtagcggccactgccaggaagcaagcactgctaggacagagactgagacacaagcaggatgcaagttgacactgagacatggatgccagctgggtggacactcctgtagccagggctagggcctgagctaggctcaggctaccactggtagtggtggagtatgagacagacctgtgttttctaccagctatggccactgaggataaccccaccctctccaatggcagggtctcagtatcgctgctactgcttctccccggagcattgcacctggcacctgaggattaccctaccccacccacaatggttggtgcttgctttccccactcggggtactgagcaaaaggccacccagcccggcattgcatctgcaagacagagcacgtagcctgtggccttggggatggcccaacccaatttaccactctggaaccagagcactcctactagcatcctgaagttggctctaaactcccagccactaccacttcagctggcacttatctgcaagtgccatctgtgagcctggaaatgggcccgcctagcccattgctgctaccaccaacatcaacacacaccaactgagacccaaataatttttctgccattgctattgccatcctccatgccacaccagctacccaatgtccaagtatctgaacacccacttggcctactgctgccactactggaatctgagcaagacatctggagtttcaagagtcagccctccagtaactgcaaacaaaagtacctgtgtatatcacccagtggaacaaaaataggcaaactcaacccactgctgccagcactgtggcctgaacactggcccacctgatatcctagtacccagcataacttcaccacagcctccactaataaccataccctaacccaccaaaaaatgacaggcatcactaatgctgtatgtagcaaaagaaattatacagagacacacttagaatcaaagtcaaagtaccctacccgaacaactccatagaaatatccttaggaaaagttctcccctacacaagtaaattcaaaaataggaagaagcaacagttacaccatatgtgcagatatcaatgcaaggatacatgaagcatgaaaaaacaaggaaatgtgacaccgccagaggaacactgtaattctctagtaatagatcttaatcgaaacaaaatgcaacatttcaggcaaagaattcaaaatatttatttttcaaacactcagtgaaacacaagagaagtctgaaaatgatacaaagaaatcagaaaaaacaatccaggatatgaatgagaaatttaccaaagatatttttttccttaagaaaaaacaaatagaaattctggaactgaggtactttttgaaggaaaaacaaaatacatttgaaagtatcaaaactggaagctagatcaggcagaagaaataatctcagaatttgaagataggtcttttgaaataatgcagtcagacaaaaatatagaaaaaaaacttaaaaagaatgagcaaagccattttgacatttgagacaacataaaaccattggatagtcaagttactgatatctccaagggtgaagaaacaacaacaaaaagattagaaactgtttaacgaaatgatagatgaaaatttcccaaatctagcaaaagatttagacattcagataaaagaggcttagcaatccccaggttgataaaatacaaatgtgtctccatggcacattatagtatgactgtctaaagctatagataaaaagccaatcctaaaaacagcaagagaaaatatctagtcatctataaagggaaccccattagattaaaagcagatttgtcagttgaacacttacaggccagaagagaattggatgatctactcagtgctgaaaaaatgtcagtcaaaaatgctatatccagcaaaattatccttcattaatgacgtagaaataaagtctttcctagtcaagcaaatgctgagggaatccataaccactagaccagtcctacaagaaatgctcgtcctaaaccagaaagcaaaagaacaacattcaccagcatgaaaacaagtaaaagtgtaaaatcactggttaaaataataatacaaaggaggaagagataaaactcaaacagtgccactgcagaaatccaccaaacaacaaagagtatcaataagagaaaaagaaaaggacaaggaatatatacaacaaccagaaaacaacaatatgacaggaacaaagcctcacgtatcaataataatcttaaatataaatgaactaaattctccacttaaaagttatagactggctgaatagattagaaaacatgaaccaacttttgctactaataagaaactcaccttaccagtgaagacacatatagactgaaagtaaaggaatggaaaaagatattccacataaaaggaaaccaaaagcaagcaggaatagctacatttatatcaggtaaaatggactttaagtgaaaagcagtttaaaaaaagacaaaagtcattatataatcataaaggaatgaattcagtaagagaatataacaattctatatatacatgtactcaacactggagtacccagatttataaagaaaatattactagatctaaagagagagaggctataaagaataatagtgagagactttaacaccccactctcagcattaggcagattatctagacagaaaatcagcaaagaaacattggatttaaactagtctttagtccaaatggacataatagacatttacacaacattctatccagcgatggcagaatatacattcctatcataagcatgtggaaaattctccaggatagatcatatgtgagacagcaaaacaagtctcatcaattttttttaaaaattgaaattatatcaagtatcttctcagaccacaatggaataaaactagaaatcaataccaagaggaacactgaaaagtaaacaacaagctcctgcattaacattgagccaatgaagaaattaagatgaaaataaaaaggtttcgaaacaaatgaaaataaagacagagcataccaaaacctatagggtacagcaaaagcaatgcaaagagagaattttatagcaataaatgccaacatcaaaaaagcagaaaaattcacaatctaaaggaactagaaaaacaagaacaaaccaaattcaaaattagcagatgaaaaaaaataaaaatgagaccagaactaaatgaaatagagactaaataaacaatacaaaggatcagtaaaacaaaaagttggttattcaaaaatataaacaaaatggataaacctgcagctaaactaatcaagcagaaagacctaaataaacaaactaagaaataaaaaaggatatattacaacagataccacagaaatacagaagatcatcagagaactattatgaccaactatacactgaaaaactggaaatggataaattcctagaaacatacaacctaccaaggttaaatcaggaggtagaaaacctaaacagaccaataacaagtagcaagagtgaatcagtaataaaaagtctctcaacatagaaaaaccctgtatcagatggaatcacagttgaattcaatcatacatacaaagaagaactaataactaccttcctgaaaccattccaacaaattgaagatgagagtattctccctatctcattttatgaggccagcatcaacccgacaccaaaaccagacaagaacacaacaaaacaagaaatccctaatatgtctaaggaacatggacacaaaaatctgcaacaaaacactagcaaaataaatccaataacataacaaaaagataatacaccttgatcaagtggcatttataccaggtatgcaaggattgttcaacatatgcaattctataaaggtgatacattacattaatggaattggggacaaaaaccatatgatattccaatagatgcagaaaaaaaatttgacaaaatttaatatccctttatgacaacaactctcaacaaactaggtatagaaggaatgtacctcaacataataaaggccgtataggacaaacgcatagctaacctcatactcaaaggggaaacgcagaaagccttttccttaagaactagaagaagacaaggatgccagctgtcatcactcctattccacataggattgatacctaaatgtcctgacttgatcactgtgcattataaacatgtaataaaagtattcattgccccataaatttatacaaattttttttaaaaaaagaaataaataaaaagatatttttaattaggagaaagtcaaatataatttgaaaaataagccactcataaaccctaatctaagttaagttaaaaaggtcactttgcttgagtatggaaaatgtgactggcaaatacagaataaagtgccatttgaggaaatacgtacattttacaagatgtttgttgcatgtaccctgctgaaatatcagtgagtatcttgatgaacaagttttcaataaatttatattaattagcttgttattggttcctctaaaatatgtattgttaatagcaggtagaaggaataagttcagtgttcaataataaaataggaaattgtagttaacaataatttacggtatacttcaaaatagctagaagagaagaattgctatgttcccaacacgaaagaaaacataaatgtttgaggtgatgggtatcccaattatcctgatttgatcatcacacattgtatataggcatcaaattatcacatgtacccccataatatatataacttatgtatcaataatcattgtaaaagaaaaaataataatttttagtttccctgaggagatgctttagacacttttgcttccttcctatctctgtcaagcaaaactaaatattaagtagtagagtcttctgtgtaagattgaagattatggagggcaacaatctgctttgttcatctttgtattcctagtgtctagcacagtgccttgaacatagtagatgttcaataaatgtatgttgaataaaagagcacatgaattattaatatgaatacattattatttgtcacaccatccaattaatagacttttagggatttgttatgtttaatgtacatatccaatgtaagatgaattctgtagtagtcgatcttgttttttaatgacgaaaatgtgtctcaaactaacgtaggcaaaagggggattttatgcaatgatataataccacatacctgaaggctgtataagcaaatgctatgaaggatggagtcaaggtgtagctggacctaaagtataccttaactagagacatccagaatcaacactgtcagcttctctgaatacgggcttcatttccaatgaaaactaactcctttatgccttagaaaacatacctgatcctaagtctaggtattttcatatcttgcagcacttccaatccccctcctaccagtaagtatgtttttgtgatagtttttacaaatattatgttgtaaatggccagttcaggtgataaagcataaatattttgttgacatattgattggaaaattaatgggaaaacattaggttgaaaacttgaacagatattctgttcaataaaagttctttgaatattttaataaaaaagaaattgtggcttatgctgaagttaatgaatattagggataaaagtaattaaaatattttaaattattttaagtaatatttgccatcttttcagactccatggaaacaatattctgcttatctctccatatccccaacatttggcacattgcctggtgtattgtaaattgttggtttacatttgttattaatatattgataataaggtcttctcggctcacatatgaatggactacaattaggcagttgtgataagaaagtatgtacaaaactagcaaatgcatcccatattgtgacccactcatacttaaagggcaaattatataatacaaattgtttagagataaatgccctgcaagataagcaaggatctagaccaaaaagaatatgtctggttgggcctggtttgtatcatattcttaaaaatagcctgaaatagtacatcgtttctttggaattcattgaagatgttaaatacgtgggaaatccttgagaggagtagaactaagtagaaataataataaagattttgagagaagtggttatttctgccaaattagctagaagaacaagaacatggctaaatattttcacatagatatatttggatgagacttttgcaggagtgcgtgaatgccaatattgttaattttgtaataaatgccatattttattgaaaaaattctttggcacaatgattttttttttttttttgagacggagtctcactgtgtcgcccaggctggagtgcagtggcacgatctcagctcaccgcaacctccgcctccagggttcaagcgattcttctgcctcaggctcccgagtagctgggtctacaggcatgcgccaccatgcccagctaatttttgtatttttagtagagacggggtttcaccgtattggccaagctggtctcggactcctgaccccacgatacacccgcctcggcctcccaaagtgctgggattacaggcatgagccaccacgcctggccacaatgattttttgaagttattgaatgcaagcaaaatcacaaatattgtttttttgtgtgtgttctttactgaaagtagaatgtagccctcacctatgaaaatatgaatgcctttaagcaaagccttcccttaatttaaattgaacctaaaaaaatgcttcttgcagtagtgaaaaaaatatttttggtaatctaagagtgatattatttagaatttccctctctaatccttcaccaagaataaaatgaaatcttagaaacggaagaagtcttataaagattgtgactaaccctttagtttttacaggtagaaactgaatttctcatgattgattcttgctgtctaaggacctactatttatgcatacccatgcaatgaaaactaagtttaaaagcataaatagttaaaagtgtaataataattgaaaattgcagtaacgtttttcttaattgtataattattgattcaagtttaatgttctttatgtgaattacatttttagtttgagggaaaatattttttaatgaattgtttttgctttgctaagtgatctatttcaagaaacagtctttctccagaaaataaaggaaatttcaatgaaagaaaaagcactcttctgttattccaaacatgtatatttcttagatcttaaccacggaagagtaatgttgaaagaaaatcattcatgagcattgattaggaaattggtgcccattgagatatgctcagcatcaatataaacgtaatttttctttaaaagagctagttgtatgtcagttgacttgctgaaaatgcttcggttatattattaaaaacagaaatttcagtggcttttaacttaggaataaacaagagtaaaggtgagaaacttgaaatgcaagtttatcaatctccctttgtcatatagaaaattgattagaattgttagcccagtaaagtgcagatatataatagatactaaatgtagaaaaactaagaacataatattggctacaaattagacaatgcaagaagaatgaacacaggttaatttaacttgttagtctcaaatatatattatcacctgtttcacagcaaaattatactatttattgtgttttattgacagaacagagtaccaagtaaaagaagaactattagactattaaaaaataaaaaatgccatcacatctgaatttatgttaatgagatggtgttgaataaagctcctagatagcctcaagatggggctagtcaccagaaagaccaaataattagagagctggaaatttcatttccacccgccagcctctggagatgagaggagggctggagagtgagttatataaacttttcaccaatgagattcagggagcatcccacttggtgagcacactggggtatggggagcgtggtgcacccagagagggcacagaagctctgcaccactccccaacccccataacttgccctatgtatctcttctatttgttcccgaattgtagcctttataataaaccagtaaatgtaaagaaagtgtcaaaaacaataaaaaatgaatattagtggaatggaaattaaatattccccattaacagtaaaaaatgattaccgacagattgagttggggaatgtgaattacatagtgactttcgagtgtgatctaaaatgaattcagcaaacagatctatgggaaataatcagtttataggtgataaaaaattacttcagcaataacactgcggaggaagttagaaaaacagtaaactcatacagataattgatacaaaaaggacagagcaaattctccagtaattaataaataaatggcagggattggggtgagggtaaaaaaaaaatggctcacgcctgtaatcccagcactttggaaggctgaggcgggtggatcatgaggtcaggagaccatcctgcctaacacggtgaaaccccgtctctactaaaaatacaaaaaattagcagggcatggtggcgggcgcctgcagtcccagctattcgggaggctgaggcaggagaatggcgtgaatcccgggggcggagcctgcagtgagccgagattgcgccactgcactccagcctggacaacagcgaaactccgtctcagaaaagaataagaactcaaatgcttccatgaagtcctggcagcattttcattgctcccatgtgtcgtcactccacatagcagtagaaaagcttcaccagagtcaagtctccaccacaacaatgctcctgctcattcatctcatcaaactaaggagactttgggagagtttcaatcagaaatgtataggcatcctcattacagtctttttctttctaatttaaatttttgttgttgttgctgctgaggcagagtctctctttgtcacccaggctggagtgcagtggcacattctcagctcaccaaaacctccatctcctgggttcaactgattctcctgcctcaggctcccgagtagctgagagtacagaaacatgctaccatgcccagttatttttttttattatttttatttttttctgagatggagtctcactctgtcgcccaggctggagtgcagtggtgcgatctcggctcactgcatcctccgcctcccaggttcaaatgattctcctgcctccacctcctgagtagctggggttacgggcgtgtgccaccacgcccggctaaattttgtatttttagtagagacggggtttccctatattggccaggctggtctcgaactcctgacttcgtgatccacccacctcggcctcccaaagtgctgggatgacaggcgtgagcgactgtgcctggccctccttatagtcttgatttggctacttctgcttcctttttgttttctaatcttaagcaatctttaaagggcacccatttttcttcaattaataacgtaaaaaagactgcatttacctggttaacttccagggatccttagttttttagggatggactaaatggctggtctcatggcttattaaagtatcttaaacttgatgaataaagtttatattttttatttttatcttttaattatatttttccacaaactttttgaagtccccttgtatttcaattgcaatttctgtagcaaagtacttcaaatcagccaaaactttttttttgttttaacgtttatatttcaggggaaaaaaactgaattcactaatggttgctcttaatttgtgttactttcaaatgttgtgttcactatttatgcaaattaaaactgtaaactgaaattttaattttattagtttcatggaaaagtttagaaagcagtggatttataatgtgaatagcaattacaattatattttactagttatatcccaggcacattcttgaataagaagttgaattacagcctgaaggagtgggctgtccctctcctgttggggatcctccactgggaatcagtggcccccaaccgttttggcaccagggacaggtttcatgcaaaacagtttttccacggatggggtgaggatggttttgggatgaaactgttccacctcagatcataaggcattagattctcataagaagcgcacaatctagatcctttgcatcacttgcacgggcagttcacaatagagtttgcgctcctgtgagaatctaatgctgccactgatctgacaggagctcaggcagcaatgcttgcctgcactctgctcacctcctgctgtgcggcccccttcctaacaggccacagacccataccactcggcagcctggggtttcgggacccctgttctagagtttctaaactctacaaatattttttctaggaatagtcagctttatgccttgacagaatggattctccaggctgtgatttgacatcagaattcatataaggattcatgtataaagaacgcatctgatactcttctctacttccctttaaattactatttcccccaatttcatttatattaagtcaaaattcctatagtgtttaatgttagcaaaaatggtactgtgctctaggctagattattaattcctttcatattgttacctcatttattattgtgttgaaagctttattgactatgtaagctgtcacaatttttttggaagtattagtgtttatataatgaaaaattaagtaggtgaataatgtatgagttagcatctagcccctcacttgttttgaatgagtcaagagattcagatactattttgaaagttataataaacagtaatatgaccacattcagttctcttttaaaacgatatagatgtaataaaatgaaggaaggatatttcgaaaatgctcttttgattttttttcaagtcctttcaaggatgcatgtcacatgtctggttcctagcaaaggtacttggtctttaggtcttctcaaagttgtaagtcctactgaagttgtactgtactgagttatacatgatggttttatattatagttcagacactctagggcaccaggtgtgtttttttttttttttttccagtaacagtagggactggttataaaggagaaaaatcacttctttccctatggattaattgccctcttaaataaaataatcaaatacagtataagaatataatgtaatcatatttgtgatagatccaaattactaaggtaatgaactatcaaaagaaaacattcctgtggagttaaaaggatcaataaatattagtgtggttgtaccatcaaacactggactaagaaccgaagaacctgaatttagtcccttgagattttagacaaatggcttaatctctctaagcttcaggctactgatcattaaaatggggattagtaatacctggcttcaccaattgtcaaactgctcatgaagtacaagtgaaatattccctgaactgcttataatctttacacttatttaaaaaaggtgtaaagaccaagaaggtaaatttaacattagcaacaacaagaaaacctacatacttgattaataagggtgattttatttgattaatatatatgtaaagttagtcattcagggaaagtaaaacataaacaaatgtaataaatacattaatgactgactccaaaagaagcatattatagcttggaaatcatagtgaatctctcaaccaattcctgcaaaactgactcataattatgccccaatcgagtctaccctctgattcccctaatagcaatcatggagcttggttgtaattgattaggagaaacaaaggtaactgtgctagccattatattagggtctctaatttattctcaaactatctgaagaatttctattaaggggactgagtctacataaaatatggaatgctaacaacactttcttaattacctttgtagtaattgctaatgtataataatatattaaacaaataatagtgatttgtattattaaaataaggattttcaatttctcagcatgccatatgcagccaaagccaaacaaattcaaataaggaaaagactctttttttaaagcctgtgagacacagaatactattttagtgagatacatatatggtacatacagtatatatatagtacatacagtatatatgcatctcaccaaatatatatatctcactgtattctgtgaaacatagaatactattttagtgagatctatatatatatatgtgggtactatacatatatgtagttaagaatcaattccaatcaactctttagaaaatgatattgatgtatatttgtaaatgcttgtatctttagcattataatctatgcttgttgagtcaattctatttaatttgaaattgtgatttttacacaggcacccaacaatttgctaatttttcctgaactctccttccatggacatgccctgtaaacctacctatattgctcattatgaaattaacttatgacaaatctttgttcattttacatttttctaaagactgttagcttgcattcatttggcttgaagtttctatagactaggccacagttattttttctttctcttgatttttcagatatgaatttgaattgattcattacttttcagccattatgttagatgcattccaaacagtgccctgcagggctatccagaaggagttttggtaaaaggagtgagtagttattgaaagctctattcctttatatgttataaaacaaaatggatttgctaaagccttccatctgttcctttatcattctttgcattaaaaaaaaaagcttttagaagatgcagacccagtctgaatcttttattgttcccatttcaactgacataaacaaaattattcagcgatgatattaaaatatgagctagtctttataagttgcatgactagatgaataagtataaatagtttttgtattcttcagctgtctatgagattatggttggtgtagatttgtaccaagtgatctgaggggtttctttaattgttagtgggagttgtggataaggatatttactcatttttgcattattactgtactaaatctaagccaattataaatgatcagtccccattttattctttttcattttgaaatttaaaataccattttcttggcataaatggtgtttgtttggcattttgaggtttacaaaaaccatttgattggcacgaaacgatttatttccatccaattgtcttgaatagggaattactttcatctagataactttcagattttagggcatgaaatggaagtattcctgctgggattctgattgggactgtatttactgtgcagtgaaccttcatttgctacaaatcaaggacttttccaaagcctttgagtagacttctgatagtggtagtaattgggactctggattaaaggtggtaacagagtttccatgtgctctgagatcaaataacattttagtaaaattagagcttagaaataggtgtgactctcgtctctagtttgtatatactcttttcacttttctctttccctctcattgtcctggcatttttccagtgcactggggatgaaagccctagtttagaaaaaagtatatacgtgcacactcacatgtgcacacacatgtatttgctttaaatcatatttcacaaaggagtaggtaatccgcatgaaatatgcagtcaaaaaggaagtcttatccatattttgagactctgctgggacatctatctttcagccattctcagcctctctggggttagtcttgctagagaattatatgctcatttttgttaaaacaacaaaactacatttgtaaagttgttattcatacttttttctccccttattgttaccagccaggtccaggtccattctgaccatgcacagtaaattaatcactgtgacgtgggttttgcagaagagaaatttattcacacagacatccagcaaggaggcaggagcacacctctcaaatctgcctccccaaagataaggcttagcgatatttatgagttagggaagtggggtggtctaaggcatggggaaaggtgattcgcagtggggaaaaatgaagtaatgggtttattctgtgcaagtatagtcaggattgatggcatttcataggacatatgtacagaaaatggcagcattagcataatctgagggtcaagttttgggccctctgaggtgaaaaggacatctttccggtgcctgtacaggctccaagttgaaggctaggtggtctcaactggcttgaactggacaggagctggcccaagttcttgaaaaacaaataaatcaaccattaccatggtgaccaatggatgttgtctgtaaagtaaccagtgaaggttaagtttcagcattcagcagagaggccttcagctacagtggctttcagcttcatggaaaaaagaaaaagaataataataataacaaaaagcaagtcagtgaaagcaaacagggctgtcagacccgatcaaattaacccctcggtttccttatagttactcagccatacttaaggttggtatgaaagccatttttcttcttattttatagatgaggaaacgttcagagaagttggcttttgggttgatcagcaatgcttggttttaaacttggctggctctctctgggaccagtgctctttcaggtacctggtatgactgtggcttggctttcaagctctttaccagatttcctacatatcattcatttacccaaaaatgtttattagtattttaagaatcttgtgtgctgccttttttttttagtgccatattctctcaattctaaatggcacatttttcccactactaaaattaatgtcccaatggcattttttttcaaaatctgagaataaattgattcaacagctgatgtcatagaaatgaggaagaacaatatttgcgttccatcactatgcctagaaaacctattacatgtcttgaattccctcttctcctacctctgaaaaaaatgtttgcttttgtgtgaaaactttatgtatctcagttactattatttctattcttacaatcttcctttattaattttcatgattctaaatttattttttaagtcactcagttttttcaagaaataatccttattgcatagttttttttttatcctgagagaatttgatctagtatctactagtttttcaaatgatcttgctaaatagttactgaggtttttcaataatggctggacttattggaatgtattttctccattgcgttaacataaacattatcctgtcttcaaacttacttatattccatgacatcttgtcagtatttttcagccctggtatgaaaaacaatatgtaagaaattaagttttataatttcttgctgactttttctgtctttgccttaactgctggaggttttgttaccagatatgacaggacctgagcagagtgaaatcaaggttgaaaaaaaattgaatgtctgaaccattgaccctaagagcaagagggaaggaagaagtggaaagcattccaaaatattatgttcaaaggactatggagctcaaaacctcagcataaagaattgaagtgaaatcaatggctccattattagtggattaactaaagtattgaacaggagaccaagactggatttttgttgaatgaaccttgcccacatgagaaaagttagtgaaagactcaactgaacgctcaatccaaggcatcctttgtatttgatctgtgacatcaaaactgtttccaacatgtgatggtcatgtttacattgtcttagtctggcttcattaactcattcaccatttatttattcaacacccactatctgtaagacactgtgataaacaagtgatatacaagataaacaagagatatacaagataaacaagagatatacaatccttttttttccccctatagactgtagtctattgggaaacttgggcaataaaataggtaattacaatgaaggctatagctttgatatcaggagttagtctagctccctctctagctctatccgtctcctttcccaagcccctctgcccttactttttgtttaaacagctctgatcatatcaagttattttgaataactttaaaaaatgcaggaagatatacagtccactgaccatatgcctcagtagtgaaaaaatgtgtttatgtatacctgcctcggaatgaagcttcctgtacctccaaatttataataattttccaaatattttctcagcttttttcaacacttcttttacagcatcctagatcaaaatgattgattttagagatttttattaaatattctttaactcattcctactgtatgctaggtactatgctatctctcaaggatataatgataagtaaatagacaggctgacatgctatctatacttaggaagtttacagtctagtggtaaatacacatattaaattaaaaatatgcaaatgacaagtcagcttgtcatacatgttaacagggaaattgcaagagcatagaatttcctcatgggataaaagtgagtgggagagaatttagatgaatgtgaaaagactgactcttggtgaaagtttgatttattttgaatcctgaagaataaagatttattcaagacacaacatgggggaataattagttattcccacattctcatatttagtttcatctcatctcatatttctagatttaaaagtttggtcatggttttttaaagatgtgaattaccttaagtctctaagtcaagactctgtgtctctaaacttggatcagaaactagctggagaaataagaaaagaaaaaaaagactgtcatgcaaatgtctaaccatttaaaatatgaggatttaaggagccaaaggcagatcagcaagtgaaagcttttcacttccgttaacatttctcattctaaattggaagttatgtgctatgacaacataagaagaggatttctaactcagagtaggagagccaaggaacatattctaaagcaactgatttcagaattgagacctaagtgataattaggagctaatcagaagagcagatggcggaaggagaaaaagtggaggaagatagcccagaggagtcagggagtcaagaaagaagaggaatttgagaacgagcccagaggcaagagggctgaaaagtcctgtagttcagtactcggagggtgctggtataggggaacagtggcaatgtgtcactggggaggtgatagggaaggcaatgagagacccttagattgtattaagaagacaagtgacttgattgaatttttgtctgcaagaaagctctggctactgttgtgaaaacatttttgagtgaggcatgactgtgaagcagaaagaatactagagggtagtgcagtaaccttggatagaaatactaatgacctagtctagtggttaccaaactttgttcctcaaacactcccaaaataattttgtaaaattgtatatcatctcatatacttgtgaattgacataaacattcatcataagtttaaaccgttgcaaaatgtaattttcagcatattgtaaattttgccattttaaattgtctgttgtattactcttaatagtatccattagagtctgaataataccgagattcaatgctcgtcattatctatttaaaaatatttgatatatctcttgcacaactctaaaaattttgtgccatttttttctttttaatttctattttcattctcatggatttcactcttttattatatatcatatgctcaaaagtatttaattatctaataatgcattttagttataaaatggttataatttaattttaaacatttcctataaggttttaagtgttaattatttttctagaatgagttgtcaataaaatttttattattgaacacttgaataaatctatataactacatttcaaattctgaaaaaattgttactgacaaaagaagtacaactttattggcaatgtatagcttaatgtaacagacgggcttttaaaattttaatccctctacctttgggagaatgttacttattgccaaaattagacagagtttaatattaattctgttttgaatttgatctattgtcaaaaattatctttaataaacttaattttgttgaatgcaaagaaatggaaattgcttgacttacgaaataatttagttgctagccattcactttctcaatagccataccagtatttctcaacatttatatcagttatctttttgtttggtgctcccaaagagtttacatgctcaatcaatgcacattaaattttgggtgggtgagaagtatgtctttcttctgtaaaataagaggaaggtaactaggaaagagggagctggaaagtagagcctgcacttgtgtctgaagatagagctgaagataaatgtatcttaagttaattatctaaaatctttttccaagtacaacttggaaggatttgtatgccctcaggaatatatatacaccagtttaaagaccactcagatagattgaggcagtgacaatgacagtagaaaaaagtggaaagacattagaaagaaagagaaatataaggtgaaaaactcaataaatttctgtattgtgttagattggtagcatgtataaaagttctagaagtcaacaagagtgggctacattttaaatattcctctggagagtagaaaatcgctgagtagggaaatagaatgatttgcctggtatctggagataatgagtttatagggctgacctgcaaggctgtacaattttctctgcagtcatcagccacaagggtgaagatgcagagaaagcacaaagttgagggctttgcgtgctaatttcagaaagtcgattttgagggatagtgaattattatgaatgaaaattgataaatttcaatttctctgggcaagataaactaaaagtggactcaaacagaggaatgtatgtgtagtagtaaggaagatttgccaaagtatgtcaggcagggaaaagaacttgaggaaaaagtccagcagcaggaggtctgggatgtcctgcaaggttgactttgaggtaatccatacacaaaaataacttgagaatgcatagttccgagaaacaacccctgcagatcaaagcaaagaaagctgccataaaaataatcagaatgacattcaggagacaaagttctggaacattctagactctctctctccaatgttttacaaacatatacttaaagcaactatacaatatataacacactggacattatattatttgaaactattgacatacatattaataagagtttagatgtcaacgtataatatgcaaaggggtacataactttttaagggggttttgtaggcaaaaactttgaagaccactgaaatgaagtactgagaactagaagcagaaatttagagataatgatgtttgtctagatgctggggaatatgtgatgctgaaggttggtgctggtagacttagagtcaattttaataacaaatctacacaacttttccaaagaattgtatgactatgagtattccaaaggtgttcaccaaataagccattctaagaatttggtagggctgttgaaaatagcaaaggcagtatgggcaggtaatacctcttttagtggaaaagaatttgataaattcatcttcattactacattctagcttgcagaggtttgtgggcagtggagatgtcttaggaactttgatgaaagttgacagagaaagcagcctggggttagaaacatttatacctttaaatcattcacaagaaatgaatgacctgaaagcaggtgggttctcagaaaatagacagaactatggtgctgctccagtagagaaatgaagttgcttcccgtggaaaaagtcaagtcagaaccttgatgccttccagcaaaatagtattaaattgatgaattaaatttttctaaatgtgtttttgcatactcatacaaaagaaaatctcggaaaagtcagtcattgtcaccttccaggtacaaaaagctgagctctgcatacacagcccttcatatttccagagatagcccaggccctaaacaggatttggccagcttccttgactctctgtatgaatctgcaagttcctttgtgttttgtttttcttgtctctggtagtggtggtggtgggatattactttttaattctgtgtacacattgccacaaatttagcaactgttaaaacatacttggttatctcaatttctttgggttaggagcatgggcacagcttagctggatcctcggttcagaatctcacaaggttgaagtcaagtttggctgggctgtgttcccttctggagcttggtgttctctttcagttgttagcagaattcagtgccttgtagttacaggactaaggtcctgatttcttgctgtcagctctgagaggtcactccctattctttgcccttctcactgcaccttcatttggcctctcccaacatagcagctcacttcttcaaggccagcaggagacccctttctcttctggaagggcccaagccctcttttaaggactttcacttgattaagaccagcccattcagaataatttctctttcaattaagtgagaaccaacttatctgagaccctaattaagattaacaaacaatatgaaaaaaagctgaacatcacagattattagagaaatgcaaatcaaaaccacaatgagataccatctcacgccagtcagaagggcaattactaaaaaagtcaagaaacaacagatgctggagaggctatggagatgttggtgggaatgtaaattaattcaaccattgtggaagatggtgtggtgattcctcaaagatctagaaccagaaataccatttgacccagcaatcccattattgcatatatacccaaaggattattaatctttctattacagaaatacatgcacacgtatgttcattgcagcactattcacaatagcaaagacagggaatcaacccaaatcctcaacagtgatagactggataaagaaaatgtggtatatatacaccatggaatactatgcagccataagaaggaacaagatcatgtcctttgcggggacatggatagagctgtaagccattgttttcagcaaactaatgcaagaacggaaaaccaaacactgaatgttgttacttagaagtgagggctgaacaatgagaacacacggacatagggaggggaacaacacacactggggcctgtcagagggtggggttgggggagggagagcatcaggaaaaatagctaatgcattctgggcttaatacctaggtgatgggttgataggtgcagcaaaccaccatggcacatgttgacctatgtaacagacctgcacgtcctacacatgtaccccagaacttaaaataaatataaaaaatttaaaacagatataaagaggagatgatggtgaaaggggatgaaaaggttaaagaatatggagaatagacccataagtaggtaaaataaatgactaatagactaatagttccagaaggcgagaacagaattgagagatgaggagaggggtaaactatggactttagttaataaatatcaatattggctcatcaattgtaacaaaagcctcacactaatgtaagatgtaggatataaaagataagataatagcggaaactgtgtgggcagatgaagggggtatatgggaacctatctgatctttttatcacaatttttctgtaaacctaaaactgctcccaaaaagttattaaaataaataagtaaacaaattgtgcaatggaaaaaaaaacaacgacaaaaagattttctttttttgcacttttgccacacagtattttttcacttttgtgtaacctaatacagagagtaatatcccatcatattgacagcttccacccacattcaagggaagaatcaacaggagcattatgctgggggtcagggcaagaattttgagatcttacaattctgtttaccacaggagtgaagggtacagaattatagtgatatttgattatctatatcctgtcactttattataaaattacttgattcaagttttaataaatttttaccaatgctaatgttttcaatttggcttgcttaaataattcaccatccaaaacttttctactttcaacatttaaaactgaagactgctttttatagctgatgtcagtaaaaaatctattaatataattattaatcatacttttccaaaacttttccaactatactgttttccttgaaatagaacacccattatcttacatattacatttgaagtcttcacctgttacaaaccctataagacttttacattttttctaattctttacataatattgatcagaaatcggatttttaaactcattaggctcaattcaacagacaaaattcatctttataaacatatattgcatactttattagctagtcagtttgccaggatataaaactgaaaaagattattctgttctcaaatagtttgtgaaaaatttcctgatgatacattaggataatttttaatattttgtctggatgtcttctaaggtctggtgcaatatgtgtgatgtcttctttaataacacttatccagttttgattctctggacaccaactgggtgttcaacaattcaattcaattgtgcctttaatttattggagttagtgcagaccccacaggttaatggctcagtcttacaagattgccccccacttcagatgccagttgcaagcctcaagcttcctgtatttctgatcaacgggctacaaattgcaggctcccacgacatcttacacaggtttaataaattgctgtaatgtctcatagaactcaaaagaatgctacttactattaccagtttattatgatggatgcaactcaaaaacagccaaagggaggagatatgtagggcaagtatgggacaaggggcaggagcttccatactctctctaggcatgccactctcccagtaactccatgtgttcgccaacatggaagctctgcaaaccccagcatttagggattttaatggaaagttattacttacacatgattcattggccattggcagaaagtttgaggtggggctgagagttccaaacttctaatcaaggcttggtatttctggcaaccagctccctcatcctgaagctatctaggggcccacaaagagtcaccttattactacaaaagatacttccatcatctttaacactcaggaaattccaaaagctttaggagctccgtgccaggaacaggggacaaagaccaaatatctatgttaccactcagggtaatgtaactaccaattcagaaattatcactgtacaacataatttaaattactttggaaagaaacacatggctactttaaagttaattgaagcctatttgctaacttaaagaacatatcacattttcttgacatttgccccaactgagttggcttgtccatgttaagtttttttctctttctgcagacttaagtgttttggctgcatttgtctcagcccatttataaaacattagatgaaatgttttatctaatgctcctagcactaatccttagggaactctgattaaaagttttctatttagaaaaaaatacatactcatgtttaaatttgcctgtttaaaaaaaaagtagaaatgtctctcaagtacctagtgaaacatttttaaagttttttaatggaatcttgtttcataaattaagaaaataagtgtaagtaatttctactagttttctttctctttgatttttttttctcttagccagagattatttaggaatgtatcttccccttgaaatactgctggattgctccccagtgcaccattttattgtagaagtgagattcactcactctataataatccttaagaaccgttctgtgcctatttatatttaccaatttctttaaaagaaccctcttcaaaaaagttattttcagtttactcattaattttttattggtttcctttgagtttacaatatgtatctttacttaatcacttttgaataatattatgccactttctatatagtacaaccacctttacaacagtgtacttccagttctttctgccgtcactgttactgttgtcatacatggcatttttacttatgtcttaaacctcacaacatattgttactatttttgttctagatagtgaattttcttttacagcaattacaaattaggaaaaagtgggagggttgcttgaggccaggagtttgagggctaggagtttgagaccagcctgggcagccgagtgaggcccctgtctttacaaaaataaagaaaaaaaaaaatagctgggctgcacctagcttctcagaagtctgacgtggaacaatcacttgtgcccaggagtttgaggttgcagtgacctatgattgtaccactgcattccagtctgggtgacagagtgagaccttgtctcttaatacacacacacacacacacacacacacacgaaatatttttcttatttaccctatttttacttttctgatcctcttcacttctttctgtagatccaggttgtgttcagtgtcatactctttctgctgtgcagcccagtttctaacaggtcacggactggtaccagtctactgcctttcacatttcttaaaatgtgggtttccctttatggggtttacagaggttactgatttctcctgtagtctgacaaaaataaaatgttacatgtgtttcctctccttttggagaggtttggctttttttgttacccaggttactcggtggctttacaacttcaggtctctgatacactcaaggaaagttatgaatatcatctggcttttttcacattgttacacagaggcgagattctttgaagctttcagcatccaatgcagaagcagaagtccactcacaattcactccttcagtgattgtatgctgtattgtcaatgtaaaggtcatgaaaaaaatctccttgttatttcatgaatttaacactcttttctgaactgggtaaagactccttctttcactgaatttgccttaataccaagctacatctgtaatctttataaatactgaatacatgcttattgaaagttacagagcaaactggtttttctccccatttcatcctaactgtatacataatattttgaaatctaccattactataaactagaagcatttttatatttattaaatatttacatcttttctctaccttattaaatgaagatgtattaaagaaagcatgttttaactttagtcatttaaaatatagctatcacatatttgctgttttataggcattgaggaagatgttcatgagagcactgtcctaatgacaaaaattgggttcagggaccttgatattttatgaatttaaaatgataatcttagaattattgccaaatagaactgcaggaagtatattatgttcaatgctggactgttagaggttctgaattaatgtttatgaatataagattcatccatgatacttaagaaagctaaaattgttgggattttccttctatatactgttatttcagttaaaatataattgatgaatagataatttataattctaattctaaaatactgtaattctgtattagacagaataggctaagataaaataggcaacaattgtattaacaaatatccataaaaccttaagtatttgacatagtaaaggtttattggctattcacatcacagctaaatgcactaatatcctatctcttaatttatgtatagcaaataacctctaaggattccctgtagtaggagtccccagcccctgggcagtagactggtaccagtccgtgacctgttagaaactgggttgcacagcaggaggtgagcagcagatgtgcaaatattaccacctgagctccaccccctgtcaatagtagcattagattctcataggagctggaaccctattataaactgtgtatgtgagggatctagactgtgagtttcttatgagaatctaatgcctgatgatctgtggaacagtttcatcctgaaatcattccttctcatctgtggaaaaattgtcttccacaaaactgggacctggtgccaaagagattggggattgctgctgtatagaacaacaaagggctggaggattaggtgggatctggaccgaccttccttccttccttcctccctccctccctccctccctccctctcttctccttctcctccttctccttctccttctgcttcccttcccttcccttctctctgctttccttttttttttttttttttttgacagagttttgctcttgttgcccaggctggagtgcaatggtgcgatcttggctcactgcaacctctgcctcccaggttcaagtgattctccttcagcctctgagtacctggggttacaggagcccgccaccacgcccagctaattttttgtatttttagtagagacagggggtttcaccatgttggttaggctggtctcgaactcctgacctcaggtgatctacctgccttggcctctcaaagtgctgggattacaggcgtgaaccaccatgcccagacctatttttctttttcttttaataactttattgagatattattcacataccctacaattcacccatttaaagtgtacaattcactgatttatagttgtgcaatcattaatctaatttcagaacatttttattccttaaaagaaactctataagtgttggcttcattctgcccccatcccctcctcttacccctgagcaatcactaatctactttctatctttatgatttacctattctggacacttcatgtgaatgaaattgcactatatgatttcataccttttgtgaattttctttcacttagcataatgttttcaaggttcattgatattgtatcatgtaaaactacttcattcctttttattactgtataatattccattgtataaatataccaccttttctgtatccgttcattagctgatggacatttgagttgtttatgctttttggctattatgaataatgcagcaatgactatctgtaagttttgtgtagatatatgtttttatttctctcatgcatacaattaagggtggaattgctggggcatatggtaactctattcttaaatttggaggcaaagttaccaccaaactgttttccaaagtaacagcactatttttacatttccaccagcatgaataaaggttcctttttctccacattctcaccaaaatttcttcttgccttttttattaaagccatcatagtgggtgtgaagtaatagtttattgtgggtttgatttgcattttcataatgagtaatgatagcaatgatttggatgtcttttcatgcgatcattgtccatctgtgtatcttctttggagaaacacctcttcaaatcctttgtttatttatctaattgggatttttgtctttttaagtattgagttataagagttcttttataattctggatacaagtcacttattagatatatgtcttgcaaatattttgtgctattctgtgagtagtctcttcactttcttgatgatatactttgatgcccaaaagttttcaaccttaatgaagtctaattctatttttgcttttgttgctgatgctttttgtatcctatgtaagaaattttggcctaactcgtggtcaaagatttactcctatgctttcttccaagaaacatacaattttagctcttacatttagatttatgacttattctgaatcatttttttggtatggtgtgaagtaggggtccaaacttattttttttgtatttgaatatttagttgtttcagtaccatatactcattgaactgtcttcacattcttttcaaaatctattgaccataagggtaaaggcttatttccatactctgaattctgtcctattgatctatatgtctattattaccaagactacattgtcttgattattgttactttgtagtgaatttgaaatttagaactgtgaattctccactttgtgcttcttctcagtactcttttggatattctgggtcccttggattttcatattaattttaagattggcttgtcaaaatttgcaaaaaagtcaggtgaaattttgaaagggattacattcaatctgtagaatactcttgggaatattgacatgtaaaatatattaagtcttctgaacaacgaacataagatgattttccattaatttaggccttttgtttcttaaacaatgttttgtagttttcagtgtaaatttcttgcacttctttcatcaaattctttcctaagtatgttattcgtcttggtgctattgtaaatttaattatttttaaattgtatttttagattgttcattgcaagtatatagaatatgattattttttgcatatttatcatctaccctgaaaccttgctgaattcatttattagccataatttttttagtggattccttagaattttctaaatacaagattatgtcatctgccaataaaaatagttttattcttttttcccaacctgggtttattttatttctatttcttatctatttgctctgtccagaactttcagtaaaatgttcagtagaagtggtgaaagagacatctttgtcttattcctgatcatatgggaaaagtattcagcaattcatctttaacataatgttagcagtggattttgtgttgatgctctttatcaagttgggaaagtttccttctattcctagtttagtaagcatttttattataaaaagtgttggagtttgtcaaatgctttttctacatctatgcagggtgatcatatggtttttgttctttattctattaatatgatgtattgcatcaattgatttttggattttaaactaacattgtgttattgggaaaaatctcacttggctatgatgtataatcctttttacctatctagccagattcagtttgctaatattttgttgataatttttacatttgtggatctcactcacctgtttatttttttatatattttacattgataactagatgtcttagataataacatcatagcaactctggatactgatttctccaccttgctattgttattgttgtttagtttttggtcatttgtgtatttgttttgtgatccagctgaaataactttgtgaagtctttctgtgcaggatgtttttaagggccaggcctaaaagttacatacatcacttttgccccaatcccaaatgccagaatttggacatgtggtccacacctaactgcaagagaagctgggagatgtagacaagcacagtgttatttggtgagcaccagaagtctctaccatcattcaaacttctagttatcaaatatctcttttccacatttaatgtaccttgttgtccaaggagttcaatcgtaaatcactgaattccaagttgaagaaccctcaagtcaggaaatgcatccacttggtctagtgacatagaaactaaaaagacaaggtctccccacaccccatctgcatccatacatgcccctaacctaaatggtggggcaggggaaagaaaaatatatctaccattaataaaatggaaggctggatgacacacaatgatcactaatctttctatgagatattggtcaaaggacacaacatgtcagctaagtaagaggaataatttcaacagcatgggactatagttaataacaatgtattgtatttgaaaatctctaagagtccatgttaagtgttttcactacaaaaaacaataagtatgtgaggtaacgcatatattaattagctcagttgaaccattccacagtgtatacatatttcaaaatgtgttgtatatggcaagtatatataaattttatttgtcaatttaaaaataacttgtctgcagaaatactagaatcctttaggacagataatttttgaagtttttctgctctgacagtgagggaagtctcctgagactcattcatgctctgctctccaagcatgaatttttctctttacttttctctttactttgaatgaattttttctctttactttgttaaacgtttactaatataaaatggagtcacactggttcctttctgtaaagggagagaagatgggctttctgagtttattattattattattattattattattttgttgatatctttggtggtacttttatatttgtgctactgtggttagaaacaccactggattacatcttagctttgaacctaattttgggacctgttgtaatttctggttttagctttactactggagaaattatttgctttgagaagttaaaagtgttattgagtcccaacttactaagatcttttagattttattatttcttgagataatagcttctatttcttttctttatttttatttctaatgtatttcctttctctctgggcataagatcttcaccaccataaataaaaataattatcccaatggaagttttttatttattagaactaggaggccgtttgaatgctaagttttctctatacaaagatcattaagattttaatttggatgaaaatttgtaatttgtaagtaaaatttcaaagcaaagcttctaatccagtctgttaaacgggattacagaggattacatccttggtagatgggagcagagattcaggttgagtcagtacttatgtggttcaacctgaatctgaacccagaatgccagaggaacagtcgctataataatttctataaagtctacaaaagggtaattaaggatgctgaaaactgacctcagcagtagcattcctttactcttcacttccacggacctaactcccctgctctctgcgttagcctcccggaactactttcacctccttaaaaattgccctctttgctcctcttgatgcttctgcacctgctccctctgggtgataggttgccattgatcctgtggctgattgtactgcatcccagcctgaacacctatccctgacaatttcatggtctttgtctctacgtgcagtcaattataaattctgtgtggattgagaccaactgtgttttctcttcccagcagctgtaacctcacatgtcccccgccactggtactgtgctagaaagcaataatagatgctttaaaaagagttgtcatatgaataaaatctcacccacttctcagttttgcttgagttacggaccttgaagttagttatttgctatttagaaattttgatactacactgtcattattcatttcagatttttttcagaaatattaaagtcaatatttctgtgaaaattgaaaaaaaattttatgattaaatttctattaattttgaataaaatgctacattaaggaatgaatgttttgatagtttataaaacacaaaataatactataataatttaagtgatatacaataataatttaagtaatattctttaaggtttgatctaaggacacaaatatatgcattaaatattgaaaaaaaataaggatgacaggatactagatccatcatttcattcctctttttttgttttttgagacagggtctttgtcacccaggctggagtgcagtggagctatcacagcccactacagccttgccctccctgggatcaagtgatcctcccaactcagtcgccagagtaagtttggactacaggtgtatgccaccatgcctggctaacttttgtattttttgtagagacaagtgtctcactatgttgcccaggctgatcttgaactcctgtgctcaagcagtctgcccacttcagcctcccaaagtgctgggattacacctgtgagccaccgtgtccagtcttcattccttttttatatacatatattattatagtcaattcatcagaatgaactatagttcataggaaaatattttgtatatagtttcttgataaacaatgcttgttattatgctaaacctattgcaaaatctatagtggtttttcatatcatgttgctttcatggtttgcaaaccaaacacaaatgaactattagaaccactaattattttgtctgttagtgaagatattggaatggaaattattttgagtttcaaaggtaaatgatatactctgaagacaattattatttttctcatttaaaatgtacattgatatggtttggctttgtccacaccaaaatctcatcttgaattgtaactcccataattcccacgtgttgtgggaggaacctggtgggaagtgattgaatcatgggggtgggtctttctcatgctgttctcatgatagtgagtgggtctcacaagatctgatggtttcaaaagtgggagtttccctgcacaagccctcttgtctgctgccatgtgagatgtgccttcaccttccaccatgattgtgaggcctctcagccacgtggaactctaagtccaataaatctcttttttttttttctaaattgcctagtcttgggtatgtctttatcagcagcataaaaattgaccaatacatacaggttccattagaattattcaaagaataaagcaaaaatattaacataaaatgactgagttactggaaaatgggactactcatggcagaatctgttgtaacaaaagacttctttgtcaaaattgtcatttcatttgggatctctttttcaattctcaaggcaaaaataagataatttatatgtatagtttaatttgcagtctagggagacttggtatataactctagccataatgtttatttcaacttccatttttttgacataaggcactcaatcagacagataatagattttcatttccaaacctaacatttctggcagtcctgggcagcactttctggagggaaatcaataaatcaaattttaatcagtatttattgagcacctgctaacatagatgctatggtagggaaaggttatgggtgaaggaatgacagaggtttatgagatattgttgctgatctaaagaaatttttatgcagaatagatgcacataagacacatgcacgcacacacacacataccaacccaaacacaccgtcacacacaaataaataaaaagcttattatcgttgagcttggccagttcataaatggttggtctgagtggaaagactaatgagaactacagcatccttggtttgcagatgtttccatcttgtgttatatagagttagcaaacaagtatctaagaataaaagtgagtgaatagatgcagttcctccttgaagcatacctgaattttgtgctctgtctacctggaggagagagatgagtgaggattctgccaggacagataaacataaaccactgtctcacaaccttttattccctggaataatcctaactaatatttctcttgctaccataaaagacaattctttgttgggagtcagttatgtaactagtgagaaatccctaagtagtgacttggatctgttacagagaaaaaaaaaaaaaaaaaaaaaaaaaaaacagaagaagcagctagaggatgataaacacagggtatggtattctgtgctatgttcaggaagcaggctggagctgagatagattgaatactatgggacttacataatacctaattgcaataagttttcattgtatgactctagggagaggagaagtatggcttaccctttaaaagatcattctaagcaattttatagagagtagactacagggaggtcagttgggaggcctggactacagtagtagtggaaatatggggcaaagtggttggatttgggatattctgaagctagactctaaacatcttgctaatagattggatatcaatggagagaagaaggacaatcagtaatctctgttttgtgcttgatcaactgagcgaatgttagtttcattctctgaaatgatccccaaagagacagaggaagaggtaaaatgttttgtataaaatgttaaggttatattttgcattttacatttccaaaatagaattaatttggctaaaaatgatcatgttcaatggagtgagtcagaccaacttgcataattctaagataatttgaatactcatctgttatttttcttttggctggaggttattgttggtggtggtagtttgacagaaaaaatgcagattttttggccaactatgagaaggaaaaacttgacacagaaaaaatctggtttattgagtgatttctagaaatggaaggtatttctattttcctaaaatgtgaatttatatttgttttttgtccaccactgaatgagattggatagtctttgagaggaaatgataaaaaactatttttacttttatggggcccctttcttgaagttacctcggaagtcatctactgtgaatcttgattttatagtaggagaaaattgagctattataaataccaaatgaattttaaaaagatcttacatatttaatcagtcagcacagaccttgagcttaagagatttcggtagggtttttccgttgctttgtttgtgtgtgtgtgtgtgtgtgtgtgtgtgtgtgtgtgtgtgtgtgtgtgttttccctatcatgatacagaaaatcacaatcattatttacaaaattaaaaacttttagtgtatagttatgtcaagtgtaacaaatcaatatcaagtatcaaaatcattaaatgaatttgtgtggactcaaataaaggcttccacaatataaatgaaatgctctgcttaccctgccttgagtatttctaactatatagttatcttgagagggcttagcgaaatgcctctgatattcaaatggcctttgaaatactgattatactgtttacaataatagtttgtattgcatgtactaagcattttttctttctttttttttttttttttttgagatggagtctggctgtcacccaggctggagtgtagtggcgctatcttggctcactgcaacctcagcctcttgggttcaagcaattctcctgcctcagcctcctgagtagctgagattacaggtgcacaccaccacgcccagataatttgtgtagagatggggtttcaccatattggtcaggctggtctcgaactcctgaccttgtgatccacccacctcggcctcccaaaatgccgggattacagtcgtgaaccaccgtgtccagctgtactaagcatttttatagtcattttcttgttgcatatttacagcaaccttatgaatctggtactattattaccccattttaaaaaatgcataaacttaggttgagaggaaagataattgcctcaaaccataagaaggtaagcagcccatccaggacttaaaccccagtcaggctgacaccaaccccatgctgctgtctactctcctctgcaattttagtagttagtaacccaataaaagtatcacaatcatgtgactaaattcttacagaaagtggaacatattataatgaagacagagaggcattaggtaagaaacagaaaatgcctaagtaaaaattctaaaaagtgctataagatatacaaattattttaacctttttacacacaaattgcaagaattatcattagtatatattcctgaaaattttagcaatttgatttcctgtcatattatacattatatgtaatgaaatatggtgtattataaaatgtataagacataagcttaactcatgcctcaaaggatagttataatcctccttattgaacacaactttgacagagctttcttgggttaagcttttgattataacacatgtattttaaaacataatatagattctccatattggtttgattgctaaaatattttttaaaccaaaacatgtaaaatttgagcaatttttctttgcttcttccaaatgttcctgttaaagttttagtgtgttaggccaaaggatatttataatgatatgaaaagccttaacatatgtttttgcagtccatgatatttgcccaaggatcttccttttagaatacaatacaattttaagatgtaccaatatgttttaaaggccatatctgtaaaaacccaaaacataattcaattctaaatttctccactctttcatcctctacatttttttttgtcagtttattactctgtagactaaaaatctgtaatggttcctcattgcccccaaactaaatatgtaacaatagctatcaactattggaatatctgctgtgtactgggccctttagtacattacctctcatccttccaatcacctgctacatatagagacaggaaaactggagcacagggagctgaccttgaaacccatgtctatttgatttgaaaatcttgtattctttccactagaaatgatggtacctcctatttagtaaatgcctaccatgttctaggcactatactcaggagtttgggttcaaatcccagctctaccattcccaacccatgtattcttgggatcattacttaaactttctttgcctcagttttcctatctataaaattaggtaaataataataataagagtaccttatagggttattgggaggataaaatgaataatctatataaagaatttagtatacaacctagtaaatacaaatacgtattagttatcattatttttattaggaaatacttcagatatacaaaaacctataatgataataaatatcaaagtcacaacgaaatttaaaggatagaacattataaacacaattggagcacatgttattttgtagctcagtatttatccttcttgtgcatgcttttgttctttcattatagatgtgtatattattttacagatgtctaaattataaagcaatatatagaaacattttcaaattttttaatggatgagaccaactgcattttttctgtaacctgctttttatgataaatatgacgcttgcaaaatccatcataattgacaaatgaggctctagttcatttattttcactgctatgcactatttatgaatgaaactgcagtgaaactagaataagtctattgtaggaatgaaactacagttcattcatccacgctattattgatgtatatttaggtgtgttttaaaacttatactatttcataaactgctatagcataataaatgatgataaaaataatataaaacactttctaatgcttacttctcaggcaatgatttacatatgttgaatcatttaatctcataaaatctcataggaagaactattattatctacaatgtacagatgaagaaagtgggtcaacttgacacatctggtacatggtgttcctggaaataaaaataaggtaatcaggccaagatgtagctgtcttgaccacatgtgcctttgggcacacgtatatacaagagtgctctaggactagttctccatcttgtctgcacattaggatcatctggacacttaaatataatgactcatgcctaaacctctttccagataaattgactcaaaatagctggggatcaagtctagacataaatattgtttaatctgatttttaattaaacttcttgttctgagataattgtaaatttgcatgttgttgtaatactatttaccatttacccagtttgccccagggataccatcttgcaaaaccatagtaaaacatcacatccaggattgacattaatacagtcaagatcctgaacatttctgtcaccacaatgatccctcctgttgcccatttgtatccacacccatttccctcctgctcatcccctccttaacccctcacaatcagtaattggttccatatttctgtaattttgtcatttcaggaatgttataacattctatataaatggaaagtcaattccaaaaggttgcatactatataatggaattccattatataggattatattataggattctattacacagtgtgggatcccattatataggatttcattatatatacccttttgggattgaccttttttaatctatcaaaattctctgcagattcatctaggttgttgcatgtataaatatttcacttcttttatagcttatagtagatcatggtatgtaagtaccacagttggtttaaacattcacctgttgaaggatatctggattgttttcaggtttttttggctattaaatataagcttctatgaatatttatttacaagtttttgtttgaatgtatgtttgcatttctctggaataaacaccaaggaatgcaattactaggccatatcacatcctgacttattcttgtcttttaagtaaattgtgttaactggccaacacctctctctttgatcacacttaaaggtcaaaaagtcagtgtctatctcaaggtaacattattttttatctccaataatgattttaccaccaatatttttaattttgatatgaatattatttctaagaaattggagatcacaaaatagctacaggttaaatattgctgacatcatttagtaaaagccaaaaaaaaaaaacccagaaaacagtttaaggttttctaatctacagagcaccctacaaggaaattaatatctgtatgcaaccatctcactagctttgtttaccagacacggcatgtgagaaagaaaacacttcaagtgtttaaacatttctaaaatcaaattcaaaaaagcatacttttctaatgagatgttcattgacttgaaaccaaagtaacaagaatgctttgaagaaaatatacccaacaatttgtatagtaaagtgaatatagtgttccatttaaacctcatagaaccccatgaaaaaattaaccaagtaagattggatgatatccacatcctagaggcatgtttcttatttattggaaatttgactaaaccatcaatatgaccacctttattctcagatatttttaggatactagagccaatgaatataatgttctattaaggagaatatgtttaaataatcacagaaattaaatatcttattccattattatttaaaaagttgtatgtgtctatttttataccaaaacatttcctattaaacatatatgtatatataataacttttcttattagctttgttttttcctaccttctgcaaccagaaatttctctgcttccttgagacagaaacataattgtgtatctgttggacaaatactattttccttttttaacaaaactttttgatagaagagctttatgttggcatcattttaatgaattcaatacattcattaaagaagtggtaagcctaataatatatttgcttctgtgcattatttttctctaaattttgggctacttgtctttgtatactgtttcaaaacctaggcactcaagtgtgtcattttccattgcaattaatcacttggttttgagctgctctaagaactgaatttcgccaaaataattgtgagtatgaactttcctgtttgtgagcttcttgaacaagttggcatattttcccttcgacaactgtcaccatctgacaatttgctattatagctagactaacattaagatttaagtatctaactctgggctcagtgaaggtcaggcatatttagacagttttccacagaaaagtttgaagttaataccctgagtttccttgaattgcatttaataacttccaggttaaaaccccaaatggtagaatcaaataaacagactcatggcataggtcctgagagatgagcaactggagaaagaggttcagatgagattatttcctctgaaagtactagttcctattgtcatggaggaaagaagatctagatgaatattcatataacccagttttctgcattgcacattacagaaagtctacagagaactctctgggagagtgagtcagaaaccaaaatcaatctgggacaatatatcatttattttcatactggaatgactttcaaatcgtctacttttattgttgttaatgacacaagtttctcctatgtaacagtctctgaatcaaactaagaaaaggcataaatatactgatgaggtttatataacccatgtctaaataatcagaacaaatcactaatggcatttaaaatattccaaaatgcttgttacttcaacttgttctctctataccatttcatatgcctgtttttctgatacttacttcttttgttgccttatccaatcacaatcaggattaaagcttgggaaattgagaagtgacccaaatttattataggcaattatttttccacttctgcctatctgtccctgtaaactttcccctcatcatctgatgcctaatatattgaagtccccatcctgctatcttcacctcttccttccccaccaaagaaacagttttttccttttttttttttttttttttttttttgagatagagttttgctcttgttgcccaggctggagtgcaatggcacgatcttggctcatagcaacctctacttcctgggttgaagcgattctcctgcctcagcctcccgagtagctgggattacaggcatgcaccaccaagcccggctaatgttgtatttttagtagagacaaagtttctccatgtttgtcaggctggtctcgaactcctgacctcaggtgatcgccggcctcagcctcccaaagtggtgggattacaggcgtgagccactgcacccagccaagaaacaattaaaaaaaaaaaaagaaccctgttctctgatcattcacagtaagttataaatagctcataaaattactaaacatatacaaaaacaaatcacattttacaaagagggcaaaatggtctagacttaacatatagaaagcaagtcaattttttctccaactacaaatgactgacatgttcaattagttttaccatttttaaaaaaatcggagtccattatccagaactcacatgaggaaaagtttagacaaaaatggtaaacccaaatcacctacgcaagatctttatgaatgggtgtgatagtccattatgtgtaatgttactgaactagtagctgcaaaacttttgtctattttccattttctgatccctcttaggaagtaataacacatttttgtaattcaatagctatcgccatgattcccgaaataggggcctactagagtattttacattttttgagtgacacccaacttctttatctttcagatctcaatattttgttttatgaaagaatcaaagtaagaaacctaagatatgaaaaaacacttatttccaaaggaagagatcatcctagttgttcgaaggcttacatgcttaatgcactttctatttgttaatgagacttgttcacattatatagctttcaattagttgttttgaattaatttttcatagtccatataaaattataatattacaaaaataaaatcaacacgactgaggagtctgaagggcagcgaggtcacatatcccagccttggtttattcagagattgattaacaggctgtgccttggagttggctcatgtgcaagaactaaatcaatgtcatggtttttcatgttgaaattttaaggcaccatgatgactttaattatatatattaaatttatcaaatattataaacagcacactttactgtttctttatagaacattggttggcagctcttttcgaaaaccagtcacccatcagaattttatttactacttctccaaaggattttccaatattcttcctacagttaagtaaaggccatttctctggcatgtgttttctaaagtcccttagcttactcaaatattctaagaaaacaacaaagatcctgcttctctaagcaataccagacataaaattccccaaagagaaataaattgagcattttatgctgaaccaagaatgttctccttctctctccttttttatatgttatgcaaaatgagccaaatgatggggattaggaatgagaaaaagaaaattaagaaaggagtgagacaaaaatcaagggtctagtattatatcacctaaaaataagatatgtgtcaggcagcaaggagggagattacagaaactaactgaaggctgaaataaaaatatgcatagatttgttcttgatttcctatgtataggaggaaattatggtcctctgtgagaagacaggttatgaagttcacagagacacgtaaattctttgttacaatcaatcctacttgtgttatgacttttgccttttgtgaaactttatgtccttgttttttttctctgttgggcatttagaaatttgtatcaagataaagaaaaaataggtaactcattaaaagcaagaaattcgtagtgattattgcatgctacatgaaaataaacagcattgtcttatcaaacaagctgaataaagattgtgaaaaatgtctgtagtaatacctttgctccaagaattttagtgctaactgctgcaaggaatacaaaatggtgtaatacagagtgtactctcaaggaacaaatttatttgaggtgacgcaaagtcataaataatgtaaatattatataataaaaagtaaaaagcagattagcaataaggaaaaggcagattatatagtggatacatactatgagtgtattcatttattcaacaactatttcctgattgtcagtaaacctaaaatcagctagattttagagatccaaagattattgtgaattggacaatttaggaaatctgagtaagaggatttccttttagtaagtttttatgtacgtttgaaggggatgtaggagaatattctttcctaagtggatgtaaatacgtttgctgagtaaatggttataaagaaaataataaagtcatcaagttttcaggatataatgataaatacctttgtctgtaatgccaagtacaaatacatttctgcttaaatgatatagaagtgagaatgctagaaaggagagattttaatcattattcaaaatatttgctattggtgctatgtgcaaaaagaaactttactcttaagcaagtagatgatgtagtaaaagattgtgcgtcacttagtactcctttgacaataagtgtcagagaacccagctaaagctgaccaagaaaagaacaggtttgtattgatacatacgactgaaaagttcagaagtaaatatggctgtacgaatactctggaacacagatgatttaatcaggaacttgtttttatccttctcttgactctattttcttctcaggctccatgacactttttttttcagttttaggcttatatcctcaaagcattcagtccggtagaaaagagagggaaactttggtttgcttctgagtaaagttactgtgttctatgcttggaacttctaaggtcagaagcttatctcttagccaatcactggggctaaaacgatggaattacacagatttacccgtagtagactacaaacctatctttcacctcctgtgaatagaagaattcagtaatttagtgttataactggataagcatagaatctatgtgctcccacatacatccacatagaatgagaatggaggaagtttatttcccagagaataattgttgtactggaaacaagtgcaatgcagaagttttgtaaacccacccaaatatttactccagggtgttgtataatagcactatgctgaaagggttggatgaaagaacacttggagagagaatgaacacgtactatggctataaattgtgtgaatttgagctatatacataaactggaatggaaagggtgatattcatgtgcaaaattttttgaagaatgacctggtagagcttggtgattgtctattagtttatccaatagtagatgttttcatagttacacatattagggctatactatggccagaggttcctaaacttttgcaagttacagcactcttaatttttcggttatttttgcatggcaccccttcaccaaaataaatgattaagaaatacatttaataaatattgactactccagtaggcccctattttgggtatcacagctatagctattgacttacaaaaatgtgttattacttcctaagaaggatcagaaaatggaaaatagataagggctttgcagctattagttcagtaacattacatataaaagactaccacacccattcatgcagatctcgagtaggtgatttgggtttaccgttttgtctaaatttttcctcatgtgagttctggataatggactctgatttaaaaaatgataaaactgatttcacatatcagtcatgtgtagttggagaagaaattgacttgctttctatatgttaattctagaccattttgccctctttgtaaaatgtgatttgtttttgtatatgtttagtgatttaatatgctatttataatttactgtgagtgatcagagaacagcgtttttaaaaaattggtttctttggtggggaaggaagagatgaagataggaggatgggggctttaataggcatcagatgttgaggggaaggagtacagggactgataggcagaagtagaaaaagaattttctgtaataaatttgggtcacttctcagtttcccaagcattaatcttgattatgattggataaggcaacaaaagaagtatcaggaaaataggtaggcatatggaatgatatagagagaacaagttgaactaacaagcattttggaatactttaaatgccattagtgatttgttctgattatttagacatgggttaaatatacctcatcagtatatttatgccttttcttagtttgattcagagactgttacatagaagaaacatgtgtcattaacaaaaataaaagtagatgatttgaaagtcattccagtatgaaaataaatgatatattgtcccagattgattttggtttctgactcactctcccagagagttctctgtaaactttctgtaacatgaaacacagaaaactgagttatatgaatatttatctagataatctttcctctaagacaataggaactagtactttcagaggaaataatctcatctggacctctttctcctgttgcccatctctcaggatctatgccatgcctaatcatatgatagagctgaaaatagtagtccatcttcactaagcccacctggtgtaccttctaagcttaacatgagtatcaatattcatgcatacatagtctcctattgtaatgctttgaatttaacatatttcatatttagtataagtaaaatagtttataatagcaaagaccttttaaaattattttttttcttacttgctttgcacatatgaagctttgatttttacattttagcttctttgtggttttattatctgaactgtacatttgactcatttgagcaaatctccttacaagctagaatatttaagatgcatctgatcgtctttcagtaattattccagaatatttattcatcactgactctatgtcttgcacaatatatatgcttttaattaggccatgtgttacaatcacctgaagatttcctcaagcctaaattttaatcaagcctgactccaaacagaataactagagttttgaaccaggggaggggtatgtttttagattcccaggtgatcctaatttgcattcatggttgagaatgatctaattcaagcaatgcttttttaagttaaatgtattcttcagctatttgttgactatttctggtattgagaaaaatgaggatgatatagtcatggtgtctgttctttttcagtccacattcttgtcaattaaaaatattatgaaagtcatacaactgtgacagagaaatgcaaatgtatttctccaaacttaaagcataagcgtcataatatttcaaaggaaacaagaaaattctagtgatttttgaattgatattccttttctccctttccagctgcctgctacctagttcacatggtttagtcacaggataagagaaaagttttcaagcattttctacagatgtgaatgtttgatataaaaaaaagacactctggtttaaagaatgttgctaggaaacacagtttgaagatgaactcccctacagagctgtcttccatcctgtaataagaaagtgtggtggtagcatgtcctcatttaaaagcaaaaaaataatctattaactgtgtatccagagggaacttgttacaggcttatttaaaacttatttggaaatagttttggtttattatatgcaccacaacttccaggaattcttttgttttttaattggtgcaaggataaagttgtgagcatataatattttgtccaaataatcactataagagaaatgcacttaaatacaataatgaactcatgttaatttttgctttaatagtaatttctattaaagtaatatatcctttatcataggaaaatgtggatatacaaaaaatatgctaagataataaggactgcccataatgccacctaagagaaataatcatgctttggtgttatttatgttttatttcttctaaatactcaaggcatgttggctaattgttgttataggtttgttctgacacactgccatttagcaagtaaaacagtttaatccacttatatttattataatttcttatgtaccttgatgtatttctaaaatcttattttatgttcttttaattacccatttttttctttttccttattttctgccttctatttgattagtttatgtaccatgtattattgaggtcataatatctaatatttagccctgcattttcatataatccagtataagcttttcctgattctgattattataaagcatttgaaagtgtaattttaaggcttccctaatatttttatcatattgctctattatatgtaaacacatcaaattatttaatcagaatagatttctctatgaggaatcactgtatcaaagtatctgaatacttttaagatacttgatgcatattactaaattatttcctgaaaatgttgtcttagttactacttcttgtagcagtataggaaaatattaatcattgcatccacataaacatcgagtattgttaattttaatgctgtgcaaattttatcaaataaaatatatatacagcattaagttgcattttttattcatatgtcatacatgtatgttcattcatgtaagtttagcatgttctttattcattagtctattagtattataatagtctttcatatattaactgctgtgagttccttatagctatgtctgtaatctttttgaagttttttcccaatttacattttgcccttaaaattcattcataacttttatatatacaacttaaattttttcctttgtattttcttatattcagggagttggtgtatttatttcctttttaagtttctgtaagttaatttgatttttatattttgacttttaattcatctgagtttttgttgatatatgaagtgagattagaatgcttattgatttttttctagctatttagttgcctcagtgccctttattgagtcgtatttcatatctttacctgttagcactttcacaaatagaggatgcaagcaatataaatgtaagcctggtttaaatcttaattccaccacttactagtaccagaaacaccacaatcctgggcaaattgcttaacctacatgactcaggtgtttcatccctaaaatggacacaaagaagaacctatatgaaggtttttgtgaggggtgagataatacatgtaaggtgtctggcacacaataaatgctcagaaaatgttagttcttatagaatctgtttgttctgtaaagaacaccattttttatgaagtttttattatgattttcaattggtgggattatagttattttattagccttgagaaacaatttggtagagtacttaagcacatggactctagagctaaactgcttggttgtgaatcccaacatgcctactagttaactgtgtgaccttagctacttcacatctttgtgtctcaatttctctatctgtaaaattgagatattcatagcatttaccatagagattttctgtgagaactccaatgagaattaaatgtatttacagtggttagtagtaagtgctatgtatgcattagctataatttgttccaaaatagtcttaatgtccttttcaaacatttttcttctctaataaatttgagacttattctttcaagtgtagagaaatcccatttgtgctttgattgaaagtatgtcattttggaaaactttaagaatattgagtcttgttatcaggagctggtatagttttccaatttgtcaatgcttcttttaagtctatcaataaatatttatagcttttcatttcttgtactgattattaaaagtatttctaggtcatcaatcgtgtgtttgttaatactgcaggctgaggcttcacctttcttatttctaagtagacattgttagtacaaaagaaaactatagtttagtttatatttatcttctgcttagtcactttgctgaactcttaatgttcatattttatttaaatccattttctttgatatcctggtctataatcataccgtatgcaaaataatagttctgcatcctcttttttgattgttgtaaatacaatttttgcttcattttgaactatatttgcctaagctccaaaacagtgctaaattctgtgtttccagtatggtagaagacactgggataaaaaacagaccagacagcgatgggccctgtcttcacagtgttttaaatctattcccatggacttaacataatattgatctatcaaatcctgtgtgttggtttgcattatttaggggagatgttatataaccttcattagattattaaaagggcttatggctgtaaaagttaagagtcttttatcgtagattctggatattagccctttgtcagaggagtaggttgcaaaaattttctcccatcttgtaggttgcctgttcactctgatggtagtttcttttgctgtgcagaagctctttagtttaattagatcccatttgtcaattttggcttctgttgccattgcttttggtgttttagacatgaagtcattgcccatgcctatgtcctgaatggtattgcctaggttttcttctagggtttctatggctttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggcttgccaaagatcagatagttgtagatatgtggcattaattctgagggctctgttctgttccattgatctatatctctgttttggtaccagtaccatgctgttttggttactgtagccttgtagtgtagtttgaagtcaggtagcgtgatgcctctggctttgttcttttggcttaggattgacttggcaatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggattcctagaatttacaagaaaaaaacaaaaaaccccatcaaaaagtgggcgaaggatgtgaacagacacttctcaaaagaagacatttatgcagccaaaaaacacatgaaaaaatgctcgtcgtcactggccatcagagatatgcaaatcaaaaccacaatgagataccatctcacaccatttagaatggcgatcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaacgatagactggattaagaaaatgtggcgcgtatacaccatggaatactatgcagccataaaaaatgatgagttcatgtcctttgtggggacatggatgaaactggaaatcatcattctcagcaaactatcgcaaggacaaaaaaccaaacactgcatgttctcactcataggtgggaattgaacaatgagaacacgtggacacaggaaggggaacatcacactctggggactgttgtggggtggggggagggaggagggatagcattaggagatatacctaatgctaaatgacgagttaatgggtgcagtacaccaacatggcacatgtatacatatgtaacaaacctgcacattgtgcacatgtaccctgaaacttaaagtataataataataataaagagtcttttatcctaatttatagtgataaatcagtcttattaataacccgattaatttttgtgatgatttatatgttcttattcactgttacggactttttaaaatttcaaaataactgtgatagtgttacccatttccttatacgtgtactttatatatatttctaattacccatattctcaaaaaacaataactaatttttcatagagaaatgttaaaatatgtcgaaaataaaaagactttaggtacattaatttacatttttaagagtcttattttgagtgttcaaaagtagtactggaaacataattcagtctgtaatcatggcttggtcacctatggtttctgtaaacataaatataaatacagatatggtttacaatcttaacttgttttagactcccgattacaacgtaaagaaatgtgattaacaacaacaacaaaaaaaggaagtatatagaatttggttttcttttgccaggaattaatctttttgtggactgcagaaatactggggaaagatagctgattggtaggaaagacagcaaggtgtttactgggcctgatagagagactacgggcccattttatcagtttaataaacagagttaagagtctaacaagctgggtggctttccacaaacaaaacaagtttgagagttgcagcaaaaggaagagatcctttcccctgatttagcatctaggagacaaccattcaaaggagggatactcatgtaaagaacacagccttgcttcccctcctgccactcggttcactccacagcgtcttgccagtgggcgttcaggcctgtgccagggatgcgctccatggagccagtcagcagaaatctcttgaaagtattttgactgaagctgtaaaaagttgaaccatttgaaaattccttcccaggttattctctgtaagggttaaacctgctgccttgggaaattcacttcctatctgtatacctgtatttatagtgggagggagattctttaataggttggtgagaagtagctgggcctataattaaaatcactgctctttattaactagattttagccataatgttgagtggaaaaaacaaagatgggggatgtgataagtgattagaaagaaaacaaaacaaaattgttaagagtcaaatatagtggtccagtttgaatggaattgaaggaaagaaaaggggcaattggaatgtcattgcttctcttttcagtctcttcaatttatccctttacatattctgtacaaatactaagcaatttttttagataagtggcatagttataactctcaaaacaatttgctaatttatacgttcaggaatttaaaaactgtttactaagcatttcccatgtgataggtgttgtggtaggttctcgggtttttgaagccccaaatcaatgggagagtcagacactgagaattatttaatcataaaatgtaatactcatccttaaagaagggcagaaatggtataaatctcaatgtattattatgagtattaaaaaaagataattcacataaagaactggcagtgatcgtggcagtttacctatcatatgtactccagtgatgagaagaatcatgaagacgagcattatgctgaggatgaagatgttaggggacaggtactgccatttattatcattggcaagctgcttgacttctctaaacctcatttctcgatgtgttagttggagtcaataatagttacctacacgtaattttgaagattaaaggtatttgtgaaccaccggtatttgaaacagtgggtgttctataattgagttatttcctttactagactcctatccatgcgatattaatctctaatactatatggatattatcaataaaaaagaaatacagatacatgagtggtatattctgagaataacattagatatggactatctctaaggtcatttttaaacagagcgaatatcacctttcctgtgactccccactgtactttatttctccttataattttgttattttttaatagactttaagagttttaggtttacagcaaagttgagcagaaataacagcgagttctcatataccccttgtctcctcacacatagcctcccccactgtcaacatcccgcaccaaagtggtacagttgttaaaatcgatgaacccgcactgatacattattatcaactgaagtccttagtttacattagggttactcttgctgttgtacatcctatggatttgcatgaatttataatgatagtatcatacagaatagtttcactgccctaaaaatcttctgtgccactgcattccagctctgtgatctccctattcatttctccctccttgctaacccctaggaaacactgattattttactgtctctgtggtgttgccttttccagaatgtcatatagttgaaatcatacagtatatagtcttttcatattgaattctttcacttagtaatatgcatttaagtttccttaatatattctcctggcttgacagctcatttctttttagtgctaaataatactccatggcctcgttgtaccacaggttatttattgattcctctactaaaggatgggtttcaatttttggcaattattaattaaggtgctataaacatccttgtgccagtttttgtactgacatacattttcaacttctttgtgtaaatactaaggagtgtgattgctggatcatatggtaagaatatgtttaactctgttagaaactgccaaactgtcttcccaagtggctgaaccattttgcatttctaccagtagtaaacgagagttcctgttcttccacatcaaatgctagtgaggatatggaacagcaggaaccaacaacatttggtgttagatttttgccatttgaattggtatgtagtgatatctttttatcattttaatgtgcaatttcctgatgatatatgatgttgagcatctcttcatatattgatttgccatttgtttatcttctttggtgagatgtctcttcaggaattttgaccgttttctagttgagttgtttgtattcctatttttaagttttaagaatttttgcatattttggataacactcctttatcagatgttttcacaaatatttgtccctgcctatggcttgtcttctccttctcttgaccgtgtcttttgcagagcaggaattttaaattttaatgaagtcctgctttgcaattctggttttcatggattctgcctttattgctatatcaaagaagtttggattctgcccctattgctataccaaagaagttatttccatacctactttctcctaggttaccttgtaggagttttatagttttgcattttaaatttaggtccctgactcattttgagttagtttttgtgaagagtgtaaggtacgtagctaaattttttttgttgttgcgcatggatgtccagttattttaacacaatttgttgaaatgactgtttcttaattaaattgcctttgtttctttgtcaaaagtcagttgattatctttatatgattctatatttgaactctctattctgttccattgatctatgtatctgtatttttcaccagtaccacagtatcttggtgaccatagctttatagtctttatggctttaagtcttgaggttggacagtgtccgtcctccagctttgctctttttcttcaatattttgttgactattctgcttctctatgtaaaccttagaatcactgtcaatgtaaacaaaataacttgctgcagctttgattggaattgtattgaatctgtagatcaagctgggcagaactgatatcttgacaattttgaatttccctcactatgtttttatctttgtgttttacctaaatatttgttcaaggaaagaataatttgaacttttccatactagagccctgtctaaaacgtttaccctctttgctatccttagttttggtcaaataactagttggctgtgaaggctgagcaaagatctaccactaagaatttgtattgtgagcctgtctgaaggtgaatgatgtatagactggatgcgaatagcaaaaagtgataagaaagacatagctacagtggaaatgagcttctctcagggtctaaaatctgttactctgcatactccttaaagtgttgctctcaatggattttgtttgtttgtttgtttcgtaaaataatatgtgtattccagatgaatccaggaagtttctcattctaagaaaaacactaaatcccagccacattagaatttttccatgagaggctgtattaggttactgactcctattaaaataaaaatattaattacagaaaacaaaatggaatcattcccaaagaaggagacacaacaagaagagatgaaaaatcatagccaaacaatcattatcactggcatatcggaaatagtacctgacttagttaagatattgtgcttcgacaggaatgctaatcatgtttcaggacataacttgtccaaaaactatatactcacagcttccggaagggaagtccacttctgcaagggcaagagatttgaaacctgaaactttgtaatttttttgctgacagggttggagggtgatttgctaacatctcattatacaatgtatgttaagagaaatgtaaaggtcaaaacatggtgctttttgtttctgctggagtgctcagtcagagagattcagttcagcacaatatcaatcattacaaattcttccccgaaattcaagacacattaatcaaaacaaatggaactcaagaaaaatgaaaactggggggggtgaataaacaaatacatgattgagttgaaaacataaaaatatttattaaaataccaaaaatattaaatagaaacattctgatgtaatgatttctgatacagttcaaacttaaataaagaatgtatggtcacataaaatgtaagtaagtatatcacctttcacctaaagttttccagttaaatgcaaaaccttcctctttaccctaactaggtagataattatatcactctgcatagtcatgttaggagtttaattttcaagctaaatcaaaatcacttaaaatgtcaatgatagtttaaaatttaagaatagaaatttggacatatcaaactcaaaattgatgctttattgaaaaaaactaaatgtctttaaattgctataacaaactttatatgttcaaaattagttaacaaaaataaaagaggacaaatttctgcattcttcaacctccaaatttctaatatctttattctaagaaactgcagctattgtagtgatattccttcaatcctgaaaacactcaggaagcaattttttttaaatgttttaccttggcaggaactttagatcacaagtcaaaggtatctcttctaaacttgtaaagaaagtaaacaatctaccaagagaacaaacagctcccaatagatacagctcttactgcttcctccccttattttgtttcttttagttagagagccatgacaaaggaaaaacaaaataatttcagatttatatttctgttgcttcttttttcttccttccattttgttcattgcataaaacaaattgattaggaggttctcttgctgggcttcaaatatcattaatatgtagatgacttccaagtagctatcccccactcctgtctgacttctaaattctggtcttatttattcaaatgtttacctagtatctccacttgaatgtctaatgggaaactcaaatataatacgttcaaaactaaattattggtcaactcactttcccatcaaaactcaagttcccctttgttgaatagcaacatccttacactctaatagccaccccaaaaggcaaacactcatccctgaattcctcccttttcctcattgtctgttccaatatctctacaggtactaagcagtcaatgtttatctttcactggttcataccctccttgaagccaagaaccatatttcttggatctgttaaatccctaggacctttaaagattttaaaacaaataaaattacctatataacagcttcttcatttgctaagcaaatgattacttttacatacctacattgcaagtgatactggcacttcactgcattgaagaagtcactagatcttgaaagataagctctattgtatccttcctcccaattgttaaaacccacagcagatatacatgaagagtgaatgttgatttaaactgtgaactttagttaataataatgtattaatattagctcatcaattgtaacaaatcgactacagtaacgcaaaatgttaatggagaaactatacaggagagaagggatatatggaaactctctgtactttctgttcaattttctttaagtctaaaactgttctgaaaataacatataaaatatgtcacagaaaaaatatttctctcattttatgccattgtattctcaagacatctagagacccattttttctccagtccccaatgccttgtcttttaatacctaactttttatttaatattttatctattagctgagtatatttcatttcccttcccacaagtgaaaatagataatatataatgctggcttcatgaagacttatgaagaaatcaattctatgaaataaaaatatttctgaatgagtttattacaactgagtggggaatttgagtgtcatttctagagaatttggtccatataaattcagtcttggcagctagccattaggggtttttgaactggcatatttgagaagtgttctaacttctcagtggaataaagaagaggggaaagaacattatagaatgattcttttctttaataaatttccatataaaagggttttgaaagtctggcctcaaggtaattccagaaatagatttcaaagactgcgactcaagtttctgtgttatagtaagcttaagttttataaagtgtcaaattgatgatcagttatatggaagcctctatttataatagtatagtccatttttatactacttttaatttgcaaaggtgctttcatatattatcttatttggtattcatagtcatcctgggaaaattgtagaacagatgctaactcctaaatagataaccacaatttcacaaagtaaagaaaaagaaatgcatggaagtatcctcagtccaattttatcagtccattttctattgcttcaaaacacctgcaactaggtaagttataaagacaagaaatttatttcctacagttatggaggctgagaagtccaaggttgaggggccatatctggtgagagcctccttgctggtggggactccgtagagtcctgtggcagcagcaacacagggcgtcatgtggtgaagggactgcgtgtgctcgggtgtttgctcaggtctctcttcctcttcttgtagagccaccaggcctactcccatgataacccatgaatccattaatccatgaatggattaaaattcaatcacctctttaaggtctcctctttaaatactgtcatgttagggaatgtttccaacacatgaaatctgggggacacaagaaaaccatagcaccaatgttaaccatttaatagtaattcttgtgcttcaagattttttttttttttttttttgagacggagtctggctctgtcgcccaggctggagtgcagtggcgcgatcttggctcactgcaagctccgcctcccgggttcacgccattctcctgcctcagcctcccgagtagctgggactacaggcggctgccaccatgcccagctaatttttttttttttgtatttttttagtagagacggggtttcaccgtgttagccaagatggtctcgatctcctgacttcgtgatccgcccgcctcgacctcccaaagtgctgggattacaggcgtgagccaccgtgcccggccgcttcaagatttcttaatgaaggtagttgcatcgatgttcataggtgcttttcttttaattatcagctctattctaagacacctaaatcttctgaacacacacacacttacatgctgacacacacatgctgacacatgcttacacttatgcacatgtatttattaatcacacactgtgcaaagtatttaagccccaataggaatataaagatatgtataaggtatgtttttttttccctctctctcagaaacttatagtatagttaggggtaaagagaaatgatcacaggtatcttacatacattttttatataattctcagaagtatgtattatattactattcccattgtacaaacactgaaatgacttgcctaaatccactgagccatgtgcatcacttctgactagactcacagtctgtacccttgtctcctagcctcactgccttttgataatataaacatctaaaatgctatgaacataggctcagatttcctaggacagttttatagttggttattgtgttctatttattgtccattaagacatatcagaaacaccaaatttcgacaaagaaaatacttctccaaaatactttctttcctcaaccttttaagttgtcctcaaatatattttttctaattcagtttcccaatattcaactggaagtggccttgcatttaaaaagtaagcaagaatataataataagataccagcaggtgagacaaaggaccacttgaagatttttgacaagggagaagacctcagaggaggaggttgtctgaggagacactttcctataaagataaaatttaatctggatcctgaaatagagttgaaattcttattttctcatttacaaactgaagctaataatagtagctacatcatttgtttagatgaaaattgagttaatacttaggcttttaaaacagagcctgacttagaagttggaagatggagtacatatatcttaactactaagctaaatgtttttatcttttaatttctattgcctagcataatgcctaacacataaaagtatttaatagataattgttgaatgaatgatgaaatgatagtgtatcattggtaaattttgagtcagagagtatagtaagagaattatagtttttggaggtcaaattgacatttgtattgttcactaagcttcagagatttggatatatgttctttacaataataaatgcttagactgtttcctcttggtggaagggatcaaaaggtagatccatcaagttttctctaaagcttctgcctaactaggtgctaagcttttgaagtttgagaatttgcttctactgttattactaactggggcttgtatgaagcatttcacatagcaggtactcaggaagtattgattgattgataagacttggatttgatacaaggaaatagttgcttacattcagggagaataattaaagataccagaaactatagaatcactttcctttagataccagtttttgtataatatacatctctttctgtaatttcatatgaccggaggcatgtattgacccttgccctactgacaaattaattaatatttgatataaattcgaataaaaaggaacaaagctctctgtatagcccaagaccgtgttgtggatataagtctgaaacctcaatggtttgggggcaccaggttaaggtagccccgtaatttccccagtatctgttctggtaatgaaacctttaaaaggagccagaagagcagagccttcataaaccaaagcacttaggattaaatattatgatgatattttcttgtagaactattcaacaactctctgtgaaagaaacaaaagttcaacacatggcatttaaggtgccatgattttaacacacttctctttctcaaatattttcacgagtatatgccctagccatgcttattcttcaagggtctctgaatttgacctttattattctcctttctctattgctacttcctcctggatctgcttgccaagtatggaacaataatttgtttttagtaatttctcaataaacatattcaacagattttaatggagtatctttgatgtgttaggcatcatgttatatgatgtggggggtatagaaaaaggaatgagataatctgctgttgaggagcttgtaatttagaaattccctccctgaataaatctctttgatttaccagtacttatgctactgctacaatatgtctggacatggtagatacttaagaaatatgtatgcaataaattaataaataattttaaattaccattcatcttcccttataggattactttgttatatattcttcaaagaaaatgtaatgcatttcttggtcttcgaacgggttttgaataaaaacagatgtctgcatggttaaattgcacaatcattgagattaacttatatatgtttcaaatataaatacttgaacagttttaattgaattgaagtgaatttaacataaaattctcttatgttctttctagaaatgagggcctaaataattttggtatgaatcacttatcagtttaagtactgatacaatgacctgtattcaatgactcttttacctaaaaaacagaatgtcaatgattacatcatgctcccaggaggactgtaccttccatgttgacgtctcttaatctgaacagcagctaataggagttatgagatcatcagtctcattctcccttcaggggtggtctcgtgtcagaagacactcagaagttttgtgtacctttagatttgtgaagtggaataaatgcctgatattttaacaaagatattcagatactgtgcagcatgcagcagcctcgagcatcataatcctatgcagcagcattaggtagaacgacttagagtggaacctcagaaagcacagtggcagcagtgatgaagccttcttattagatgtgggcatctccacagtggagtaaggccatacaaagggattattacagcacaggaagtctttaaaactctcagggtacattgagtgagctcttggatctggcactatttctttacaggtcttatccttttatgcttatatgtgagagcaaaagagaaaggagtttgaacattctatcctgctgacataggatttttttctgctgtattaaattcaaaattctactttggatctagatatgattcacaggtatcacaaagcatatttcttttgtagtagtctaccaatctcagatcggtttgaattgcagttgagcaacaatggtagttaaaacacattcaatcaggtcattatcgtccaataagacagtctcacataaaagtcagaaaccttctagttattagtcaaagcaatacatcagaatgccttgtttattatgatatggcaaaatgaatcagatgtagacatagaggatatttattcatcatgtagaccaaatgccacacaaaatataccatagacataattttaagagacagactattaaatatcatgcatcttctaatttttagagatgtgttggctgaacgtgtggccctggaacacatttgcatgcacatagatacctatacattgttctctgtgagcaacgaaaatattccaaccttcacttaacatacttactacgacaatccttgaactttagtatgcctacaaatttcccggaaaacttgattaaaatgaaaatattaagactattcttcaagagttgctcagaaatcgatcttaacaatcacgtgccaagtgctgttaatgtaggtggcccttggaccacagtttgggaaacactgacttattgttatgaaaaatatgttaattattaaatatgcaaaatactggttttttaaataatctaaagcaaagacagatactaagtatcttttaaaaaaattaagtaataaacgataagggatttaaatctgtacggaatagaaacccttgctctgtgctctgttactagctatttgtattagagcaatccatgtaatccctttaagtcagtccatctctagaaatggctgctgaggagaaaaaaatcttaaggctttgacagatatggatgttaattaagtgctgacaggacggcatgcattttacagaacaactgactgcttacatttttgtataattggatttataattaaattaattgctcatttatttttgaaatgatgtaatgcaagcagaggaatgtaaaaatagtgaaactttatttgtgatatttatagcatatatttttactgggataatttaagcccatggtgtcacacaggactataattgctacagccacacgtattccctggaatttcaggaaaccatcatttttaggtggtagcaaaaataggaaggcccacatagatttttgtcctacattttgggagtgtgtgtgtgtatggttaggtgccttgtaaagtttgagaaaatgcagaaaagccctgctgattccaaactatcttgcctgtggaactgataaggtaccaactccacacagttattttgcttagaattacaaaatttgacatgctaatggaaaatggagatagtaataatgaacaaatcaagtgatattatttcttgcttatcagcaatgctgagaattactgattcaatcaatgaacaaaagaggcactgttttagcaagcaagatttagaactcacaaatgtatttacgagattccactcaacctctttcctatcagtatattaataagaatcagtttattactcaagggcaaagctatattttaggtttggcaaataattgctgcttaaaatattaaatgaatattaaaggaaagataaaacatggtagataggtttcagtaggagttgcaaaggatgaggggatgtgaaactgacaaccgctctgttgtcgatgatttacatgaagaatctgtgtagaagagattgaagggagccaggcaattaatgggagtactgaaggtgacacagtaacctcagatacataaatgcagtaggaagtaacaagcatatctgcttaaaatcttataagccactaacttgtacattttcgtatctgatcctgaccaaatctctcacatttctagagctgtactgagttaatagggatcgtgtagattgcccaaaaatgcatagctagtaatacagccagggtttgaatccttttattctagacacatttaaattctctatgttttagtagttttttaaaaagatatttaaaatccgttcttgatctagatcataaaaaggattttttatattcaaaaattagcatatttttaataacgctaagtcagtgttttccaaaatgtggtccagggtccacttaacaccatttggggtgcacttgttaattagacagattcctgagtaaatcgcaagataataaggatttctatggaaatagctcaagcatctgattttaatcaagcttcctaagtaatttgtaggcatactaaagttcaagaattattgtagtaagtgtgccaagtgaaggttggaatgtttgatactctggggatgttacatttcatgagatgttttagaatgtgttgtattgctcctctttcatgtatacggcacacacattcaagtgacaggctgtttgaggggctaaggctgttgccatctgaagaccaatgcagctctatctgctcattgaacaacatattttattctgacaatggaaggatactgtttgtaatcatttgcagaaaagggggtattctccttgtgtgtgtactgtattccttggcttagaacagtatggtcttcagaaatttttatgaaatgtatttgaccactgcaataagctgcttaaacattgttaatgacttcatagaaaatggttagacttttgtttatagagtgtaaagaaatcagtgtgaggctgatctaaaacataccattagtcagttaaagggggtttcatcacctatatttaaattgtatttaataatccaaaaattaactggagagagataatatttatatgaaagtgcttaattgactttgtatttcattgtatagtatccccttttaaaggggtagcaattttaaaattcaaaactagttttatttccagaaaatttcatgtattcgtttcatgcatttcacttttatgtacatatgctgcaaagctttacatccacacacacatatccatatacatgcattacctaaacctcacaataacactcttagtaggaacttggatcttcattttaaagactgacacctcagaagatgaagggacttgagcagcagaggaagaatttcagatcgagtctgagaggaaattgtccctcagttttgaattgtagagtaggagatattggtgtctttttgtctggaataatatgtgcttaacttgaataagcttctgataatctcttggaaatagaactttgtagtgaatgttgttcaacatcaaattttaggttaaatatttttttaaaaaatgaactttcacgaggttgaaatagaggtacaatttatggataaaggcacatttttttgtacctgatgtgccaaaaaattttttttgtaaaagtgatatgaccatttgctgatatatatgaatatttcttcaatattcttgagatgttctctgtcaatgtaaatgattgtctaatcatcagtgcgatgaaaagctagtttcatttgtcatgatggaacacactttcattacatagcagtactaaattctttgtaaataatagttgctaatatattgttgaagcattttataataatttatttggactatccagcaccagaataaaacatgacaagagctagatggaggtctgtccagcagaaaaatgcatatctagatataggacagatttctcaaatgagaaaaccctagtgttgtctaaaggaaagagggagcaggaagaagaatgacaagtagaggaagagagaaggagaaagaaagacgaagatgtgtcatactgccttgccttactatattgagaagtgctgttgttttaaaatatgtgtaagagatttagtaaaggatgctggagaacagaaggtgaattctcctggaaattaacagagtgccagtccatgtcagggatccatcagtcatggagacccacagagctgcatgaggttgtgagatgcagcagcagcagcagcagtacctggcataaggcctggctgggtgtacaagaggtcacagggctctgaaggctgacacgttcagggagctggccagcacagcatggcctcaggaacaggaatgcacccccagttcctgcttctggtccttctgttatttcagttgttgagaagaaacaagtctgctcctgtgactggcacatgtttgtcagagttgcttttttttttttttttgcctctgtcacttcattttttgcaacactttcaggtccatggaggtcagggggctagctgtgaattactaagtggtgtggcctcaagagagaagtagtaggggcagtttcttccacattagtaggatgggctcagcttgctgccttctctactgtgctgctgaaggatgtgatcagagagtcacaaatgatgggataactggtgacacaatagaacagatcaccagcagaaaaataaatgtgtgaacaacatatgaaagatacttttatacccgaatggcaagaaatctatatcataaaataaattacatgctgctgggggatgtctcactgtcctaatgaaagacaaaacattttgaagtgaaggaaaagatagcatggaataacacagagaggctcaaaataatgaaaataacttttcattctgattagagtgtacatattcagaactggaaaacagacttccagtaatgcccaataaaccacatatttcaaaatgcttttaaatattgatacttaaaatatccttttctggagtatatttataaactgcaggaatccctaacaaggatcaaagccccagtaatagacattttctttccttctttctttctcgtctcttctcttctttttgagatggagtctcgctctgtcgcctaggctggagtgcagtggcgcgatctcggctcactgcaagctccgcctcctgggttcacgccattctcctgcctcagcctcccgagtagctgggactacaggcgcctgccaccacgcacagctaattttttgtatttttagtagagatggggtttcactgtgttagccaggatggtctcaatctcctgacctcgtgatccgtccaccttggcctcccaaagtgctggattacaggcgtgagccaccccgcccagccctcttctctttttccttctccttcttcttctttttccttccttccttcctttccttccttccttctttccttccttccttcttccctccctctttcattctttctttttttttcttttttctttctttctttctcagagtttcactctgtcacccaggctggagtacagtggcatgatctccactcactacaacctccagctcctgggttcaagcaattctcctgcttcagcctcccaagtagctgggattacaggtgcatgccaccatgctcagctaattttttgtatttttactagtgatagggtttcattatgttggccaggctggtctcgaactcctgaccttaggtgatccacccacctcggcctcccaaattgctgggattacaggtgtgagccactggacccagaccctattcttattttaggaaattaaagttcattttggataggattatagttatgtacatggtccattcatttcatcatttattcaataactccatatcaagtgacttctgtgtgtcaggcattagcgccacaacaatgaacaagatatgtatcccctgccctggttggcttacagcctaatggaataataaatggttactgaatactttcagtcaacattttgcatgcacaactttatgcaaaccttgcaattgtgctatgaattagatattctttccatattaaaaggtgaagacaattaggttcagaggctgagtaatttgcccaaagttgcaagctaaagaatggttgagccaaaattcggcaagatatggctaactttccctgtacacatttatgcattttggcacatgttcccatatactgtggtcattattgagaaggaactgttaaattacattctagccctagaaaagttgtctgtattttattttcaatttactgagatatcttgctgtatgtggacacaactaatctttttttaggcctatcccacttctttccagattatctatacagttcatgggtaaatagaccaaaatatcactgatgtactctatcaaaatgaaaaataagaagcaaactttcacagaaattgctcttaattcttcacctttatttatctgtttctttttctctctggtcagtgctgctttcttgcccctcaatagcaacactgcagtagcatctcttgctcttaaatgtgaatatctgtgggaaacatttagaattctcaaattataacagtttattattacacaaattaagatttcactctgtcactcaggctggagtacagttaggattacacaaattaggatttgtgtaataataataaaattaaaaataaaaataataatatgtcatctaagttaatttttacaaagtcaattgcttgattggcattaaagttttggcatttttatgtgtttgctttttctaactttctcttcattaaaatataacttgtcttattttgtatgtgtaactcaatgagaaaaattagaaactatcaggacaaaaaaagtgatcaaattcacatttttgtgacaaagtttagataggcataaccagtgtgtacacatttcaaaaattttcacttaagtctatatgtagataacgatgtcatgcacaatcaaaataaaaagctaaaaatctttccacagatcatgtaattgattttcctgtcctctaaaagaattgttggccgggtgcaatggctcacgcctgtaatcccagcactttgggaggccgaggcgggcggatcacgaggtcaggagatcgagaccatcctaacacggtgaaaccccgtctctactaaaaatacaaaaaattagccgggcgtggtggtgggtgcctgtagtcccagctactcgggaggctgaggcaggagaatggcgtgaacccaggaggtggagcttgcagtgagccgagactgcaccactgcactccagactgggcgacagagagagactacgtctcaaaagaaaaaaaaattgcttttcattcttcacctctattaaactgtttattttcctctctgcccaattctgcctaggaaaataaattaataaaaatttaaaatttcaggcttatatatattaaaaaggaaaaatatgtttatcctggcccatatattaccatggtccaggtaaaaattttgtccagcctctgccaaatgctaggattcttgcaaatcagggagtatatgtgttctcaaaatccattaaaaaataaatagactcctatatttttctctgacataatagtatggtgcaagcaatcagtaggattttaatgttgctgttttaaatatgttcgactatatttatacgttgaacactacaacatgtgttttccttttaaaattgtttttcatgctttttttttgttttgttttttttgagatggagtttcgctcttgttgcccaggctggagtgcagtggtgtgaagatctcggctcactgcaacctccacctcccaggttcaagtgattctcctgcctcagcctcctgagtagctgggatacaggcatgcgccactaagccaggctagttttatatttttagtagagatgggggtttcaccatgttggtcaggctggtctcgaactcctgacctcaggtgatctacgagcttcagcctcccaaagggctgggattacaggtgtgagccactgtgcccagcccatgctctatcttaatttatgttttcattcaattctatgtcatgagatttcagttatgctattatatattcttttaaaacaatgatttaatgtcttttcaagatgaaacccctattgtgtcattattgatgagtgctctaatgccctaggccatatcattcttaaggtgatccagtaagcagtggttgaggcaggaagtcaccaaatgactcaaatctaagaatgcaacactcctgtataaggccctgcctaccgcaggaaggcccattcccaccgtgctgtgtttaccatggtttcagtgaaaatgattaacactttttcacgtttaatagcatacaggtccacacaactatgtcattgcactggcttgttcacatatctgtgtactctttttctgtgaacttcttaagagcaagcaaactgtgcctttcttttttgagtcttcatagctacatgcttagtcacagtggtggattttaccacggagatgatgaaacttaagtagcagggcccttcacctgcatgaggctattccagggtcctgggtgaaactttagcagtgtaatcacatggtcgtacatgattgcaaaatttttaaaagcaagatattttaattagactgctacatggttttgtattttcgtttatattagtaattttattttcttcttgtcctgaaagaaggctctccaaatggacaattttggccccacaaaaccttgattgtcccctgttgacatgcaaggaacacttatttgcttttttcttgaataagtgaaagaagtaaaagggatgaggaggaatgaatattttattaattaatatattgtaacatttaaaattagcatgtctggcaaaaattttccttaagccactaacagaaaatgctaacatcatcacccttgtgtaatgtctgtgagtttacaagctcttatacaaatgtaacttcaattgaatctttgaaccaggccttccgttaaatgtaaccttcaattaaagtgaatgatatcaaaatgtttacaactgtgctatttgtagaaaagacttattatactcaatggttacagaggaaaagaaacctaaacacatgattgagtgacactcatgattgcattgtgtcaatactaggatgtcagctgaagccttctgatactgactccagtctttgcattacacggtgtttacaaatatatttaaataaatgaaaacttattctacaaacgaaaagcataaagtcacataggttaataatgttttcctcaaatgatgaacatttccaatttccttccctttctttcttctcctctcctcctctccccttccttcccctctccttccttctaattctttccttcttcttcttttctttcttgatgcaggtgtttaaaattatccaactgccatagagctaaattcttttttggaaaattgaaccgaacttctactgaatacaagatgaaaatgtggttgctggtcagtcatcttgtgataatatctattactacctgtttagcaggtaagaaatatcctttgtatattctacatatattatgtcaacataattgatatgcgtgtttattaaatgtattgtatgaagtaaaaattcttattttctcgacatctgggtcagataagtagataaatatgtatcaagggtgaccctatttcctttttaatttcaattaagatttcacaaaacattgtcaatcttgggtaatagtgtgctggtgaatgtttaaaatctagatctctggggagatccctggagtgtagcatttgtctattactggggagtaaattatcctaccatggccagtttcaacctgacatcatttaatgtggaactggaaagatgtgcaaccgctcaccagtctgtagtattttcaccaccctgatataagtaaccacaatggcaaagagaatataaaatatagtaaataaaagagagaaaacaatgggttttaagcatttattccctttgttcttagtataatttattcatttgtaaattaatacaatttttaatactggccatgtttaacaactgattcacaaaatttctgaaaattaataatcacttcttaagagctataagcagatgcaacacactactgaatcttacacaactcttttgccaatttgatcaatataatttaaaaaatggattaaagtaatctacagtgtgtgtagggacataagactaataaaacaattttgagagtacattcattttaggacaaagaaatattatatttctgtctttcaaaggcaagtgtgaagcattcagacctatttcctacaatgagaagcacatcatatctttatctgaaaaactgatataattacccaactagtacttattgagctaggtcatttagtacttattgagctaggtcattattatgaaagtattagaaaaattgaattctaacaaccaatttttctaatactttcatgataatgacctaacccagtagatacttgttgagtgactgttttgttcaagacataaatggtcctcatccttttgtatataaatccccattgatcactttaatgattaatctgacgggcatcattattaagaacataaaaaaatattattttattttggggaataatttttattatgctcactccaaaactcagaaaagatcatttcattagtacttaaggattttaatgacattgataaatatatattttataaccagggtaattatgcacacacacccacatacatagatgtaattacatgcataatatatttacatatatataatgtaaatataataaagaaaaaatttggtaaagtcattgtgaagtcttatttttgtgaataaaataaaataaaaattatcttattattactgaaaattcatacgaattctattgactgcaaacttcggtgctgcaactatcaatgtaaagataagaaataagtatctgcacagatgtgaagatacttcaacctttatagtaaagggccactactctcattccattgtctagcatctcagctatttaagtaatgtttgaaaccacaattcaaataattgcttcaggatcaaaattgttttttctttcatttttagagtttacatggtatagaagatatggtcatggaggtaagttgaccaaagagtagaccttgtaaacatcttttctctattgaatcatattttatctctgctttaaactattaactctctaaactttaaggcaaatggttaatgttagatcactatgaaattttgtaaggtggtctttctgagattataagcaaactgtttgttgaatgagtggatacatcataaacaaatatcctattagaggattgtagcaaatggaaaatattcaatttggctggctttttttcctgcatgctttgtaacaatgctatgcgactaaatttggaagcaatattttaaaatttgtaagccttgaacttatttttgaaagcctcttgctttgttgcaagggagataactaaagttagtgaaattggaatcttaagattcagttcaattaaaagtccacaggtattgcaaaatttattgtttaataatccttccagtttagagcctacttcaactaccaaacagatattgcagaaataaagtcagcatggtatactggaaaaaatacagagtctagagtaagaccagcctgaatttgcattttcagctcagtacttactagatgattttattatcttgcataaattatataacttctatgagtctcaactttccaatatgtaaaaatcacagaattgttgtgaggactaaaaaatgaattgcaatgataacttctagcataatgactggcaagtaggtgcttaatgagtgtagcaacactagtaacttacaaaagccattgcatgatggtaggagaatgaaaaatcatgaagaatcactgaacaaccagtgctagaacttgcatgccaaatcaaggttacccattgtattagtctgttttcacgctgttgataaagacatatcccagactgggaagaaaaagaagtttaattggacatacagttccacttggctggggaggcctcagaattacggcaggaggcgaaaggcactttttaatttatttatttatttatttttgagatggagtctcgctctgtcacccaggctggagtgcagcggcgcgatctcggctcactgcaagctccacctccgggattcacgccattctcctgcctcagcctcccgagtagctgggactacaggcacccgcaaccacgcccggctaattttttgtatttttagtagagacggggtttcaccatattagccaggatggtctcaatctcctgacctcgtgatccgcccgccttagcctcccaaagagctaggattacaggcgtgagccaccgtgcccggccgcaaaaggcacttcttacatggccgcagcaaaagaaaaatggggaagaagcaacagcggaaacccctgataaacccatcaggtcttgtgagacttattcactaagtattttttaaaaatagcctatggctgctttttccaattccttgacccatattctccttttaatctgctgcaatcagtgtttcccacgagcactcaacaaaaactgcctcattcatgtctctaatgtcacacattgtaagtccagtggtcaactctcaggcttcctacttaaccggctggcagcagtgctgcagttccaggtatcacacagagacataacaatgtcttgtaggcaaatagagcatgcttgttttttttcttgtatctatctacctttaaaaacaaggagacctttcccagaaaccttacactacatgtccagagttgggtcacacattcaccaacaagcccatcgctagcaagagtaatggcatcactccctgtcaacctttacgtctgagtcatgtgagggataggttgatccttgaactaagctgagctttgtcatgaaagtaaagggcagaagaggagctgattagtcaaccaacaatgtctgcgaattactcaggtgaattgaaattgagaattttctcacaaatgaaaaagttatatccaatatgtcatccagcatatataatagtttttaatgattattttacagcaacattagtagctagtgttcaaatatatgtattaaaacaaaaacattttaaatttgaaaaacaaagtacataaaagattataacaaaatcatcaaaaccaacttcactcaatgtctttaagaatatttttcttcttaatttttttttagattttgtgaaagcaatattgtattctattgagataagagagcaaatatgaataagttgcacataatctgtaatgtttagatatttaattaataactaaatcatttgacagcaaatattttagatgcttttttccacttgtagtctgcatttactttactttcagaaagaaaaaaaaaaacctgcagctattgtaggaccaacttacacccaggctaatctaaaatgaaaataagtatctttcattcctttgtaattcattgagaaaaagtatcttaaaaatgaaataaaatagcagtataatatatattttgtaagaattgggatatgaaataatatataatttatactttgtacatttagagttatgatatgactgtataatatccaaagctaatatttaaaaaaaaaaactatcttcattgcttagctgtagggaggacaggtagaacatttcatatatctttacagtacttgcaccaagatttcctgtatattttttcaactagactcacatcagtcagtaagaattattttcagtacatatttctatctctaaatatgattgacattttatagcagtcagtgacctgtctctattttgatctatggtcccacatagccccattaatcaaaatagactagagttagactgaaacaggccaagttctggaagtaggcccaccagcccagtcatgctatatattaggatgtagtaagacgtgaggtaggtgtcagaagatgcccagccaggtatgtaaaacagaatctagatgcttcagaggtgggtcacaggacaaggaagtagttcctctagagagatgtgacaggctccccttgggcaggtaaagccaagcaaggagaatttagttcacttaactttcatactaacctgactatattctttattctaataactgtatttctgcaagtttttgaggccaactccttactttgtatgtttagttataaaaaagtactgcaatgttacctattacccatgaccctaaaaaactggggcaccagagtgtttaaaggctaagcccatcttctgttatcagcaggaaatggttggcagtggagataggaagctgtaatatgtggaagaaggatgctttgtgacaatttaaatattatctcatttagagagtttcaagagagcttacaccactccccacccaataatcactgtaacactgtaaatgtaaaaatttccattttagtcttttgaaattttgatgccattacctttttctaacagatttttcctaggactcttcttacaacatgcttatgtaaaattgtgtttactaactaacagattgaggtgacatataatagactgggaagtggagtttgtctcaaaaagtatataaaatgaatacaaatatctctgaagtacaaatcataattttactttcaattcctggaagtaaaatagaatagcaatattatagtggatactctccacatagtggtaggtgaagtaatcccatttgagattatataagtgactaattatattaatggcgaaagtgagaatgaaagaacagtagcttttgcctctcatttacattagtaaatatgactgcaaatattcttacattatttatttctatcttagtctttttgatcacatttaagaaatgtacttatgtctgtaatagatttatgataatcacattatctggtaggaaataaatgtatttgcattaaaagcagatcaaaatagtgatatgaaatgttaaagcttcaattagcttgagaggtcatctataactttgtgctccttttaagaagaatctatctagtaaaaaaaaggaatgtattaaaaaataattttagtttttaaaaacacaatctctatctgtggtttgtttcttatgccttttaacctcataatacttccaaagcatcaaaatttgtcatctaagtgtttccatggctgtagaaaaaaatcaatagatgacagtattttctgtaggctgagaacataatgcttacattactggatcctttgctgagctttgtattgaaatatccctcaaaattcttctccctgcatctgagcaccctagttgagctagcgtggtcggaaactaaggtacagcctgcgagggagacatgaggatcatattcaagaggttcatgctgaacctggcaatgcaatacagatgcttgttttgagtaatgtttctttcaagggcccaaatatgttcctaaaataaaatatatacagtaatttctaaaccgtcaaacaaaatacattatgtgactcaggcttgaaaagtttagaaagcaagaagaatatagttatgaaataaaatccttaatagaaaaatgaatgtgacgtgaagtgtgtcctattctgctttttgttctaggaaagagcaaagggaaatatcttaactgcaatattctctcaatgtgaaaaataatttcagtattttcttggagattcgcttcttattttaatccttgaaagcttgcattgtctgttcctataaaggtcaaatataagtgggagtattgggaaatatatacatataatttgtgaaaagtattgtaactgagaagaaaaagtagcataaggcaccaatgttatccagtttggcctataaaattcactccaaaattgtatatcccctttgagggtttgctcattccttatatataggaataaccctatatacacactcagtataactttataggcatggcctcatcattattagtatgtgacattctataattttcaatgaaaattttccttgctagcacctttttctttttttaaaaatacatattattaagataaaaaagctacttaaaacatattctcagttttctgaaagctgaccaacttttatctcaaaagcataatataccttaaatgaaaggatacattatcaaaagaaatacttaagactactcatttcattaaaatatgaaaatctactaatctttacatagaaatatgttcatgtgaatttgtctttattgtatttgaaggcgccaagcagtactttcagtaatcaaagcaattctgaatgaccataactcaccttacttcaaagagataaaaaagcttcttttaaggaagcaaatgaaattataaattaaatttagaattctggacgatgaccctccatataatgacacttctagaagccactttagaagcagacactagacaggccagggctgtctgtttctacattggaagtacaattgtgtaactggtctttattaatgtaagcctgtacctctttgagatgagttcatattttaggaagtcatatttaatcactactatattccccattattaaatgagactgatatttagtttctaaaaaatctttccaatgtgctgcttgtagaatgcaagtcagagaaggttcaaaggaaaactcttaaccctgaagacctgagattctcttaacgatgtctttcactgagcagatcttttgattttaagaaaatccaacttaatcctttttttttctttgatagatcatgcttttggtgttgtgtctaaaaacttactgaagtacccaaagtcagatcaaggacagctaacacctatagtgtatcaaattgttgctcccaacatgaccatctgaaatttctatgctaccactgttgtaagaagtggaaactcaagatccaatccagtgcagattagtggccttatgtttaaagtgtatgcatacttgcaacacaaattcatttctccttaaatctccttacatgtatagccttctccattggtaataacatttacatcatcactaggcttgtcgcataaatatcgaagtacttagaagatctttatgaactttacactcccctaagcaatatttatttttagttttctaaatatttatgaacttagacttaaaataaattgttttaaaataattcacactaaagtcattatttatcaaggattatagtgggaatagaaattatcttaccttcaagaagagaatctagatatattgatttctctacttgtctttttaagcatttttatatgcattgagaagaaacaacaagatcttcaaaatggcaggtgaactaaattgctccagtcagaaaccctgtgcaattgggagagactcaaggaatagcttatgaaattgtccaactgagaagaaaaatagcgtatgatttttatcagagataagcacaaggtcatttctttcagaaatcagaaaatccagaccttccataaaaaatgaaagtcttcagtaatcaggattcaggattcatttctcattttttccctgctgtgctgttacaacctgaagagccagaaaatatcaggcatcttcagtaaaagtattagaagtgaagcagaaaacattatattcatttatggcttttacagcctcaagaaggatatggaactagagacaacctacaacacaactttcaaaattattagcagagagcatctctgtgactacctcatatttgtaatcttaataataattgtggtaggcacatggagtccttaggacatatgctcatgttcctttcttttctgaatgtacgagccctgtaaaacaaattgcttgcctaagacaataactagaaaagttcatggcaggagctaagtctcagttcctctcattcttctgattctgatccagctatttcctatctgaaataggatggtggttatggaatatgtctgaggtctataaactattgaataaaagtttcagcaaatttcaaccaagaatgaggcagctccctttgaaacattttgggttaacttttttattaaataaattaattcttcataccagtggtgggggcgggggggggggcagaactaacttgaggattttagtaaccatctatatgtacaataaaaatgtactgagtgtcccaaacaacacagtgctaacagcaccagagccaaaggagtgaaaacttggcttttggtttttagaagcttcatgattagttgaatagcttatatacataagaaacataaacaaaattttgaagagattggcaaattcatgagagtgtttttaaaattagcatttattcattgctgattataagctaggtacattgccatctttcatgaattgtctcaaaataattctgataataaccttttcaggtagattttattatccccattttataaagagtgatattgagctttggagagattaaataatttgtccaaaggcacactgataatgttactgaaacaagatttaaatgacataatgaaactatttgttcaaaaggaagctcgaacagcactctcatcttcaagtttagtgtcagagaagacaaaatatttgtgtgccattgtctttacctctctcttaaaaaacaactggaggagtgaaccatcgcttagattgggcagagacattccagtgacctgtaagaatattcgttctttctagccacacagatgattattaattcatttgaggcatatggctttgcactgtgctctctaaatgctgccgcagtggtggcatgtgaatgattttcttctcctcatcctgctatgaagtgtcactcttccctgccagggagaatagaccatgaggaataactgcttctcaacacggctgtttgtgataaattttaaaccagttgttcagatccaatatccgtgtaatttattgattgattgttctagatggtgctgagtgccaacgctagtcacatgtttagaaaaaaatcaacaaaaactggctcagaaaagagactgattttctcaacatcaagaagctctcctttgcattcagactcttgttcaaaaatcattaggctccttttgttttccagacaacccaggagaatgatgtacacagatgaaagacgtagccacctgttctcaagcatttgcaatctagcagaacagaaagttgtaccaagaatcatagcaagtgtattaagtaccataacctttatggggagctacaggaactcaaaagaggaccaataaaagccaggagagatgagaggttttggcttcctgttggaactaactatggctaggtcaccaaaggatcatgcaaattttgataggacaagaaaagtagaatgatgattctaggaaaaccgaaagcatatgcggaggctcaggggcatgaaagcacagcttgtttggggaagtggaaagtagttaagtttggcaacacatggtacatttggaaaaatgacaggagatgcacagaaaataattttaaatgaagaacctgatgtttggctcagtattatggaggcaaatatctttgttttgaattaaaatggagattctgtttctgatttttttcaagtaattttttttcaatgttctcaaattttctttgacttataaagcagtacaatgtaaaacaatttcatatttcttgtagtttctgaggaagacaaaggatttggaccaatttttgaagagcagccaatcaataccatttatccagaggaatcactggaaggaaaagtctcactcaactgtagggcacgagccagccctttcccggtttacaagtaatgtacctcgcttctcttttcagagtggagtgtcagagtaatgatcacagatcagcatctatgaacttgtacagatgtaatatagtgctttctgcaaattccatggacattaacaaaaatattggcatacaaactattaaaaaagttgcctaatgctcaaatagcagattttcttaaatatatgcaaataattctcttactattttttgcacagataatgttactggcatttgacattatccacttataaattgtataatggaaatcatgtttttaggcccatgaatggttacataaaattatgcataatttaaatatacagatttgaggataaaatgtttttgttatgtactggcctgcataactcatacctacagatatggataaatttttatattaagtacatttaaagatcttgcacaaataactgtagaaagcaccatatttttcaacagtctcatatctatattccacccaacacagcaaatttcttaaatgtctctacctataggaaaatctatataaacatacctcttactatttttctgggttacatatgtatgctatctaaaacaactttataaaaagcaacaatgagttttcctgcttcagatgggtcataaaagtatactaacagtttctcatctgatgcaaagaatgagatgcaaaaatcaaccaaatgccagtggatttaaatttcacctgtgcaatggttccatgaagacaaaacaagtgactgatggagaaattgggggctctagtgtgttaatgtcacctgacttaattgaaagttgtcactcaacaaagttaattttaatattttttccttgatacaaaagtaactttctattattataaaaagttcttacaaaagagaatatccctttccacccatttgattctaacagtactcagttttttcctgcctttggctataatcacaaaattattcttaagataaaattgtgaatttagatacaaaatcaccatcccattgaaattatttttatcgtttcaatttcatacatggaaatatgatataagtaggtattttataaattataaataacacatttgttctcaaaatatttgatgggctagacttatttccacccttaagccatatataatgagagcctatttgtcattgacatggaatagtagaactaataggatctgtagaggagatccaatccaagaaaattttacaggagaggaagctgaatcctgaataagtaaatttgcttgctcaagaactagtaaatcacagatccaagactgaaacacagtttttatgacttccaatgaggtatgcaattttttcattatttatctatctggatagattgatagaatcccaaaaactctttcagtgacacttatgctgtgacactctgttgttaacagtcacacaagggaccttagcaaatcagtctctaggctagaacagaggcaaccaaaagaaagggctgctctcagataacattctagaaacatggaaaaggctatgcttctccttgctgcccccatgcccccaccccacaggcacaataaaaagcaaagctttgctttgccagtaagtcaccaactgcctctctcaggttgcacccagcactgaaattcccactttgagtttggcctggttatccatacactaatagacagaactggagaagacagatagatgtttaatcttgttatgaagacagtctgcatttgacaggaaaaaaaaaagtggggggaaagaacagaaaaaaaatcagctcatgatggaaatagtttgatggaaaagaacatttaaagtttttaaaatgtacataatttcaggacaaattatactaaccttggtaatcatccaatttttcattcatatagtagttatatatttgtagcatgttctgggacaacgtgctattcatagcaacatcctgagaggtacaacagggtactttacttctgacttataagccttgaggctttcattatcttgcccccatccccaaagaaacaagcattacaataaaaaagtattaaaagggattgtagcaatagtctatgtttctgaaactagaccagtgaacttcttcaaagacagaaaaaggtaatccttatatgatgtcacaagcacaatcagatccatgtggaggaaggtaagataataaacaaatatttggaaccaatataatgagggagaaattacaaaaattggagctgcccaacaaagaaacccactgtcttgacaagagctaagcaacttaacactagatggttcaggcagggacaatattgccatcacctgggggaagaggaaggctttattcattggattgtaatttagtaagttttaaaaatgcaaaatcacagttttctatacttgcttttaaattatctcctatactgcgaaaattgtaactaataatgttccagtaactttgatttgacaacagatattctaaagtcattaggacttttgggcatgattattactctaattagaagtggccaggaaatgagcgatgtggccacgagccactactacttgagcgatttgaccacagctctaggcttatgactttcctgaggacatggaactttaaaggataaaccctgataaagaatgattataaaattatacagttggttctcttagttgagaactattttctacatgcattcttttcatcatcacatcagaaagttagatccctgtttccagtctatttataacactatccctatcagttaatgctctgattatctgcagcatgtcttatattgttatgatattatgtggttggggagaaaaagaattgttcctctttttcactttattaaaagtaatcttagagtaatgagaaaagacataagtgaccactaactctaggctgaggaaaatccagatttacttgtatatttgtggctcggaataaatttttaaaaacccaactgacttttatcattttcaaattgtgtgactgacctctagtggtcagaatatgtcacttattgagcagaacccactgtcaattagtttgttttattgaaaaattactttgaaatttagagtcagatattgatattttgtattttatttatggtagaacaatgcttttaatactttatacagtatatctgcatatgtatgaatctaactggtgcatagatggctatcaattacatcccaagaaatcaatttatggagaaaaactcaacaaaatatttgtcacttgagatacctcacaaaaaaaagacaaaatacgtcatgtactttgatgtttccttgtctgtacttgagctaaattacaaattatggtcctagagactcagaatcatagagtacaaagaaataccacctgaatcatattcttaattgtctgacttcacatggagccgtacccaaattattttagaactgtgttagctccgtagagtttctaggtctcatgacctgtgatatgacctttgtgtctttttctcatagatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatgtaagtaaactgtaacttttaaaaaagggcaagcgtgtttaggtgagttcagcaagaagaacaatcaggaaaggatagtgagaggaaggcatcatagatgaggtggatcttacaagatgagtggaccctaattgtgtaatggagacaacaaagcaccacaaggcatactatgaatgcacttgaaacagtgaaagatgatgttgtcaaataaaggaaggccagcgtctgaggatcttgaatgactctttaaaagttagcatcaggctgggcgcggtggctcacacctgtaatcccagcactttgggaggctgaggctggtggatcatgaggtcaggagatcgagaccatcctggccaacatggtgaaaccctgtctctacttaaaatacaaaaattagctgggcgttgtggtgcatgcctgtaatcccagctactcgggaggctgaggcaggagaattgatggaacctgggaggcggaggttgcagtaagccgagattgtgccactgcattccagcctgatgacagagcaagactctgccttaaaaaaaaaaaaaaaaaaaagacatcaatggaagcaacaagccatgtattatcaaaggggcactatcacccctaagggggtgaaaattgtcttttgggggaagaaaatgtcacatattgcaacataatgtctgtgactcttcaaagatcaacccaatatgacaatattgtattccctaatatttaacttctaatagtaggaataaatttaattatattttagttaatttattttaaatttaaattacatgaaacatttcttttaattagggctaataatgaaaaactgtgctaagctaaaaattagaggttgttttgaaagaaaattttacattgggagatgagttggaccaggtgatctccagtatgtgatttgtcagcacttaaatcttttgcaaaatgaattataggatgaaaacaatgttttaagaagtccttcatggtagggtttatcaggagggaatgagaaaggtccaggaagagaagtaagattaaattagtgtggtgagagtggaaatgtaaataatatacattaaccataaggaaagaattaacaggttgcattgcacaaaaggaaagaagactgtacattttttttccaagttatgtctagtcagagggtagaaacattctgttctcattaataatgggatgggagcaagaaaaaccaatttcaaggatggcaggaagcatttaaatggttgcttcacatgcagaggttattttgatattgagttatccaagttgaaatgtcaagtaagctattgaggatagggatggcattcaagtaagacaccaggcctagagaagtagatttgaaaagtcctctgcaaaaaagtaacacttagcatagatgaattttcagaggtatacactttatactgagaaaagtaacaattcaatgttataatttgggtgccgatcacaggttaggaacaggaagagaggcagaaaaaaatagaatgagtatcagtaaaacaaatgaagaactggaagaatatcaaggaatcaagtgaaatgtaagttccaaatacatagaaaagagtaaagaaaattagaactgaaacaaacccagaatttgagaaggagcaagagattggttactttcacgttccctaatgagggtcctgcctttcacccttattccttcccgatatccaagccctccctcaggaagagaaatacccttcaaatgagtccattcctctaagtcattccttcttacttactttctttggtaggtccctggtttgtctgatttcattgtatttccagataccctgactgagattctccctaagtctgaaacaaaagtcttcaggatatttgtgattttcagggttgtcagaattcttatgcaggctgctcccaatatccatagactttgagctcataacagaactttttaatagtctatacaaaatctcagcaatgtaagaacgaggagctgactttactaggcttcaccaaaccactgagaagtgctgtatctcacgaatgagttatttgctgaaaggtaaaattgatgaatgtctctctttctattgaccagagagtgaatgtttctctttttttctttcgtaattagatcttgatcctttcccacctgaggaacgtcctgaggtcagagtaaaagaagggaaaggaatggtgcttctctgtgaccccccataccattttccaggtaaacttaattcctctctgactattagcatctatgaaacaaaatggacaagtttccattttcttagtaataatgctacattattaataatcatggcttattattaattaaatgagactgaatatttgcataccttgtaatgtgtcactaattgttgtggacactttctttcttggctcagtcacctggctctagtcccaaggatctctaatcattttagtttataaacatatatatatatatatagtattatgtcatcattaaagttcctattccatagggaaattctgttagattttctagaaaatattcctgaaatagaacagtaccaagaaaggatgtataatcaatcattttcttaacaagttagtatctatgaaatactgtgaactgtatgtaactaaaccctagaagggataaagacataataaattattaatctccttaggaataccaatcagcaagaataatcatctactttataaatggggctaaattaagtgtcatctgttatgaaattcaattttgaatctatgttttctgtaattttatatggctaagacaaaagccaccaaagtgctaattaaaagatgaattcctcatatactttcaccaattttcatttatttatcaaatatctctttgaaacaatatataaatacctgttttcacaatttaaaaatcatgtttctattcttttagttctaatattatgccttaaatttgactttaaacatctccatagagaatgaaacgtaacaggcttttaaactccatacaggattttgtgtgggatacatcaatctgatgtgtgtgtatgtacatatacacacacatatatttcacacaaaattatgttatatattccacatgaaattgtgtgtgtgtgtgtgtgtatatatatacacgtatatatacgtatatacgtatatatacatgtatatatatatatacgtgtatatatatatatacacatatatatatatagagagagagagttgtggttgtttacatatcaaatatttgtgattttctccacaataggagaaagatgattgcttgataaatacaggaggtacatataaaattcaaaattttctaacaccctttcaatgagaaaaacctttttcttaaggaactattgaaattatatatatatatatatatatatatatatgtatgtgtgtgtgtgtatatatatatatatatatatatgtatatatacatattttaaaaacctaccattttcatagtgtttcccacaaagtaatgaccaaaactatccagtgactacatttgaccatattcaatactggatggacttcactgcatcactcattgactcagaaaatctcttatgagtatttgttatacagcaggcacaatgtatgccacagaaatgcctcagtggagcaaaacaggaaaagctaccagccttcagaggtcttccacggggagagtcagacattaataagataaatggctaaaagacatgccatgttagatattgctaaataaggatagatagatagatagatagatagatagatagatagatagatagatagatataatgcagggaagtggggagagtaagtattgaggggaatgactgaactcaggaggagcatcactagaaggaaagttggaataaacacctgaaggaagtaaaggagctaacaatatgagtatccgagagaagagcatgccaggaagatgctgaggtcagactatggaagaccaaggaagccagggtggctgtcatagagtgaataaggcagagggtagtaagaaatgaaataagagaggtacaagagctgcattatggaggaccttatgatccataacaattattaatactttggcttttactttgaatgcgatttacattggtgggctttgagcagaggagacacatgacatgacttaagttatagaaaggtgactctggttactgttttaagaaaggacctggggaggacaaaggtggaaacaagagatctgtttggaggtattgcaatagtttaggtagcatatgatgggccagagtggtggcagtggaggtgggaagataaatccaagcatattctagataaaatagaatatactaaattctatatagaaatctaggtatactttggttaaattctagatatattttgaaggaaaagccaataggatttgcttgttgactttatgtggtatataagataaatacaagagttgagggtggcataaaagtttttgctgtgagatcctaaaagaatgaagttgccattacttcagctgaaggaatagatgtggacatgttaaatgtgaagcatctgttaagcttccaaacggaaatcaaggtggcagttctatatgtgtgtagatgtcgggggtgatggaatatcaatttatgattcatcattcaataagttgttttcaaaactatgggactgcaatgtgcttacctagacttctggggcaaaagcaagaagtgtcatatatctaccgataaaagcaacatttcttaagtatgtgctggcacttactgaaaaaataattttatggttatttattgtttaatccagtctataatccgaggaaaacagatagcttttgcaaagatgattgattttatcatctgtgtggggctaggaaagacacaaagaagatggtctgttgagtccttgaaagaactagatcagggcttagctcttgattgacaaagtcacatctcatccgtaagtcggagagtcagcgtggctattgctctggtgttggtacagcttattttggtgatggtgggtggggaaagaggtgagaacatcagttctgcctcccgtttgctgtatgacctcaggcaagtcacttcaccctattaggccttggatcccccatttaaaaatggcaagagccattcctacctttgttgtaacgattgctgacagattctaacaaattgcaattattgttttgtccaagtgaatggctttaaaaataagtaagatttgttaaataaatttagattaattatattgcaagtcccacaaatccaaaggccacatctatcttgtttagcagcacttggaaggtacttagattttgcaaaataagtaaattagagaatctacatcgggcattcagtcagttagaccagttgttctatagtccaagacttatgttcatacaacatcacgacaataacttctcggatttagcatttatcccttataaggatcaagtaccatcacttctttcattccttttcacacatctcttatgagtggggcacaggaaaatgtcttacattttagagaaactgagtaatagagtgactaactggcctgataaaaaagtcatactgagaattaaaattcaggtctctgtattcacataaccactgaggattcagattactctaaatgcattttgtgggcagtatctttcatacattctatagttacaaaagtcctttctctgtaaggaaatacaaaatttcttgacatttttggctttggtggtggggcagggggagtggggatttaatttttaacagaaatccttacaaaatttggatttacatttcaactgagaataggaaatattaattcagaatcagaaaagatcaaagtcttcttttaaatgtactatacatatcagcttggatgaaagactacttaatactcctttctgaatgtgatacttctttacttatcccaggagccctcatttaagaaatttaagcagctccctaaatattttcctatactaattatcctgtgaccctaaatcagcaagaagaaaacaaatgaaaagaattcaattattcacagatataagtgcctagaaatatatgttaaccgtaattctgagttagaggctaattatggtagtctaattttctgcctctttttatctgtattctgtttcttcaataataaacatatgctgctgcttctataatttgaaaaaatcaatgttgaaaaccaaaagaatataatcatattcactgcctgtcttgatgttgtattttgctggagaaaattacatagctaagctaaatataatgcccaggttattattcccaattatgtgaagcttatataatgtgcatctcttttagtttttcatagtcattgtgctttcacactctctttgaaagctttgctagccacgctgagttcccgaaagcaaaatagccatttgtcatgattattcatctttaaaagaagcctgagtgctgtgatttcttggtttttcaccattttacacctaaaatcctatctagtctgacctagagagattcccacttatattcttcccagtagaaattgtctttatgtgatcaagatgttttgaagggaatcatcattttttgacctaaaggtatgcattgcccattgtctccttgtgtatttgttgaatgactcctggggagtcattcatcaaaacagagaggaaagaaggaatagaaaactataggaaatgcagcaaattaaggaggaaattcagttttccatttaactagttagtgtgttcagccaaaggaatttcatgtgggtaagagttaccatatgatacatctcctaatatttaattaaaccagtaccatacttttccctgtttctgtggtttccctttttaatgtgaccacaataggttatgtaagctcatttctaactctataaaataggtgcacacacacacacacacaaaaaaaaaaagataaagcaataatatggtaagtaatcttaattatatttataaaatgcagtttggcagattaatcatggctttcgagttattagacatggattcaaaatcctatttcttcttaatagtcatgacattctaagcaagttatgtaacctcttcgagtttcacttagcccatcaatgaaatgaaagcaagaatataatagtttattaaataatagaaatagataaatagatgtaattgcttagtgtaatgcttatattcatgtgaaatatggtacatgtttaaaagtgtgcactgtttgtcttggctttctcctaacatttgctccacaatagcctttattagattaagtgatagcttgttactagcctctattaaattatgtaacaactttgggagaagcacttaatatttagaaggcaatattttctcctagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgtaagtattttatttgttacactctgttttcgcaaggttatctacatatggtatacttaccgtaatgaaaagaaatatccagtgaagactagctgacttttcaggaaggacaatataaaaggggatgcatgttgaaggggccaaaggcttggtcctaagctttttgcgttgagaagatttagctaataaaattgctgtaagaaggttgagttcggatgagttgcctctagctcggaaaatacacaggggactgataccttagtccagttctagtgtattggttacagtggaaatcactgacatctactttttgttttgtggccattcctacttcttagtaagctcatgaagaaatcaaaggattggtagatcaaaacaaacaatagtaattgtagaattttttaagtcattttgattattttggtatttttaaggaactatttacatgatacaaataagtaaataaatggtcttttctaatctacataatcagcatgaggtgctaccctggtagcaccatggcagatgacactgacaatctgattggcctttccccaggctccaattgaactacttcccttttaaaaagcactgctgcttaagagaatcaaatcacagtatacttgcttactttacattatttctatccaagtccttctgctacattaatatcagcaaattcaagctcatgagagcataccagcttcagattaacagatttaggtttggctcctgcctttacccctaagcacagtgtgatgatgggaaaaatgctataataccattgaggttccatttttatttttctctgcaaggcaacactcacataattggtattcaaaaaatattgttgactttctggctcatttttcttttctcagttttaagagataatctcaccccctacttcatagactgaaaaggagccatcatgtaaaaattctcttgattttctttctactcttccccagaaatatacttgcaattcagcacttctatttattttcttactttttgtctccatagcagaaatatttctcccctcgctcaagctaagttctccagttgttccggttcacattccatttgtttcaattagaaacttcactacaacacttattttcttctttcctgaatcctcagattctgctctacctcattatctctgcatattctcttgtattcaatgcaattttgaattattatgaattcctatttgctaaatccaaaggacactttgaagtccttattctgtttgaactttgacactgcctcttctgcctttcatgaacttttctttcttcacttaatttcctgaactcttcatctcccttctgcctctctgacaaatttcatagaatattcttcacaaaatattcttctttcttatatttttctctaatcttttcctaggtattctcacccacttacacattttcaacagtatacctttgcaagagacttcaagttcacatctccgaaacttttcttgtgtttagatgtcaattcttcctatatcctggacttgtcccccagaaagctctcacagatgttaagctcaaagtgtcacaaatacatgtgttacttctctccaaaaccttccttttatttagcttatttagcaatacagtttcatttctaataactcaaggtagcattatttattatcaaatcccaatttccactgatcttcaggacagctaaccctgtggttcttaattagtaggtaagcacctggggagttttgggaataatgcaggacccagagatactgattcagcaggcctggaatatgacccaggaatccacaagttgaaccagtatcctaggtgattctgatgattgagcctttaatctacaccttgagaaacattgatccaaggagccgtcctgttgattctgcctctaaaatacaatttatatttactgtttcctttctgttttcactgtaactatgccctagtgttggccctcacctgttttgcctgaagtattgaaacagcctttttggacctctgagactgtcttctatatttctcctctccatgctccatcctttaaaaatgccagcaaggtcttccacttaaaccaaagataagatccatattacttctcttaccaagtcccaatggtagttacctgatacgatttggctgtgtcctcacccaaatctcaccttgaattgtaataatcttcacttgtcaagggtggggccaggtggagataattgaatcatggggggctgtctcccccatactgttcttgtggtagtgaataagtctcatgagatctgatggttgtataaaggggagttcccctgcacatgctgtctcttgcccactgccatgtaagatttccctttgctcttccttaatcttccaccatgattatgaggcctacccagttatgcagaactgtgagtcaattaaacctctttcctttataaattacctagtttcagatatgtctctattagcaccatgagaacagactaatatattacctattgagaaaattcatctcaaaatattattttttcagtccttctagattgtgggttcaagctcatatacttcagcatcatttgagttcctagaccttttaaaattccttgcacactcctggagctttgtcgtaatatggtgtttgctcaagctaaactggtccaatttaaatgccatatttgcctcagagtgctatagcccttacctacttctaactaccgtcctcatcagtcactctttcaaagtacccattttgatttggcttatatatcattatttatttatttgtctctttagcattttacagtgtgtggtacacactcaatttgtgatcctaaacaatgcctttcacctttctaagcctgattttttctgtaagcctgaaggattaatacatctttcaggactgatgtgctaaataaatgaaataaagtgtctagtttgaagagtgctgtgttgtctgagtaaatgttttccttctttccctctctccttctctcttttcaatttgtttccctttgcctttatctctgtgggcatttcttcttttctccttagtttcttgccttgcgtctttcttttctactctcttctccttcttctctttccttctccctcattttctttctccaccttcctgagttccatgcagcactgatcacaatgtttgacacatatctgttgctcactaaagacaggattttttttagtaaattgagtcacaatggttatgcagctgtcagaacgagccaatattattgaaaatactgagaagttatactatattcatactgtgcataaacaaacaagtctatccattatgatatgacctgtacctgtacagagaaaagcttccatgttggagcagctctaatcctgtagaattaccatgtttaagaataactaatattgtgcctaataattagtggatatttgtgtttctcttaatattaggaacaacaaaaccatatcctgctgatattgtagttcagttcaaggatgtatatgcattgatgggccaaaatgtgaccttagaatgttttgcacttggaaagtaagtatactgacacttttattaatatatatagaaatagtaccattttaggaaataaataattgtttagctataaacataaagtaattgtcttttaagtgtgtgaaactttaacccttgtatcttctatttaaagtcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaaggtagatacattattttaattttgtataaatttcatcagtatcttatttagagccatttccatacatgaaaaactactatataatgattaatggttttaaaaacagtgatgcatgttacatcatggagaaagataaaatatttctcatatgtctaatgaagtcacaactatgagttatagaagttacgaacttattaccagttgaaccataggtaatagcaatagattgatagaagtgttattggtaattttcagaatatacacttaatgtagtttgtttactcattttatcactgtcttttttcagtatctttttatttatagaagaagctatgtgttatgacttagtttaagtcagtggtttgcaaacttaagcatgcatcaaaatcacatggagggcttgttaaaacagattgctgggccaaactctcagaatttttcattcagaggtctgttaggggctcatgaatttgtatttttaacaaattcccaaaggatgctgataatattggtcctggagtcacactttgagaaccactggtttaagaaatctttttttttttttttgacaaaattatcatggcacaaacctttgattttcacacattaaaataaacttacatttgggaagacagattttttttcaggccacactggaaactttccagactgaaataatttctataatgttccacaacatgaactttgcaggtcacaagtgaataaacatcgagggcttccacaatattattcgtttttaactctggctactgtcccatttcactttctcccgtctctcccaaaaaggaataaaaaatttgacagattcacgcattctctctaaaagtgttgtctccatctccagtttttcttctctcttaattgcactccaacatgatttgcatctctgcctctccacagaaacctttcttttcatgaccacagacttccatattgctaaagctaatgatcaattctcagttgtacttttttttgatctaacagcagtggttgccacagttggtccctcccttcttcatgattcactttctgcacttcatgtctgcaacctactttgttattaatttccttgtataatctttcattctccattgcctttcaactccatacttttctaacattggtgtgatcagggttccatctgtgaaccccatctccatttcagtcactccatttatgatcccactcgtgatcatggctttagacacactctgtaccctgaatgctctaacccaaacatttactctgaacttcagactcgtatgtccaatgccacagtaacattaatgcaatacatatcaagtctgcatgaaatggcctcctaaaaggaagaaaatactaggtaaggtcctttaaacttttgaaataaatccaccactttctactaggtttctaaagcttatagacctgtttttattcaacatattaagaaaactacactccaggttctcaacagagtaaaattttgaactgtctaatatctaaagccttagaagaaccaaggtgacagagcacatatttacagaaggtaatttaagagaaatattatttattctttactaatgcagcatactaagtattatctttaggtctgatcacatcactagaaggttacataattaagccatatatagactgtgtcaagccaattcaattattcattacatgatgtaatagaaaatgtctgtgttgtctttgtgaggccaagacaggaagggtgctgatattcctgtattatgtattgctaagattgtatacaaaataaaacctttctcccttacaatgaacatatccaccaatagtttaaaaaatatctccctatgttacaaatataatgatgagtgaaaacatgtactaaataagattatatatgctttaagatatataggtgtacatatgtctacatgtataatgtatacattataatgtataatgttgatggtatttggtgagataaaaatgttttctagtttttaaatttctagtattttattacttgttaaatgttttttataagatgcatatattgcttttgccataaaattaacacaagttcccagtttcaaagaaaattaaatattattctccactcaggattctttcttcctacttcctttttgtattaatttatttatctgcatttatttggactagataactgaaataatcaaaaagactgtcaaattgtttatttgcttgttctctaaaaatattttttctttggaaaatttttagcattttctcatttttatggatgtctctttagctatcaagtagatcagactaaagaatgagactgagatcaattttaccaatgcatggatttcaccaatcatggctactgtatatagtttctaatatggaaagagtatatttaggtgtccaagtcatttttctagcgccaaagtgagatgttaccgtggccactagctgaaagttccatcaaaatgaagataatgtatacctgagggagtgggaaaaatatctgagtctttatccaaaatgttaagagatggtatcatattgaattgagatgtaattctttaaaacctcaattatcattttgacagacttgaaaggtttatgttatgagcagaaaaaaatcagttattttagtaataattataactcagcttttcaacaaaacatgatttacaaatggaaaaataatggctgagttatagttacctcctgctgtaataatacaggatttgcgtaggttaagcctatgcaaagacaaggcctattactgagttcaggatgcatacactatctgatgtattctgcagaattaggttaactaaatgtaatatttatactctggagattatgatggatcttgagcccttcatttaacatttacaatgttccttactttttagcattccctgagtgggtagaacacatcaatgacacagaggtggacataggcagtgatctctactggccttgtgtggccacaggaaagcccatccctacaatccgatggttgaaaaatggatatgcggtatgtatgttcaagtgctttgctgttcctgagtccctgttcaagcagtgtttcagggtagtcctgggataaatttagcaggagagacaatacagaaagggcacttgggccctgaaatataaaagcttcctaaaaaagacaaaaactgaacataaagtatcttctttcagtttaaacaactttctgtaatcttactctaccttctctctctctctctccttatttttttcctttgttccacttttccaccctcttcctactcatccatctccaatacctgatattgtcctctttttcttgccactattttcctgtaccccacagagacagaggtaagagtgaagctctaagtcctacctttggccctggggacaagtagcagcagtgggattcttctctaccttcccactgtaatctcccagctggtccaagaggggaaaaggtggactctcagctctgtaggatgaatagaacaagagcctttgggcatggtaagtgggttttcctttcccatgccatgaaaatcccactcagttcatcttaggtaacagtgggggcagatgaacataatgtatctaaatgaaaagacaaccaaacccagacctaagtgaaagtatttctattaaagttcattgagaatatgtttcaattttattcttttcagtatcataaaggggaattaagactgtatgatgtgacttttgaaaatgccggaatgtatcagtgcatagctgaaaacacatatggagccatttatgcaaatgctgagttgaagatcttgggtcagtatcatttctaatttctgttaaacattgttaaagcaatatgtcatatcacacaaaatgtttattgagcctacacaaaatacccagtattgtgttaggtgtacaacatatgttggttgtttactgatttatttattgctaattatcataattcagactaacgaaacaatggaatagaatgaatctttgccacaacaaaagtcttcttcagagcatcagcagcagtggccatacctaggagcacattagaagtgcagaatcccaggctcaccccagacctactgaatggacactttaaaaagatacccagatgattttaatacaaagataattttgagaatgaccagaccagaggatgaagagtcaaaacccagatgaagatatgcttaggcctagaaaagcctccagaaagtacatagttacggatgattgtaatgtgttgaaatatatggatgaaatctgcttggagtctgccaagggaagaggagagtgagcagtggattaaatgtgtggatgctgaggaaagtctgagcatgacatcaatgaagtaaccttttttaagcctctgtattctgttctaataattattgctctgtacttggaggtaatgatgaactacaaatgatcatgtctccttaattagttgattagatccattattcccatagctgtttatagatagatcctgaaagcaggactccaattattttggcattttgcagggtgtttgcatacagatgatgctcagtaattgtataaagaaggagagactgcattgtttaatgaaaagtacatgctttggaaacagaaggacctagattcaaatgtgactcccacttattactacctgtggtacctttgccaaattaaataatcctaatagatttcaattttctcatttataaactgggaatagttcattcaacatgtggtttagaggattgactaggaccatatgtcagtgtgtataatgctggtcaattttttccagcctttcactttactttccttgtggaattgagtcaaagcaacagaattcagagttaattttaaggtaaatgtgtataaaacatttgattgaaattgaagttatttatttattgagacagggtctcacggtgttgcccagcctggagtgcagtgaggcgatcacgcttcactgcagccttgaccttctaggttcaggtgatcctccacctcagcctcctggatagctgggactacaggcatgcaccaacatgcccagctaatttttttgtattttaggtagagatggagttttgccgtgttacccagtctgctctcaaactcctgggtaagccatctgcccacctcagcctctgaaactgctgggattataggtgtgagccacccatgcctggattctaattaaagtttctaataatcaattcagttatcatcaagaattgtacatttgaattgggtgaattttataagtcaaagttattaaataaaagttacaaagcattaggtatagaatgcctattggtgacagctgatcatatttaccgagattaatcctttccattaactattaaggagaataaaagattctacaacacagaagcaatgtttaggctttacaaacagaaagagaaagataacaatttgttttctttttagcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcaggtcagtgctgaaactagaaatccaattgcaaaatctgtttgaaaaagtttattttatagaagacttgtttatatgttaataatgaaaatgttttttgctctgaattttttttttcacagaagatcctgtagttctaagatggacagaaatacctatccctgtcagtatctattataatgaaggtttaattaacaggactctataatgtataaggaatttagaaaattgaagctcagaggtgtttttttgttgtcttgttgttataaattgcccaatgtcacacagctaataaacaatgggaaataaagtaggatctctctaacatatttttccccagtataggcatctggcatctatatccattcatattcaactgaattttgtgcagttagcctattaaatatttttgtagaaaaataaaaaggtgatttcaaagtgcaaataatctcttcctatctcaaaatgaacaagatgttatcatcatcttccttataaatggaccatctaccaatgttttggtggtttggggacaaaatgaaaaagcagtgtacaacttatatagattatttgtataaaagccacactgaatagtttatatgtatcctagaagaagtaatattgagtgcaaaaattatgacgaggagaaagccaggatgggaaatgggagggatgggatgtgtgggttggcttgagggtgtatgtgagggtgtatgtgagggtgtatgtgaatgtgagggcagcatgtacaaaggccctatggtgaggagtttagaatgtgtaagaaattgcagaaactgaaatcagtgtgatttgtctttagaggaaaatggaggagacttttaagagatgagacatagtaagccacatcataaatgacaaagttttctatgctaaggggcttgggcttcatctaagagtaatataaatctgtttaaagtcttaaacaagggaggacaaggatcacttttgtcatttgaaagactgttattactcagatgtagaaaatacattattttcttcacagtaacccaataaagtaacatgggaattatcatccatattttgatgtgtctaaagcttggtaaagttaaagtgaccttctgcaaaaatatattcatgctatctaaactagaacttgaagttgtaagacattgatataaattgagaatatgccagcacagccctcttattaggatgagcacaggcacggctgtttatggaatggggcaagagggcagggacatcaggggcttccctgaacacactgacttttaaagttaatatgtttgacctcagggttgttaagattttaacaaaatgatactacaagaagggttaaaggaaaagtccatttgttcaatttgccgctgaaacattaatggtcagacaatgagcaatgcagagaccatgatcaaagggcagctacatgtgtaggtgcttactccttccacagcctagagcagggcattccccaatggacaaaccattagttctcttccgtgataataaaatctttttctgattctgatgaagacccatgtcatggacctcttcaaccaaggatttcccagaactatgtttcatggacttgtttttcctaaatatcaatatgtgttcaaaaaaagaagagaaagatctagctcctgaaattttacaagtttgattgtgttctgatatttttaaagcctttgaaatcaaattgcattatttccttgattaaagagtctataaatctaatttttacttagtactttaacccattactatctcagtgtaaatactatttaatagtagatatagtattcatatgcaaatatatttgaattgtaaaataagatgtataaaaagctaaacataaaaattttggtgtctattttgaaaaagaatacacaaggactaactaaatattggtctttaagcataaatataatcttattcttctgaatataattataaacaacatttccacgtaactaagttatttctgtatctggttagtgcctaaagagtggtttatatgatatttggaagaagctatgtatcttgataaatagtaattaggttttcattttatgattttatttttggctcaaatgatatattttctgcagcagaatttctttgtaattagcagaattaagttagttgctaatttaaattcaatggattgctattagctctaaggtcacttttatttaaaccacttataggaagggatcttcattagtcttttctactccagaggttattctggagtaattttggtaccaataagtgaccaattggttaaagaccagattgttcctagtttgtttgacagctgatctatatcatagtatctggaaataaggataagatcttgagagtttagtctatattactttaagaataaagagaattattacaaaaaaatcaggttttctaaatatttttattaaaaagtaattttaatctcaaaggcaaagtacctgaaagtataaatgagacgaatgacacatggaattatgtataccctttaaagatggtaaaagatcaattgaaaactaacataagtaagctaaaaatattagcatgatttaagaaagaatcatcattgttttttccactgctacttcattataatttttgttgtgcttcttgaaaaataattaaatgaaagggatgtgggaacttggctgaggatttatactagagggtagtgagaaaaagtgtgacccattaatattggtactgtgttaatatgtgtcctccaagaagctgaagccaggaagattagctatgtaagaaattaattaatggcaatgcatgggagggaaaatagagaggaagctggtggaggcttggaaaagtattttactgagatacaggtctgatcccagatgaaggacagagggaaggaaggaaaaaagattgtgttgaaatgacttggactgcactgcacttctaagagtatggtcatgccactggaaagtcttccattcaaaaatgcatatcagaggagtttgctgtcttccaggagcaggcctggtttaaaattcctcccatggtcagtcattggctaagaacagcctgtggaatgtgtggctttgaataaacacagtgatggatttctgagtacggcgtctgggacagagaataaattacactcctcagagttggagagtggcatattctcagagcttccatgatcttaaataattacttttatcattatattattttgatacttcatttctccttcaacaacaaaaagtactctgaaatgagcttcaagtcaggactggattgttcaagaaaggaaaggaaatcctggactataatgttagcggaaattttgttattttcttatatgaagatttttatcagtaaggtagatagttttgcttcttttatcagactttgcccttaaaatggatatacgtttgcatgttttgtgcaaactttcaaagataatttagttttgaaaattatctatttaaagaaagtaaaaaatccaatgacaggcaattcaatatttaatctaagtgtgagtttctatacaataaaacttagtgagtttttagtgtccatcccctgaggaagaggctgacaggtagggaaatatgtgtagtatgaaagacttagtttctgttcaaagaagaatttcctaaatattaatttgttccagaagttgttactaaggaggttttaaaatattttttaaagtttctaaaaataaaatacatttatatttctctgtagccatggaaatggcaatctgtcctcacctcctagtctgaattgaagtcctgaggttacatttctgggagaccggggctcatttctttcaggcctatgactgatttcagcctgtcccatagtggaaggtcagttagaagactacggcaatagttcaagaaaaagatgaaagtggatttccaaaacaaaatgtcaatgatgagaaaaaatattataactaaaggctagaatttgtcatcttacaaaaatgtctgtggtcgcatgatttatatagaatgtaataattgaaaaatattagtgtttgtaatctaagacataataatgtattttactaaatcaggtttgtgaattatatatatttttatttcactagaatactcatttgggaagatggtagcttggaaatcaacaacattacaaggaatgatggaggtatctatacatgctttgcagaaaataacagagggaaagctaatagcactggaacccttgttatcacaggtaagttaatgtttgagggtgcttaatttctaatgtattaaaaaacatgattcagcactaagcatctaaacagtcaatgtatttgtaagtttctttttcaaaagaatttcaggcaagtttcttgcttgatgatattgttcttggaatttggaagtgaaaacatcttattattttgcacaaataaaaatatattggttattattttaatataccagataatattgtgtcttatatcttcttgaattgtgctttacatttaaaaatatatagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatggtatgtgttttaagtttcatcttattaacaccccagtgattcctatgtgtctgcattgaaagttctattactataatcacattttatatcatctttgtttttcatgagaccaaaaagcaggcaaaaaagctttctgtggttctccttatattaactgttgtactgctaaatctttctaaaatggctagccctgaggattttggtataaatattaatcaattaatattaattgggctttaggtatgatttcccccttaattttaatacaattgatgtgtattacatcagtatatatgtgcccttggttctagtgccttcctttttactttaaatgaagagcatagaacttaatctttgttataatgatgatcttaaagcatttatgttatgctttaagagtaagaaagagacaaaattatatatgttggagaatttggagaattagtttatgtgatttgaagagggttaaatggctatattttaagaattgaaaggtgttacattctacaagtcctatagttaaacatagtgatatagagagtcaaggtgtagaaagaaataaaatagagggaaaagactgagaagtaatgcaggcaaaacaacttgtgtaagaacattgttggtgtcttggtaggctgtctaggttacagtgtatttaaaaagtaaattaatcactggccctatcagcctcttctttagaaaagcaaacatttgtaagactaaggacatatttagaacataggcataattaggaaaacttttattttagaagtcagttattaatataaaaaagaagcacaaatgaactcagtaggacatttaggattgtttaagtcccataaaatctgaagattgatatgtacacattattatattatgctttcatattgtccagctatgtttttagctttagaagagttgtaatttaactgatctagctacaactgtacacctctagtaaacataccaatactctttcagtttctgaaccaaaattatactttaaagaataacaattgagaattggcagagaactgtaaattttgtattttgacattatataccatgtaatatattttccttatagatctgaaactattttgcacatgcccaaaattagtcaaattggcaccaaaatctccaatactttatttaaagtgtattttattttgcaagaaaagtaaatacaacttgggttttattcattttaaaggaaaaaagtaagctaaacagggatcttactttctcaaaaagtaggcttctgaatttgaaagaattatctttggtgttataaattgaataatttcaaaagtaaagtctagaagttccacaaccatagtttataaagtagtaactaatagctgcaatgaagtctatgtaaataaatttgcagacaaaaattgccctaaactgaaacttcatatttagagcttatttatattctttaaaatactaattacattgtgctggtacatgtaaataatgactgcaaaaagaaaatggaaaaaaaaaggaatttaaagagaaagaaaaatagatcccagtcccctttaaaaaaaaaaacaggaaaacaaagaaataactggaatactaattaggaaacaaataataaattagaccataaaaatgtaaaagaccttgtggccacttagtgcacactctcccttttcagatgatagctgcagagattcacatagttacccctccagctaatccagagcagagtcctgaccgcaggctcaccacctcaggtttcagttcattccatcaaataatgatctgacagtgggagcaaacctactcaactgactagataagcatcttaattgaatcagaatatcaaatgcacatgtttagcatgtcatagatggacagatgcattcaattatctcgatttttaaaaagcctggataagaatcattttaaaataaataattaaactgaattctatctttcaaaccaacacaagactaatgaagctatccctggcaccttccttctcttttaaggcaaactacaaagttaaacttcactggtcaatatgccatgcaaaatttaagtaaaaacgctataaatatttgatccaccttttggaagatagtcctaacagctattaattgcttctaggattgttaatagatcattctcagaattagtggctcctcctatgaaaatcttagtgaatatatatatgtctcttaaataatgatttggtattttatgtagttctcccaatatttcaacaattgaatagcatttgttcattaagaatatgtactaagcacatgccataagcagacacagttgtaggcactaggttaaataaaacactgaaatagacatggacaccagcccaaaataaaccaatgataccccaagagtttaagattcagatgtaaatgttttttggtagctattacagttaacaaaaccaacataattaacatgttctaacaattttcattgctaaaaactaatacaggaagttctgactaataataaaaaggaatagggaaatcaaattttaaactttttatttcaagaacctaagtttttattttccaatttagtttcaataataaattgaattcaataattaagtatgcactgattttagcttgctattcttgattttaaccactaaggggcaaccttgtataaggattcaaatttcacagcccggtgtaatttgggacttcttttccttcatgaaattaaacaaatgcatttgctcctacttatgaataaattgtgagattataggtgatttttaaatgtcttctttatattttttctaattaaagttatgtaattattaggaaaaatgtaactgtacatttttaaagatgtatatttcttttaagagtttaatgggaacaccaaaaaagcaaaaataacactgtctttgtatttagtaatcctactttatgtaaaactttgggattaatttattttttaatgtaactttcaattttaaggcagtaattgcacacctagtactgattatagaaaaacactaaggagttaaacatctaaaaatttcctgagtattatattaatatgtaataattgtcagatgttccactggaacttgaactcatgcatgggggatgttaaaaatacaagctcgaagcagaaatttaataaatctgaggctttgatacaataagatattaaagcagtttatctgccattcttttattttgttgatgttatatggcaaatgatcataaatgtttcaagtccaattataaagtggctcctgttttggctttctaattcaatagctacttaatgccttggagtaaatacaaaaggcagagccattttatttattcatttaatgtataacttttcttgttccagaaaagacttaagacaatctatcaaaaatatgaattttaaatatctcattttattcctctttcaaggtggcacctaacctgtagaatttttcagtagccctcaatttttgacattcactttgggtcattttctttcaactgtttaacaacattccctgcttagagccattaagttagttaattacatgagttccttaaaatttccagttttggagattgtcactatttcatatatatatatatatatacacacacacacacacacacacacacacacacacacacacacacacatatgtattactcttattacaaatacatgttaaatttgtaatactgtgggacattattgcctgtcttatatgaattcataaatatcacttgaattgttcagagattgtgtcacaaaccaacctgggctttaggcttcattttctcacctcttatgtggtgactctgatccagggattaaaattctctaagcctcagaatttccctctgtaaaacgtgattaatcattcacttacttcattcaggttacttcactgggtttgaaaaactagttacttcatgaaagagtgcatatagagacttggcacagcatctgagagtattggggacacgaataaagtatataagtggttattaatactttttataagagagcaatcatcccccattggaaattccagaagcttttgctagctagtttttctttctttctttttttttttttttttttttttgagccacagatctcatttttcacaatttaatacttgcactgcttgctgtgctggatacttagactgagaccaaaaaaaaaaaaaaatctgggtatttcattgctgaaggcagtgaagaggtaataatagccaacatttattgtgggcttactgtttagacagaattgggttaaatgtttttcacatatttctcagttgatcttcacagaaatcctctgtggagtgcatattattgtgattttctcagttttcaaagtgaggaaagtgagtattagaaaagttgagtaactggtcccatgtaatcatacaagtcgctagaggctaacagaagatttgataccaggtggcctgactgccaaccctgtaatctccaccactttgattcatcttttggttaatgttcatgtctgtgtctatttaaataattctcccataagtatttgatgctctacaaggcaatactgttcaattcacattttattctctaatctggtttaatgaaccttgtatgctcactcagattgcccaaattacttcattctccctacactgttggccacctttgcaatacactgtaagtcatgtctacacagtttcaagtggtctaactatgaagttcctggcaattcctaatgatcccctgtagacaggtatgctaggtgtgtgtttgcaggtatgtgggtgtgcattttttctgagtgcataagcaataccattcaagagagaagaagacagatttctcacccaaacgttattttccttttttaaagaaaaattttattaaacatatcaaaaaaggtctttagattttacaaatatgtatttaaaactagatcatgctgtgatcttgtacagaaattttgtttctgcaagacaagaaaaaggagaggaaaaatgataaaacagaagtcaatttgtttttttttttgtttttttacaatttaatcttttatttttatttacattttatgtagaatgcttataactagaaagaaaggtttctttttttatatactttaagttttagggtacatgtgcacattgtgcaggtcacatatgtatacatgtgccatgctggtgcgctgcacccactaactcgtcatctagcattaggtatatctcccgatgctatccctaccccccctccccccaccccacaacagtccccagagtgtgatattccccttcctgtgtccatgtgatctcattgttcaatatttcattgtctctattcactattttggttgttgttgctgtttttgtgggttttcttcttttcttttctttcttttttttttttttttttttttttttgagacgtaggttagctcttgttgcccaggctggagtgcaatgacgcaatctcggctcactgcaacctctcccaggttcaagtaattctctggcctcagcctcccaagtagctgggattgcaggtgcctgccaccacacctgaccatttttttgtatttttagtagagatggggtttcaccatcttggccaggctggtctcgaactcctgacctcaggtgatccacccgcctcggcctcccaaagcactggggttacaggcatgagccaccgcacccggcctctattcactgttgaacaagaaggttaagattatccagaattatgtgggagaaaacgaggacggttgggcaataatccttggtaagaatcagattcgagccgaaaaaaattagagcaggataccaggcagccacagggagatcgtggaagccctgaagtattgtaactttggtcccatgtggagacatttttggttatcacaactgtagaggtgttgagagggtgtgtgtgtgtgtgtgtgtgtgtgtgtgtgtgtgtgtgtgtgtgtattgcatctatttagctattaaatatcctataatgcacaagacagattccaaaaacctagtattatctggcccaaattatcgatagaaccaagcttgagaaacgtcctcaagaaagatattaaaaaagagacttagcaatactgggactagccactgcaaggttttaagcatgatgtattggaaacaaagagatgttatattgttttgagcatctgagagtattggggacacgaataaaaagaaactagatttttcaaaatgcatatccaaaatagtttaagtagtagaggatgggttttatgtgcttcttgaatttaagactcttaaattttgatgagcagtggaaaagagggagaaatacataaaaagtatacaggctcctggcacagtcttgtgacacacaaaacatacaaaagcattcggccaatgtcaaattgctctatttttcttatcagtagttagttggaaaagagttaattagataattctatcatacttcattctgtatgaatatataacttttctgatcccctttttactaccttaataaacctttactgatacctaactgctatattttatttgctatttaccagtgttaaacgaaggaaggtatctatgttcctgggtgtgttttcagttgggctagcttcttttaagatcatcacacttcccatgtatagaccatgttagctgatgtcactctctagcctaacttctcatagtccttactaagcatttgttgataagaatgccaggtgaatggaattaagcatatatatatataagaatgccaggtgaatggaattaagcatatatatataatataatatataaaatgtccattctgatcacttttttctacaaagtggtccaagaagatttttagaactctaaagctaaggggaaccaacttgaaaaccatataaattaaatgatatatgagttgtatttcaactctaaaacataggttccaaatcaaaggcattgatgtttttgtccatcattcaaaatgcttaggagaaacctcaaagaaaatggtcttttgagttttcatttaaaatggccagctgatcaaaattggactcttcagctgtcattctcgttgtttattacatacaaaaatagccaaatttagagattttcaacacgtctactcttaatttatatgcaaacacactcttagtaattatcttagtaatcttagaaattatcctggacaacttgccttatttatttttttgtatgtccaatgacatcacttcactttaataagttgttttgtcattttatttatgtttttgactcaatcttaatattgatgcatttcttaaaataaccctaacaaaaactagataacattagagaattactgttaattatgttatgtgtgaaaatggttttgcatacaaaaattggcctagggtggtggtgcacacctgtaatcccagctactcgagaggctgaggcatgagaatcatttgaacccaggaggtggaggttgcagtgagcccagactgtgccactgcactccagcctgggtgaaagagtgagactttgtctcaaaatttaaaaaaaaaaaaaaaaaaaaaaaaaaagaagaaaaggaaaatggttttgtgattatgtaagaaaatgacctcaattttttgagattcaagctaatgtctttagaaattgctgatgagttgatgagttgagtagtattgatatcataatatccggaatttatttttcaagtgttcagtcctagacagaaagacagagatagtggacagagagaagtaaatatagagctagttagctagacaattagataaggcaaatatggcaaaaagtttacaattgttaatctagttggctggtttatagatggtgatagtactattctttctacttatgcttgaaaatttaaatagcaaaaaaataagtaaaataacaacatatcatatatgaagaagcaccacatctacttaccaaacactaaatccagttatctgatctattaagcactaccttggaaacagcttgacttggtgaaactagggctatatattacctatggagccttccacaagtagcttaatgtaaaatctcaaggtccttatttctaaaatgggaatattaatagtaaatctttgggtagtgttacttctggaactcagaagtgaaaaggagatagtcctagtttcattattagggctatgaaattataaatataattacataaattgaataagaaaatgtatgtaaagtagctagcacattgctagacatttaaaaaacattcagtaaattagatttggtaatagtaggagttcaatagtagtatcagtagtggcagtaacaatagaagttatattagccattttaatagtaataggagcagttttagtagtattaatagcgacactagtaatattagtggctatagttatagtagttttgtgtcttcctctgtaaaatacagctaaaaatagtacgtatctcataggcttgttattaagagtaagtcagttcgcatgtatatttataacaacctttgacacctagttaaccctaattaaatatctgctgttagtagagttggtggtggtagtaatgtttgcagttggatatgacatatttgctatagtatttttgctttctctactctaacaagccaaaagtaaagaagaaacgttttattatttcatggatatagcatatatcagacatatttaataatttttatgtttgtgaaacatattctttaaaggatgcacttctttccaaacatctatatctctccctttactctgaacttgaatggaacaaattatttaaatgacaattatgagctctaagttttatctagaccttttctgtaccatatagaatctttctttgttcactaagattaattcaatttgttaatacagcgtcatcactgagactcatttacattgcagaaatgattttgcagttagtttacgggggaaggtgaaggaagggctgggtatttatatgttggaagtcttttgatttaaacttgggaaacttctaagtggtcaaccacatatacactttggaacatccctgagctttgctatcacaatttccagtatgtgattcaactctcctcatctgaagggaggaattttgtaattgagccaagctgtggcttttagtaaaaatacagtgagcatttgtatctaatttgtggctagaatgtgctgaggcccatgatctttacttgctttgtaagcgttctgccaaccactgaggacctcaacttctcttgaggtatggaaagtgctagtagtatttacaaaaactttaggagtgctttcatacatacacaactatattgggaatgatactttatattttttcttctttccttctgagaagttttattgctacatgttcaccaaatgtagaaccagtgagaataaacattacagttgcttcttactgctttatgcaagtgggcttatcgataaaagagttaattttcaaactagtttaacattaaacttttagagtagtttaaaaatcgtaaaagagttcatggtgaaaaattaataaatataaatttaatataatgtattctaggatataaaacagtttgtgctttttattacatgtgacagtataagaagaatgaccacattattcctatcagaataaaataagtgaatgtataaacagcaccatgtttcaaagagagtttagggaaaaaagatagcaatttcattaagaaagaaagaagattagatacatcacataaatatttttaaaagggcaattatgataccacaatatgtttatttttatattactttctgccctcaattttttgttgtaaagttcaatgaagaaacattttaaattgctaaggtgatttttttgaaaattcaaatctaatgacatggctcattgaaatagtgggagtttagtaacagggttatctttcaattagacaccgaagcaaccaaagtactgagttcatttaatgaataaataccaaaaaagtgctttttacttgtatgcagacattattctttccaaatataactatcattttgtgtcgtaatagtttgaaagattttacttaatacatttatattattgaatatttagtatcaagtgcatttgtattaaggatgtcaagaaacatcaaaacagtctatttaacaaatatgtaatgtttattttattttacaataattattttatattttatttttcctcactaaaaattacttagacatatatgtcaattaacttttatgatagaccaagaaaaactcatatttaccttctctatatatgaatcttattctctgcttacctcaaaaaaaattttaatataagtaataaaataacatcttttacctcctttgttagatgaattctatttagtataagaagttaggccagctgcaaagttgggcacagtcccccaaaccaccctcacttctgacaccaactgcaagttcaaggggttgcaaaaatcaccctcagtttccatgcttcgctagaaggtattcacagaattctcttaaagctgttatatacatgggtacagcttcttacaggagaaggatacaaattaaaattagccaaaggaaaaagcacacagggcagagtcaagaagtacaaaacacagagcttctattatcttctccccgtgcagttaaaatgcattactctgactgctctgatgtgtgacagtatgcttgaagtactgccaaccagcaaagcttaccaagcctttctgtccagagtttttggggggacttcatcaactagacatgattgatggactcattgctcacatggttaatctcagtctctaggttgactgataccacatgaatcgaagaccctactctaagtcaaaatgtcctatttgtggcatgaccaggcccttctctaagactctacaggtgtagttaactcttgcccgaaatcacatggttggattttccagtatgacccaactcctactctatgaccagccccagcttgaagactatagaggtgtggctaacccctactctaaatcatatgattggactatcctgtatgacccaagacttcccaagcaaagaaagatattatagagattaccttctagaagctgagggcaatggcaagacctctctttgggcaaggctaaactctttactacacataggggtgggaaaagttagaagttcagttttcttgtatgttagtgatattgttttctctataaattttcacaccttcccaataacctttctattttcttatgaaaatagtgtatagatatttgaaatatatcattcctggtagtttatctcatagatatggatagcaatagtttttctcaagtcagttattttatctcataacattatcattatcttacctgaaaaaaccatttgaaattactgaaagaatgtctatttaataaaaacactttagattattttaatgtatctattcaatatttgttgaattctcttgtatgtcagatattacattaagtactttgtatgtaataataaataagacctggttctttccttaaggaattacagtctagtggaagaaatcaacagtgacacgattacggtagaaaggaatagttacaatgaaactgtacagagggcaataactaatccagccttacaatttcagatatgggaggggtatccaaaatgtgggttgaacattcatagccaagtaatggaagtgggaggtggggcaatccaggcaatgcaagtgatatatgcaaagttttgacgtgagaacacatagcaaagtataccctattcactgtggctggggcacaggagttaggtgcaggggtaatctgtggaggctgaaggtgtgtgtacttcactctcacacaagaaaagcctcattatttgtttagtaaatgctgtcactgtcatgggttatatgtacttgctaacataattctgaatgtagctgaaaagaagtgaatacatattatcttaagagcagataccaaaattcttgacaatttgacaagttcattcaaacaaggcatatttagcgtgattatttgcttggcactgtgctggacttgagaagacagcgcatacagctgtatacatatataacacagggatacaacatgtctgctaaataaaacagacgtatttcctcacatcaaacttatagtcggccagggagaacaacttcaaccacataatcacaaaagtgtttaactgcatttacgatatgtaatatgacagaagtttcatggtagcataataaaatatagaaagggtacctgcctagtccacagaaaatggaaagacttgctggagaaaatgatttcaactggtattgggtagaggtgaaggtgataggggagggggtattgaggttatgaggggtatgaatcacaattccagaagacaagacaatgtgatgaaccagagactgaagagaacaagatacatttgtggtcctaaaaagagaatgttctgcctggagagcagagtgtgagtgagatggcacactaggtgagctggagcatcagagagagcctagagaatggaatcaagttggctacaataatgctatggcttttgtcccaggaaagggaaattttaaaggtttcagtttatctgcttttatggagacaagtgagttgggcccagctgcatttttaaaaggttattctaggtaaccaatagaggaaagaatagagtggaacagtggtggaagtagtgatcaaataagatgtaggggttcaggtgagagatgtgggtagtttggacaagaggcagtagtgatggaaagaatggataaattcaagaatttatgatgagtttatgagaaagttgaagaaagggaggggttaagaatgtcctagaagttcctggaaagtcagatgactagaaaaaaatgagtatttgaggaaggaaagccaaatgctatcaagaagtcaaataagatgagctgaagcagtgggactcagatgagaattgattgaagagtaagaaatgaagaaatggaaaaactaaaaacagaatagatattgtcagaatccaagtaaaaatcaaacaatcaaacagcttaatatgagaaaataagaattatttatttccaagagaaagaagagaaaagaagagagaagtaagagattggtagtaggagtggctgccaacaagatggcagagcactgggagaggtgaaggttactgggaaattcccagtaaatttacggccaacaggacttttaaaaacagaattatgcagtggatgatacttttcaaggttgatttaccctaccttttttttttttttgatataaccagttccagctccttcagttgttcagtaaactaactttactaggtaagacttcatgctatttggttttctgataaaatagagaaagtgctgaatttctagtctggagctccctggtatgacaaaaataaataaataaataaataaataaataaataacagaccaagaggacagaaggaaaaaaactcccctattgcaggaatttgtagaaatcttgggaactgtttcaatttttgaccaatctatacctcaagggactggaagatctcaatcgacattaaattaagactggctaatatcaaggattaaggtgtgtggccactgatcagttctttatatggagatattaatattctgttccaactaactataccaatatgctctctcagctattattcttaacctcattaatccagcaagggttgcaaacccaaatgttttccaagaactggagggaacatgatatatgaagaggttattggtagaacctatggtgaagcaaaacgttcactccatgtacagtcatgatacatcataggtatctagatatttatcactgaaatagtaaatcaatatttttggttcataggaaaaccaaatgtccatttaaaaattgagttttccaagttttcattctaagaaaatatcttggagataattaacatgaactttgacatgctcctgctaccatacaagctgagtgaccttagttatcttagttaaattacttggattccttaagtctaacttttactgttaatcaaatggatataataagacctatctcatagggcagttgtcaaaaaagaattgaataaaagtgtgtgtatgtgtgtgtgtgcctgtatgtgtgtatgtatgtgtatatgtgtgtgtgtatatatgtgtgtgtgtgtgtgtgtgtgtgtgtgtatgtatgtatgtatgtatatacttgcacagaccaggacccggtatagagtaggcattgaataactattagctatttttggaaattacattgaaatggtgtctcatcatcacaagcaaaatttcctcaagactcaaaaatatgtgttgaacactcttggaggcaatagaatagagcattgaacaaaacaaatactcttgtcctcgcagaacttataatttggcaacagagtacatgttagtggaattgtacattttctcaatttctgcaaacttttagtatctttgtaaaatgaactgtggcacatattaaaactagtcaattagatcagctttgtgaaaccaaatcaatcattcttccaaaccatatagtatttgtttgtactcattgatacttaaaacttattgatacttattagaccttaatatttctctttaagagatatcaatgaaatagtttcatcccttgagtttctctcgatataaccctctgattgtggaaataatagaatgttaaagatatgaaagctaaaaaataccttatcaataaattattcactttatttttcagttgagaaactgaagcctagagcaaggacatagagttagcatgtctaaaacacattctttaagtggtgttcattttgttaggggaaaaaactacctcttggatcttaaatgccacataattggtgaaaaatgtactgatttgaataattgctgtttttgctaacagctggattccaatggggaattactaatccgaaatgcgcagctgaaacatgctggaagatacacatgcactgcccagacaattgtggacaattcttcagcttcagctgaccttgtagtgagaggtaagagtttcaacattttaaaattacaaaaccaaaagtatttgacttgcataaacatgtataatcttctggtaactctggtgcaaattcttacatatttagagtctcaatcccatgcttaagaatggatcttaagcttcttcccatgcctaagaatgatctatgccagacaagtagtaaacaacactgattttgtttgttttactaactacgtatcttctagaaagttacaccacatatctcctactaaatgtttgtgctttgtagacttaccaaaagttctcgtttcctgctaatactttttagtgtgttgtgtatagtgctgtttccttttttatttctatggaaaagatatatactgatgctgtttactataacctcaactgttatatatttatcacttttgtcttagagtgtaaagttaatttatacatgtatcatgtttttatttgttgctggttttttcaaattagtgttttcgttcttatgaataatataattgagattgtgatggaatatacatttattaaaaatgcaacccctttgctactggccgctgccatagcagtgaggctggctgggaacacagcacaccttgtttaaaataaagagctggctcttcactgactgccctttagttttgcacccaagaagtaccatgtgttgaccccagcttgcttacctttaatatctcacttcatgtaaccaactccaaccatctaactaatccacaaaaatacactttaacttccatgtcagttgctttattcacagtattccttccatgtctttttctcatgatttgttgaccaaatcttattcatccttcaagtcttaaagtatatactaagttcatgaatccttctcttgatgtccccaatatgagctccgatcttctgaattttcataacatatattgctttctctcatatgttttatagcagttggtacacagttatctactctcctaagttgtaaaattcatatatgttttttttttagtgaatggcagagttcctttgcattgtttcgtagctctctctttctgtctcagtgtcagttaaaattactattttttcacatttcacctactaaaaatatttattgaacattaattgtacattttgcctttacttttcacactatcagataaattggcaataaaatgatatttgtggcttgtttattttaattctccttccacatctgggtcaatataattttactcaatctcatgcagctcctgcatttccctctagagcaatgttaatatggggtccctaagcaacactgggcaaatgctgaaaactcttctactccatttgaatatattctccaatagagttttaagaagtctagttgaagtttcttcatctgaatgaacttggaaatacattccacaaaccacttattgaataataacaaataaaaatgagactacaaaatcctaagtcaaacaaaattcatttaggttcagtattttcatttattttgttatctgggacattgattgttttcaagaattattagggagagggattagagggattagttcaccattcttcctagtcagaccactagctgttaagtcatttccagaagtagccaaagtgtatatttaattgaaattgcttgcatatgaaaataattagcattaatattgcaataggagttatgttacagtgtgtggacataaatgtcttcatatgattacattgtagtaaactcatagtactattaccatagaatactctgtaatattcagagtgaagaggaattttacagatgaaatgcaagggtagtcatgatactagccacacatacttaggtaattaattatcaccactatatgtatttttatagagaatcaataaaaagaagctatagccaatattatgtagaaataaaaacgtatacagcattttaagtccttgcactatagtaggatgctaataaaaccatacaggtacatgaaaatactgcttacctctgttaaagtcagcagagtcataaccattcttcaaactttatttctaataatagaaaaagtatccatttcatatcaaaagaaatttgcaattaaaatagtcaaatatatttgactattgcagaacttgtgtcaaaaacatgtatagatgttctaatatgctttatatatttaaaccagaaggtagacaattaaacagttgtttttattttttaataataatggtgagcaatgtataagacatgccctgccttaagtgatattattattggtctatttattcatttaattatacttttgtatctagttcaggaaatcataacctggagtctatgaacaggctttaagggatccatggaccaccagaaattgtacataaaattctacgtgtatgtacattttcctgggaaaatgatttgtaattttcataagattttcgtagccagcaatgtcccacaaggcattaaaaagctaatctattttttatttccccatctagatcaagactctctaataaaataaattgaagagatgattattcactttatgcaaaagaataaaatactaatacatttcatgtagttaaatctaatagcacatttagattgtgaattgcttttaaaagattcgatttgcactcaacccttcaaaattacatgtttgtaaaaaatattaaatatgttatgtagtagacagtagaaatctataagaactttccatatttgagatggactaattttaatccatattcagatattggtaatctgaactgcagctgctgaaattagtggtgcaatgagaaggacagtaaacacagtagaggggaaagcaatttcatctgaggatcgctaaaaaattttttataacaaaattatttctgtgtataaatgattatgccttatcagagaagactgaaacaaaagtataaatatttagacataattaagattgtggatttcttttagcctacatcacactgaaggaaatgaatacatagtaagaacagtgttgctgccctaatcaacatgtgtgtgtgcgtgtgtgtgcatgtgtgcacgcatttgtaattgtgggtggaaaagggtgagtatatgcatacagcatgatgaaagcaatttctatcagaaaagaagtgtgttttaatttattccttgcctttttattgtatattgagcttagaatgtaagcagtcaagtagttaaatctgaatgcctctaaatataaaactaaaattaaatgtaggaaaaatatagtcaatggaaaatgtagcattggatctgatttcatggggccttttactgagagaaaacactcccgctgtgagttttttgtgtcatgtatggtaggatttagaaatgaagaaagcagtggcaattgtcgccaaagaaaaacaatctgtagaaaatgtccccgataataagatatgaactattgtaattctgtaaaagcataaatgtgtacttatagaaagctatagcactttaatttatttaccatataactgggtccaaagatgcttgaggaaaagaggccagtaaagttgcatgcattgtctaatcctccagctctgcaaacaacttcaaatcatgagattgtattgaccatgtaattttcacttttcttttccaaagttggcttttatatgagttatatctgttaactttggcaacatttctgttagtctttctatagtatagagattatttttgcaagagtaacatttcttcaaatgctgttgtccaggaggtctaacatataaaatcgaagatgaagataaataaataaacatttgtgtcgtcacaaccctggcaaaagcagattatctactctgaaataggacaccttcaaccagccccctaaggattctaacaaatttagataaataaaatatgaatctatataaaaaatgaaaattgatggccaggtgtggtggctcacaactgtaatcccagcactttgggaggccaaggagtgcgtattgctttgagaccagcctgagcaacatggcaaaaaacccgtctctaccaaaaatacaaaaataagctaggcatggtggcaagagattaaaatgctatgcttgatatgatgacatttaaataacttatagaagattttagtgaaagtttatttttttcctatgaagaacacatattgacctcaattttccaattttccaaataatattgttggtgaaaggagtaatttcagaatcacccctttaagacaggggtttgtataatatacctgaaggaatttagaacttaaatcactatagattacttaatatttaagaggccttaaatatgttgcgttatgtttaaaatgtttaaaatatttatattttaaaatgttaatattaatatttaaaatgttaatatttaaaggtcttaaatatgttgccttatattgccttagctttaaaataagaaccaggtattacacttcagatgtttttaggcttctggtataaaagtctacattaagagtattgatacaaatttcctctgttgttgcaataaaatttttatttcttaggtcccataaaagtatatttcgggttgcctcgtcaaagtaagtgtctgatgcttgtgaacagccctgtatgaatattttttagcaaacaacatttctaaagctcttcagctaaaagagtgtcatttagaggcaagagttttgcaggatttatacagcaagatttattttggaaacctatgtgcagcttgccaaatctaaattctcattcatgagtgcacctttggacaacattcaaaaatagaccataaaattaggccccaaatgaaaaagaaattaggctttaacttgtacatgtattaccactttctctggtatttctgatgtattataaatattttggcaatgcttctggctaaggaacactttcctgccacctgggtgaacaaaacatgtttgccactgaaattgccaaaatagaaaatgcaattaagattatatcttatatactatatatttgtttacatcttatgtgttacattaaatgacgtttgttcactcaaatctgagtttaaaaacaaacaaaagaaaaagaaaacgactttgctatctaaactttttcttttggcctggttctcaactctaacatatgctgtatagaattttaaaatgttttggaaaaagagtagctgaaactaaagcaaatgatatgaaaactctgtaaatcattttctcctcaaaagaagtttgtgttgtttacattattacattagaagcttatttatttaaccttacgtggacttgtatttaggtgaaaacaccgtgtaagtgagtgtgtgtgtgtgtgtgtgtgtgtgtgtgtgtgtgcatgcagctttccactttatttctaaggaaaaaatacagttacagaatggagagagatattagttagaggtcatctttattgatataccctgttaaggtttttattgcttagcctaatgacgtggttaccagattttttcttaagaaggctatttagttgattactaaaccacttttaaactcttggataagttaaagtaacacggtcgaacaaataaataagccaataagcctgatggaagctgtcagtatacgttttagctggaataatattgcagtattttaaagtactataatagttgcctaaaggtcttttctatggaaaatgctcttgggtattttactcccagctggtttacattagcagagttaatatccagagtatcccactcttcactgtccagacaaaattagttctgaagcatttacttggagatgatggtccaggaaaattagtattctttttttgtaagaaatatggaatagataaacattttctttctctaagataaaagtgttctaatggtcctattattggcaaatcatgtgttagttacgtcttttctccttcccactttttcacagtaactatatgaaatctctgcatttatgttcaaatttgaaaatacaattttaaatgtagaactaatcctatgggttatctagaaagttcctaccccttcatttaacaacttggactctgagagaaagagttcctcccctgtattttccatctacatggtggcaaacaataatcttgggaccccagtccagtcttctcattgtactagactttctccagaaagtatggataaataaaatctatagttaatttctaaaactcactataccagaaagattatcaagtctattctggagctggtaggacaaattcttttactaatttttactaaatagtaaaagttattgatttcagtttctgctcttttctctttctgttcctactatctggcatatgctaatacaaaatatataatttttaaaacattgtaggaaaaataaagccaaagacatgcattataaacagatgtaatcattaattcttggattatttagggttctatttgcatgactagctcagggaccttggatattagtgagggccacaggaccgcatgttgccatgtgaaaagtttgtgtaactcttggtgctaaatcagattttaagcttctgtggtatctggcataaatgttcacattgtgttcaagaatccttacattcaacatattcttaaataagcaaatatggctttatgtttgaaattattattaaggtatggcaggccaaaataaattaaaaaggacttttaaattaagcaatttaagtattatgtagttgagaagaatagacataaaagttctatataatatacacaccaagttaaacaggcgtgtaagtatacacacctcatcacaccacacacacacacacacacacacacacacacacacacacacgcacgcattggaagagatccaggaaagagacgatcatataaaggcagaaagatctgggtccaaatcatcacagtcaaatcaaagagaatggttgaggtagtttttcaagtatttggggcagaaaaacacacatttacctcagatatttggataattgcctccactttccacttgctctggccaacgaagtcttgccacagagacagactagagattccatctcatcagccttgcagaactgagacaggaaaatggtccttgctgcccacactggctggaacaatgacaactgggcgccattctgagccatcctgaccccactctgcactaaccacagcaatgcatccattgatagcaaaacctgcctagaaattaagccttccccttcccactgagaatcaacaaattcagatcaaagaaatacgactgggctggttctccataattgtaatacacaaaagctaaaatattgagctgaaatgcatatttggttataacaaatgcagaatttagaaaatttaaagtcagaacttagtggttatttaaacaaaaactctagtaaaaatgacagctttcccaattacttctggaattttaaagtacatcaataatttgaaattgtatttttcaatgcaagttcagcgtaaattgaggtacactcaagaattttttcaaatatggccacaaaataggtaattcactcagaatgattcacattattttaaattttaagataggtcttgaaaattatctagatgaacacttcatcttacaaattcaaaacttaaaatataaggataagaagatactatgttatgcgctaatataaatttagatttttctttccctccacactagagtacagtgagaaaagctcccgtggaggatttcttcttttctgcaattaattactcccgggtctcttataatcaaactggtcagcttttggcaaactggaatttctttttttgctgcacatttagtgtgtacccatggctcccttaaaaaataatcggccaggggaggcagaggcaggagaattgcttgaacccagggggcggaggttgcagtgagctaagatcatgccactgtactccagcctgggcagtagagcgagactccatctcatctcaaataataataattataataataataatcagcctggtgcagtggctcatggctgtaatcccagcactttgggaggccaaggcgggtggatcaggaggtcaggagttcgagaccaacctgaccaatatggtgaaaccccatctctactaaaaataaaaaaattattgggtgtggtggcacatgcctgtagtcccccctgcttgggaggctgagacaggagaatcacttgaacccaggaggtggaggttgcagtaagccgagatcgtgccactgcactctagcctgggcgacagagtgagactgtctcaaaaaaacaaaacaaaacaaacaaacaaacaaaaaataacccttctaccactcagtttgattccagggagacagtaggaaagctttacagaacttagcaggccttgggagcttttagacactgcatgcatttcagtgctccatagtgattcatacatccatgcgtatttaccagataattatgccaaattaggctacaattatgccaataatgtcaaagttcaagagcaatacagataatcagagatacctacaagtctcgaagaatatgaataaatggcaattagttcatattttgaaagtaattgtgatgtatgttggtaaaatactacatttttccaactcaaatctttaggctgtgaaaaggtatttatataaaatgatgaatataaaatgaaaataaagatatataattatataatttaatatataatgacagaatgtaactacatagcatgttataataaaatatatattatatgtcatataacatgtattgattatatcataaaatgatatataacatttattaaagacattgtttaccagatttaattttaaaggacaggtatcgttactgtattatattcattttacacatgagaaaattgaatctaatgaggctaagttaatcactaaaggtcacaaagctactaagtggaagaacaaggtttgaatgcagacagtctaatttcaggtagaacacccagctcatggctgtagcacactataactaaaacttaattcaaatatattcaatgtgataaaataatcagtgtggaaaagctaagctgctggccttttactttcttggcaataaatgtttattctatagagtgtcactgatactgatcttgctattttatttttgctcatgttatatttatggctggcctattacaagggaaactatagtagttatttttttttcagctactcaactttacacagttataattacaatagcaaaaccaataaatgaattgtactagatggcttgaaagcttgattttataatgtgctctttggcctaaaaataggtaaatgaaattttgatgtgtgttttcctgctttttaaaataatgtataattcatacagttaaaaatagttcattcagaatatttaaatatcttagattataatgtctacacttataggattttcctataaattttaccacgtcatcctacaaaattgctgtgaggtggtagtacaaggactgttattcccatttcataggcaaaggaagtttaaaaaagaaaaaaaatatattttcaactatcagttataaagccagaatgtggccagatactagtgttccaaattcaactacatgaatatgcttttcccttcttgatgtttaatgttcccaaagacagaagtcagaccatataattttgtattgtgcatctctatcattgttggtacatggtttgtcaaattaattaggtaattccctcaaaacactctgagttattgataattccaagttaagttagagagtagagtaacattttagctcgtttaaaattagaatttcattaatagtttcccttttcagctcattttactaaataagacaaaaacaccttagcctcattgctgaaaatataaccaagaaaaaacttaacgacgtaaaatccctttcgagcagttttattacctatgatttttgtgcagtctgccatttccagtctcgtgactatgcagtgctttcttgagggagccttttgtgggcttgctttccacccagtttctggaaatttaatttggtcacaaaagtttgggcatattagaatgaaggaaactcagaaaaagcttttaccctctaaactcatcatcggtttatgaagctacagagagattttagtgcttttgaattcctacaatagcttctccaactctaattgtcactactgggattaaatgaaacatacacagagagagaaagaaatgtttaagtattctgcaactgacgcttagctaggataccccattagatcagagcagcaaggcacagttctaaatcttttctctgccagagtgcttttccatcatcatgtttaactgtacactatactctcataactgattgcagattttggcataaatccaaaaaaacctttttcccctaaaaagcacaacactattttaattgttatttgcttaatgccagctaacagtgatgatcattgtgtggacatgggaagacataagggagtggctgaggttcatgtgcattttccagggcacccctgaagagccaacaccttcacctaaaagtgcattgggatgcaagtgagtgagagttagcatgctaccaggataactttgaatccactttatcctttgggaaaaaaatgcagaaacttctgaattctcaatcttattagtagcaaattacttgtgacacaccagagtgtagagatcccttgtgtaattattcccagaatggtctaacgtccgtcactctgaagaacccacttctgagcatctgcttcctgcactcttagcgactctcaataatgagagcttgaccccgcccctccttcacacattcctgagaatttctcgagaagaaaggaactgttactgatagaaatatgtcagatcccgctgatgtgtagggtctaagcaacttggaggaccactatttgatatctttctacattgtctggtagatacagtgactaattcaaggaaatggcacccctctctggaggagtttaggaaggctcccttggtgactgttcacagcacccccttttcagacttaaaatctcaaatcacagataagcaaactctggtaaaataccaaaaactacccaaactgcgttcaaaagaaaaaaaaaagaatatatctaaaattaggattttcagttctcatcaaaaggatttaaaattttatatgcttaaaatgtcaaatgtcttacgaccttttttttactatttaccgtaaggactgaatttacaacaagcagtcagcataggcaagttttcctagtttccgtttcttctatttaaatagctatctccagggggcagtagtggctataaaatggtataattctaataataactatccttagttatgcgtaggggaatgaggtaggtgatcactctgttaattacatggttttctataacaatattgctgtattaatatacacatactgttgttaaatgattacatggttttctataacaatatttctgtattaatatacacatactgctgttaaatgatttgcatggtgtgatctaaaagctgtggcctttggtattaggtaaatcgattagatatccactttgcctacctaacctatggtcttaggctagtctattaatcactgtaagcctcaagttccatatttatgaaagagaatatgagtagttacagtccatacattgttcatggcaactttttataaacattgtcctttacttccttccctttactatgaatgtatatatcgacataagaaataaataaaatataactcaagacacagttctcacaaaacagccttaaccgttgattaactttttcaaaccattgcttcaatctatccttattacttttattcttagaagtcttcaaggcataaccatatgtttcagtagatagacttgcactctgtggaatgaaatttacaaaggatccacgagatttgtttcatttatttgttttttgaggagagacttcagttacaacgcttgctccttagaaagtcagtcactgtgtatgagggaaaggttttaattgggccacagcttgtggcatcggtcttctccctttggccccccgtcctcagtgtgtaggggaagatacctttctgtgtttattctttcaccttacccatcaaggaaatagggcaaatcccccaagtgcatggcttcctgcccctaattgggcatccacactctcccttcagccttgatctttcctcttgcaggtaaaaacagaaaaggtggagagaaaaacatggtggattcctttctccccgtctgtgcaagcctgcctccaacctggtgatcgttgacactcaccatttctgtgaaagacttttttttttttaacatattatactagatttgactaactcaatcttgtagcttctgcagttctccccacccccaacctagttcttagagtatgtttccccttttgaaacatgtaaacatactttgggcataaatattttttaaaatataactataatgcttcactaataccttaaaaatgcctagtgaactaactcagtacattatataatggccaagtgaaagttttgtgttttcatgtcctgtttttctttgaaattatatagcccagaaattagctcattatctgaaaaacgtatgaagaactgatgaattgtataatacaggagtattgccattgaatgtactgtttgatttattcaagcaggtaatgaacaatgttgtcaaactctctaatgagacatcataattaggacataagctaaaaggggcattactccggcagtctttttttcttaatcctagtaccatacatattctttggcatgaaagaatgaaaagcattagtaaacaactgaagtcctaccatggctctgtagggtttttggaacaattcctggaattggaaagtgaaaatggatagcatgtgggggaaaccctcatctgagtagcaagattttagtaaagatgactaagccattaacagcatgcattcatatttaattttattgactcctgccatcagcttttgtagatcgtttgggtggaaggttgtgatttttactgggaggacttgagtagaagtggatgattaaaattgaggagtatataattctttctgggactgcttaaatgttattgtttgaaaataccttcactttccccctttggtcaaagagatgtgcttaaaattcttattccttcacaataaataattttgattttcttagacaggtttgtgtttaggtatgagtttctcttttacttcatctagcaattctctctgtggtcagaagaactctgaagaaagctttgagggaaatgaatataactcttaaattattatatgtgtgtgtatatatatagtttaactttaaaaataatttattagtcatcataaagaaataaatgtctctggctcaagatgttacttatttccttcttttatattttctagtctcaattactgttccaaaaggagctatcttagaacttagactagagatccagattaattgccatttttgtaagatgtttaaaatcaatttgagaattttcatgtgtctgtaaacagcaccatggagacatgtatgaatcgtattaagggcatctttccatgtagtccatactgaaattatacaaccaagaccagataggaatattttttattttattttattattacacttcaagttttagggtacatgtgcacaatgtgcaggttagttacatatgtatacatgtgccatgctggtgtgctgcacccattaactcatcatttagcattaagtattttgttttttaaagaaataataaaaattctaaaggaaatcataggacagatgtgacttgtaccagaaagggaaggacaaccttaaactatatcaatatcaagtagaagaattatacaggttcatttatcttcctttagtcttgttcttatttctaactgggatctaaatttacctttatcaatatcagaggttaagaaaattaccatattcctattaaatggtagagatatttaataagattcagcttcatcttagtacaacttcaaacatcaacatgatcagaaaacattgatttatattttaaaataggatattggagccattgtcttagataattttcaaggcaagaacaagcctgcaataaataatgagactttgacattccttggcgaagaagatgtctcctgccctaatatgactgtcactcagcaatttcaattttatgtttacttgatttaaaaagggaggataaattgttctgaaaagttttttgtttccttaacatttcaaagttttcactgaaatttgttgttttggtaaaaataaacagttaactacagaatatttttacgtggtgctttgcttttaattacttactagggaattaccagtggaaaaaagaatgtcaccagtgtttttcctacttacaccagttctgcagcatgaatatttatattaaatgtatgtgctatatgaattccccaaagggtcagtagttttggggggtttatttccaactatagttgtttagaaagccagtgtttaagagggagagagcaggttagggctactatctaagtagtggcaccaactcaaatgatacgtggggtgtagtcacagctactttacatcctgtttataaattgagacacgaggatcttaatttctagtcttctatccaatttgatttatcaaaaaaatgaatcttgattattgattaagaaaatatggtcagcttactatgtgtgaatggtcatttggaaaatttatatattgttttctcactatctttcctcaaatgtctaaattcctcttcattgaatgttactacatttttaaagcagaaatgacagaactgattaactatatttctcctcatttttaaaaattagtttacatatgaatgaaaactgagtaaaaatcaaatctatattttgttcatacataggtatgtttttctaaaaacattagtaaaatccaggaaagattaccaaatatatttatagcaatcaataaagagtgggaatgtattgaatatgaatttataaatggatgatgtgtttatctttacttatctgagttaacactgaaacaaagatttaaaaaggcatgattggccaggcatgatggtacacaccagcactttgggagactgagatgggatcacataagcccaggagctcaaggccagcccaggcaacgtggtgaaacctcatctccataaaaataaaaaataaaaataaaaaataaaaaaaagctatgatcagtatgttacagtttttgtcatattttccaaaatattcacttgtatacaagtaattcatattcttcccaaaaagaaaagtcagcaacggaaacctaataacatttttgaatgtgatactgacaatgctgttttaaaaatattgtttttaggatagttgttgaaaatttggtctcatgacaaattgattaggctcagattctaactttgacatttacttgctgggtgaacgtggccattttatttaacctattcctgtctgtttcctcacctgtaaaataggaaaaataatagcacttacatcatagggttattggtaagaattataaaagatttggcagtgacttcaatataagtactcagaaaaaagcataatttttattaaaatgtacagtataaatttcccctttttgaatgactaataattttataccatgtaaattttatattgttagcagttcaagtccaaagagaacaatagtgtagacttgttgtcatccaggtaattacttggaagtcttttgcagacaggcacatttaagctgtataatctaaatttgaaaatagatgttttctcattttgagcgtgttataccagaaaaccctgtctttgatcccatctctgtactctgtcactgattagctatgtatctctgacaacagcccttatagacttcggtgtccttttgtaaaatggattatatatatatatatatatatatatatatatatatatatatatatgttttagtggactcttaaatgtatgtgatctaccttaaatattgaaatgtttctattatttgtctgtagtgcatgatttaattgtaaaaatgttgaaaacataaatttagagaaagagagtaggggtgtggcaaatgagactctgcattgaaccatgaatgacagaatgacaggagatcattcaggccgtttccccagtcctttactaggttaaaaagtgacagaaacaggtctcagtagctgttcgtaaacttgtttttagtcaactttgaagaacccccaaggtaagaaacataacactaacaaggactttgatagatcattatttttgtatgccccataggtgaaattttatggaacattctcagtcagcattctctaagaggaatttttaaagtgagagtgaaagaatataatgggtgcaaaacaagaatagtaagagagggggtcatgcaaataggaaagaaagaatagtccatagaggcagccaccatctgaagtacagaaaggtagcccaaagaagggtagcaatttgaacactatgattttgaatgggaaaataagaatcaaaaaaatcaacactgaagtttgtcctgccaactgcaatgaaagaggaattcaatcagctggataggctgagcacaattagtggtatccactcttgatgacatcctgtgagcatttgaaagaatcaggaaacagaaatagcataaatagtagggatatgatatatgagcgtaataaaatgtatttcaaaaactcgagagcatgggtagggggaggtggtgacaagagaggagtgaagataaaactgtatttataaaagcataaaacaaaaagcatgctttaaataactttttattccctcctccatattgttctttttctcctctttcacctctttctaactccccaatattaatgttagtgagaaaaatggataaaaagactttgccaggtctagtcagaaatatatttcagttctttttcccctaacttcagatctttaataattacagccaaagaaagaaaaaagaaaaacagaagacaaatttgtcatctaatgtatctaggcatttaaaatcaggtcagattccaacagtctttttcaactgaccaatttctctcttttatgttaactttggggtaaacagttctcagaatccttagctatctggctgagaacagcctaagaaactggaaggagatatcagtaaagtaatagtgaaataagctgcatgcatcaggccatttgcttacattttccctggtttcctgaaggatttattgagagcgcatggtaatggaaactaaaaaaagaaaaaaaaaaaagaaagaaagaactcagggttagaattatgtatggttgggtttttttcattgacaaaagaatcagaagagtggtcagttcttaaatgccttcctttgtgctgagaacaaagtagttttgtcattttattttctacctcaacacttttctgtccattctaaacaaaaaaaataagcaagtaacatcagcctacactgcttgaaaaccttcctgctgagagacactgcagggctggccctgggttgaagtccgaccgtccacgtttgtctccgtgctctattttttgccacaaactgattccttaatacacagagtatcttcacattcccaaattttcctcacctacatcaaaattactggaaaacattttactttctatgttgtcctataaaccaaagagtatctgagacaagtctcaagaaagtttattttgccaaggttatgaatgcacctgtgacacagcctcaggaggtcctgacgacctgttcccgaggttgctgggatacagcttggttttatgtattttagggggacatgagatatcaatcaacacatgtaagatgtacattggttccatctgggaaggtgggacaactcaaaatggggggcttccagatcagaggtagatttaaggattttctgattggcaattggttgaaagagttattaccaatagaaaagaatgtctgtattaccatacagacttgtgggtggcggaaatcaaggttttctcccgcagatgaagccttcaggtagcaagcttcagaaaatagattgtaaatgcttcttattagacttaagaagtctgttctatcaataattcccaaagggaggagggtgtaatgaggcatgtctggctgccccttcccatcacttcctgaactagtttttcaggttacttttggactgcccttgccaagaaaagggttcctttcagatggctggggggcttagaattttatttttggtttactgtccctgctttcttttaagtaataagtggtaaatgaatactctgtaaacagatccctggaatgactgacaaagtactaattaataactcctgccaggtagctaagatgctcagaaatcttttaaagaagtaatgacaataataatattgttaatagataaggtttcctgatggctttctatgtaccaggctgagaactacattctttaaggacattatttcagtcctaacaatcatctgttttgttttgttttgttttgttttgttttgttttgttttgttttgttttgttttgaaaaggagtctcactctgtcacccaggctggagtgcagtggcgcaatcttggctcgctgcaacctctgcctcccaggttcaagcaattctcctgtctcagcctcctgaatagctgggattattaggtgtgtactgccatgccagctgatttttgtatttttcgtagagatccggtttcactatgttggccaggctgttcttgaactcctgacctcaggtaatccacctgccttggcctccaaagtgctgggattatagacgtgagttaccacacctggcctaaaaacaatcctatatgttcggtttttattactcttgttttacagatgagtaaacaggaacttaacgattttaagaaacttgcccaagataaatcagggcacagaactgaaagctgagtctatcttaattctaaaatccctgttttttaatacaattatgattttaatagtattatttttctcaggcatttttggggagatatttgtaggcaattactagatggaaaaatctacttcatatcagtggaaccattaccgagtaaaattcccacaccagggttttgaagataccaacacaaccctttccatttgtcttctcgattccacctcttcatgatgatatagtatttcaagacaattggaaaaatgaagactgtattgtggatgacaattatgtttacagaactgcctgaacattaattataataaatttatttatctatacaccaaatatttatgaagaacctaccataagccagacatgtatccgagaaaacaatggacaagtataattatagtgttttgctcaacaatattacccttaaatgagtggatgactgaattattatgcatataatgtctcaacaaatacactaataatatgcagctttattctgacctttatgaaatattactcatttgacacctcaagaacatcagagaataacagcagggaaatgatttacattttaatggttaatgactaacctatgataattttgtcttaaattccctttaacgttttctgaatgccatacccctatgctcagaaaaagtaactgaatgcatgcattacagggctttttcttcatttgagaaattcttttattattcacctctaattttttattttaacactctgaaatattctacttagtaattgacttaggatgctgcattatgtgaagtaatgaacttcttggttctgatcaagaatgtacactgtatttcaatgtgttttcttacatatgaaaaatgcaatatgttctctctgaatatcaaatgtgttctgttatgtgtctattttcaattatttaacattaagaagtctaagtatactattataggttacaaatttataaaagttcgcttgcttttcttatatgtgatatatttccaaataataaaatttactgtcatggatagggtatgtgtcttgtgttattttaacattggtggtgatgtgtttttgttgatctgcacacactttctttcttgggaccactttaaggaaatgggtgaaggtttggggtgttggccatacctctgcaaataccaatgttcttataaagaaaaaggccatctaagctaagcaacccaactgatatataaatataaaggtatatatttcagctgaaagataaagacaaatgtcctctttagtattacattaattatgaaaaatgatggtgctacttaataaaaattattaattattatattaaatatgcctaaatcaattgggggtggactcctttctggtgcaaatagaacaagtgatatgtatgtttagttataaacattctgaaatgtctatactaggagctgtctattaactgagagacttctttagcttttgaagtgatagatgccacttcaccacttaaaggacatttttctcttatttttatttgtcttatttgaagacaaaaagctcttcaaagcccaaaaagttgtgtctcacttatcttttaatttctatttcccagcacagtgcactgttgaaaggaaaaaggaatcatattggtactgagttatgaagcatctatgaaaacctatttttaacattgttttttgttctgccagaacaattcttctaagactcttcaatataatttgaggttttaagagcattcctggtatatctctgaattgacaattattttctatatattatataagtagaaacatttttaatattacttattcttatgactataactaacatgaaatgtattatgcaaaatgatacatgaaattattcccagaaatttccacttcaagtaaaatgaattacctataacatttagagttataagaaagtatgtgggccagtgcggtggttcacacctgtagtcccaacactttggaatgcctaggcatgaggatcacttgagcccagaacttggagaccagcctggacaacacggtgaaacccagtctctgcaaaagagtacacacatgcacacaaaaattagttgggtgttgtggagtgcttgtagtcccagctacttgggcggctgagctgggaggatctcttgagctggggaggcagggagaggctgcagtgagccatgatcatccccactgcactccagcctgggtgacagagtgagaccctaactcaaaaaaaaaaaaaaaagccacaaagaacaaagaggatgtgttcagttctggggaggcagaatgacaatagaccaaatgttcccatatctaaactgaattgtgctaccatctgattcatgcattcagcaagaattcattaaatcatgctatgctacaatctgttaggtccccttggtgccaattgcatataatgagtcagagattactatatctgcataacaatgtcatttttaaatgatagcatttatccccttccttaaaaagagatacatgaaatcattcagtgaaaactacaaatgatatcacttcttataatctatatttaaaagaaatgcagacacactgattatattggacaaatgttctttagattaatggttagaagacatttttatattctaatgtgtgtttgactcactagatggaattcactgattcattacccacattttcatttcaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacaggtgagttttatttgtctgattaatccgtgcatgttttcaaagtgaattcttttctcaaaaacaaaaatttggaggttttaaaaatgtcattatctaccttgaaaggctttctttcttaaattttttaaaatgtattctaatattttggtaatgaagaaaattacatagaatttacacatttaaatgtgttaaagctatagaaaaagaagtatcatttctaaatcaatatataatggaaagcaaaatgaggcctcctgggtttcttacttgagttttgtgtgagatttactgccccaaaatcatcgggaagtctatttttgagcaaatagcatttatagcatagtatttatgaccctttttatttgggtatatatgtactatagttctgaatttctaaaaaaccacattgatcataaatcttaaattaagcatccaaatcttactactataaccctttatgtgaatgatctcacccggtttgaatttcctcaaaacagatttttaaagacattttggatctttcaacctttttcttttcttatattaagattttctaaagttgatcgggaaaaattaactaagaataagtgggtactttcctttgtctacaactttgccatttgtcatgactagcctacaatatcacacattaatacatatattttctcctgtaaaatggaagattgaagacctttttgataaaataacctgtttatctttgtaacttttgacaatatttttaaacaaacttgtcattgccagaattctttaagatggaaaagaggagacatagaaatattttcccagttgtcacaagaggagaaatgagacacgagtgtgtgaataaaatgttcctcctttttaaaaaactaaaaaaaaaaaaaatactctaatctcccaaatctgctttcattttagatttatcttaacataatggaaatcccatttccaaaatgcctatatttgtattgctcactaagatattttaatttaaatttacttctatttgatacttctctccctccagggaaataaatcaaatataaacttgaggtctgttgcaaggatttaggatatattttaatatcagatgattccccacctaagtgtataaagttgcaataaattagaaataggtgaaatatttccattacattatgcttattgttttaagaattatctgtaaatattcttgacaaaatcagatcatctgaaaaataattttaaaaaccttttagatactttataaacctaaagcatgggcagtttctacttttctgaagagaatggaaaagtatgataataatgaaactattagaaatctagccacattaaaataagtaaatggtttaaatttggtttggccctgaaaaaagaaatactaattgcaatcattttcattatttatgtatgcttactatgtagctcaatttaaatatgcttcttattttaaaatatccactagaaagtaagttccatgaaggtaaaaactgttttattcactgttctatctctagcacctatatcagggcccacagtgctcattcattaaacatgtttattgagtccccactgtgtgccagaacctattctagatgcagtatgtataggtgagtagcagtgaacataataacaacaataaaacctgtcttcaaggagcttatattatagtagaagagatgccaatacagaattaaaatatatagtaagtcatgtggtgatgaatgctagagagaaacaacagaaaagaggaatggggaagtaggagatgtgttttaaatagggtatttctcatattctcactcataggtgggaattgaataatgagaacacttggacacagggtggggaacatcacacaccggggcctgtcttggggtggggggaggggggaggatagcattaggagatatacctaatgtaaatgatgagttaatgggtgcagtaaaccaacatggcacatgtatacatatgtaacaaacctgcacattgtgcacatgtaccctagaacttaaagtataataaaataaataaataagtaaatagggtacttctgatattagtaatagccactgctgctttctgaaagttcctatttccattatatatcttttccaattcttctactttcattgaatttgggtctttgaatctaaagtatgttttctgttggccacatatagttggatttttcatccagtttgatagtctctgccttttgattgaattaatcaattaacatttaatgttattattgatacagttggattgtagctgcattgtatttttgctttctaaatattttactatttttgttcctcttttccttgttcactgctttcttttggaagaagtgagcattttctagtgtaacattttaattcctttgatgatattcaccgtgtgtgtgtgtgtgtgtgtgtgtgagtgtatgtgtgtatgtgtgtatatgtataatcctgctctgaagggaagtttatattcactatacatgtgtatattcaaacacatacatacttaatgaatactctagggcttaccagatacatttgaatttatcagaataggttttataattttattagcttaaattttcagtgaatatgaaagtgtttctcctacatagttctatttcattcttcctcttttgtgctattacagtactatatatatatactatatattatattactatatattaatagcatatatagtaatatagttatatattactataatactgtatattaatattttgttatatatgctattatagcatattttattatatgctattatagcatattttattttatgctattatagcatattttattatatgctattatagcatattttattatatgctatgtcatatatagtaatatatatattgctataatagcatataatatatgatattaatatttagtaatatattattaaatatattactcacacacagaggattaaatatattacgcacaaaagaggaagatgaaataaagctatctaggggaaacacttttatactcagtgaaatatatataaatatatatattacatctctatatgtcacaaacccaataatcttatattaatattatcactttctataaatgtttgcctattaaaccaatatgtttatattatcctttgttaatttgtctgttatattatcctttatatttactacttctaatcctcctcacttgttcatgttgatttgaatttcatctgtctaagtctattttgcattgctataaagaaatatctgaggccgggtgattttgaaagaaaagagttttatttggctcacagttctgcaggatatacaagaatcatagtgccagcatctgctccttgtgagggcttcaggaagctttcattcatggtgaaagcaaattggcttgtcacatggtgagagagggagcaacaaagagagaagcaaggtgctaggctcttcgtaacaatcagttcttgcatgagctaataaagcaagaactcactcattattggaagaaaggcacaaagtcattcattgggaatccacccccatgacccaaactcctcttattaggccccacctccaatattggggatcaaatttcaacatgagatttagagtggacaaatataccaactatgtatcaccatctgatatgatttctttacaactttgctcctacctgtcccctttgtgcagctagtatcaaatatattacatttaaatatattatagatccaataagacaattatatatatacatgcatatataaatgcacaacatatgtgtgaatatatatacatacatatatagttttctacaattacttttaaataagttaagagaagatagaagaaaaaataagtatttatatcatcttttataattacaaaattacctttaccaatgctcattattttgggggagtttattcaaattgctgtttgggatcaactactttcaacttgaagaactttaatttttttttgtaagataagtcttttactaacagtttctctcagtttttgtttatctaggagtgcattttgcctttggttttaaaatatatttgcttggatatgatattcttggttgacagtttttgtttttcttttctttttcactgctttgaatatgtcatcttagatgccttttttaggctgagaagattgttttctattctatttgctgaaaagtgtctcaaaatccctttatatttaccagtatatttattatatctgggttcctcattcctttctgtaaaactctttttttatctggtataatttgcattactaagaaacttatagcatttcaaattgttcaggttgttggactcaaaggtttttacattttttctatcagaaaatgtctttaatttcatctttaagtattatttttatttcatacaaaatccaaattgctcttcattttactttgatcactttaaaaacattgttctgttgtcttttgtctccattgttttgggtgagaagtcagttattgttttaatcataattccctgcacttgatatgtcccttttatgtgactgcttcaagatttctttttgtatttgcttttcagcttgataaaatgcatttatcctaatggagcttggcttcttgtattcttaggttgatattttcttcaactttggaaaattcttagccattcattacctcttgaaatatttcctctgctctactctctcttcttggtttctcttgacacatatgttagattgtttgatgttgttccacagataatggacagtgtgtgtgtgtctgtgtgtgtgtgtgtgcacgcacgcatgtgtctgtttatctgcgtgtctgtgtttctgtatggataatggctaatttcctctcttgcttacatagataatttattttgttggattcggtctgtgaataatcccattaaaatacttttgaccttctgctttattgtgttcaggaatttttatttctagcatttggctgcttttaatattgttcacataatattccatgggaatttcctatttgtttatacaagttgtgcatgttttccacttgacatttttacatacttaacatagttatgctaaaaccctatgagatgatttaaacatctagaccatcttaaagtctagctctgttgatttattttttctttcttgacagtgggtcatatttctttgtttgctcatgtgtctgataactttttgctcaattccaaacattgtgtatagaagaacagtgattactaaagtaaatattaattgatgtctgggaaagtgcatgtcattactttagggactgagtcaatcagatttgtagttgagatgatctgagcattgttagattcagtttagcacaggcttcaagtaattcgaatgtatgatcagacctcctacatatctgagtgtctggaggttttcctgtcctgctatcagatttcggcagactcttctacgttggaccccacagagggctctttcagttcccctgcttctgcccagatacctgctgctgataatcagtctaaagcccagagtgctcgggctttttactcagttctccttctcttcccttagacttcaacaggtccaaagcacctgtccctcaaggggaagcagatctctctcagcactcctgccactatctcatgtttgtagtatcggtgccgcagagggaagtcttttttggctcttttgttctgccccaaaactttcttgagtacacatgatgaaggcctatgaaaaataattgtcaaattactatagattctccttgttctttgatctccccacgtttttaaacagccataccagcctatactttgtctgtaaatatctgttagaagttaaactgttttcttcttgctaacatctgtgactacaaccttctttcatcactgttctaccaatgatgaattttagtccattgtgtcttcacaaactcagctctctaatgggctttgaaagatggtggtttatagattatctatgtgttgtttttgttagtgtactagtgaagttctcttgtgactgcatcctaagtggaagtgaaaaatattttctgcaacaaatacagaaataaaaatcatatggtttttatttataatgtgaccactaggaaacaaaggtacaggattaaattcagcttcatgaaggtaaatacttaagatatgaaataaatatgtttcaaagatatcaattttcagtgttccaaagattaaatttagaataatgagatgaagaaatagactatgtacttttaaggcaatctattgtaaattttacttctcttggactgtttttagcagatggacagcagacagcttgatgctgttcctggagttgtacaagatgctcaggtcgttgttagaaaattgtgtttgattctatgctgttgttttcagcggacaaatgatagaatattgttagtgatggtgtgtgtgtatgtaagaagatgttggccagaacatgaagaggcatagtaaccatgctatgagaaatagttaagagaacctggaatagattatgcaacatgaagaaaatatgtttatatttaaatttctgtgttatgtaagactgagttgattattaaaatttttctgcagttaacatctttgcacataaatgtttctctatactttagattatttccctaaaatagatatttgtaaattaaattgttgagtgtaaacagccaaaacccatgagctgtattatataatcgctctgcaataaagtagaaccagtttttattcccatcatcagtatttgagtatctcttctgccatatctttacctagtattagtattatctttttaaaaatgaaaactctctaggtttattgtaggacagtatcctttttttttttttgcctttctgtttcttcagtttttgtagttctcatttcaaacatgaatttctagatttttatgaggctacattcgtatttcccttagagaaggatcaaggattcacaccttctgagatgccagaacacagcttgctttacttttgcttcatggaaatttgcctaacctatggctccttccagagtcctgccaggcgatccatgggttgggtctaggacctgtaacataagactgagtaggtgcgttagaaccagtgagaagcctttaaattctcatttccagtctcaaacagacacctgaatttttatttagaatctctgagtgagtaggtttgttctgcgtacttacaaatatttgggttttagattgaaatgggggacatcaaagattctgcttgtgttcggatcttaaagaaataccaggactcactcaggtaacttgtaaaagtctacaatggaggggcttacattggctggagttattcttgacacaatctgttttttagtcctgaagtcattctggctgtttccaaagctgctcaaacaattaatcagtgtgctctaaaggcagggtaccacgagcatgatttccaggcaactaaaacacaatgaattattggtcttatgatacccatgaggcttgattctcttttcctcaaagaatggtggaaacttctttttattctaagccttagggcctcaaggcatttgtaaatagatctttgaattattgcttacagctggttgctaaactgagtactttggcctaagtactaaagtaagaactaaggtctcctgctttatatctctttgcttaaaatttacactaaaagtaaaacaaatttttaaagaactacccatttaatacacaaagtttagttttttttaaaagagagatgcctctaacaggcattatactgttaagatctgatttttcactgctgagattaactgtattgcctgactcagaactgacccggttaaaaatcaggtctagaacaaggtctgctcctgatccatccccagtatttgcctccattatgcaaagtactttactctctttctggctccaagaataacaaacaggttgcaaggaacttggctgaagaaaaaggacacaaagtctctccgttcctgtttctcttcatttggcttgaggcataaatctgcttccaaagcaaagctgacttctttagggagcaggcctctgctcccaaactgcataggtgattttggaagcagtaaaaaaagaagaaagagaagaagagaaaaggatccaatagttcctaccagggcttaaggaataggaaagaagattgcattaggtacaagtccatttatgaagacatttagggctcacaataaaacatataaaatgtgttttaaaagtaaaaccatgtttttaaaaagcatacaaagcggcagtggaagagataaatgagaatcaactcacaattgaagggaaaggaagaggccttaagaagatagagtagtactatctgctttagacaggacaggacaatttatgggctgaatacatgacaatatagagtcatggagtgatggatattatgtggtggggcaaggtaaaacagtgccctccttctcttacctgcctgattcaaggatggagaagacactaaagtgattgatatagacaaagctatgcttcttgcattgagacactgtccactctaaatagacacaaactttagaatttgtattacatatatattttaagcaaaaatgtattaagtacttctatttgtaaaacatcatgctgggcatactaggccctgaggggtttcaaaacatgaataaaaagtagaagaaatgtatacatggccacaaatgatagctaggaacaagcaagggggagacagaagaagtatattgagtgtgggcctcatgtggacctagccagtcttggagttccatttgtagtgatgatatgggctacttagctcaagataagagctgggaaaatagacagaaagtgttttaaattatgtacttctgatgtggttggggtcagaagtgccaccgagatttgcagaagtgaaagcagcttagagagaagagacacttttaattcttggtacatcttttaaaaatgatagacgttaatcatgtttttgctaaattattcctactacttacatagatggttttattgaggggatattataactatctaccaaaacatgtttgttttagatatttgtattctcgtaggtactgatgttaatataaattatcaagaagaagaataattgggtttgttctaaaaagaagagttgtcaagctattagtaatcctggtgggaatactatttttaaatatttacagcaaattccttccttaataattcagaatgtccattctggaattccatccccttaacttgcacttcgttttccccctttgagagagttttatgcgtctttggaccaaggggttcttcctagggtccacctgcttgaggtcatgactctgagtctggttgcttattcttcctttcttcatctcactcgttaaaatcaaagccttggctcctcagctggaatccagatctagcataaaatgactcctgttgacttttcttgccttacctaccatcattccttcacatatttttggtggtcaactatgatcttctactttatgaaaatgtcttccatttgtttgggatattttcatactggatcctcacactttttatatgcactcaaaatcagtcaatcaactgcagcttctccacacatccacctggttcttctttgtctgtcctagcagatacctgcccttacctgttgacctcccagcttcctggaaaagccccagtgtagccttgactatcataagaacacaatatcctcattctttaaaatgcttccaacatttccatccttaaaacccttaaattgtgctggagttttgggactaggaagcaggggagcaggtcagactgcctcaagcctcctaaaacacttttgtactgtacacccctcaacccctgccaaactcaagaattataaactcacaaatagctccatcagcttctgcctttaaggttcagtattagttttctagggttgccaacaaattaacataaacttgttagcctaaaacaacagaaatttactctctcatagtttggagaccaaaatcaaggtggtggcagggctgcatcctctccaaaggctccattccttgcttctttcagcttctgatggctccacatatcccttggcttgtggctacatcactttcatatctaccttggtggtctcatggccttctgctcttctaggtgtgactcttctctgtgtctttcttttataaagacatttgtcattggatttagagcccacctagaaaatttaggataatcctaccctaagattcttaacacttacaaccttaatttgagggtctgccaagcctttttttttttccatataagataacatttacaggttctggtaatttggacatggacattttttgggtggagaaaggtaccatttaacccaatacagcctgttttctataaggggttaaaatcattgaaaagtgtccagtaaaaaagggctaccttggccgggtatggtggctcacgcctgtaatcccaggactttgggaggccaaggtgggtggatcacgaggtcaggagatcaagaccatcctggctaacacggtgaaatgccgtctctactacaaatacaaaaattagccgggcctggtggcataagcctgtagtcccagctactcgggaggctgaggcaggagaatggcgtgaacccaggaggcagagcttgcagtaagcagagatcacgcaactgcactccagcctgggtgacagagtgagactccgtctcaaaacaaacaaacaaacaaacaaacaaaaaggctaccttactcagcgttatcagttatcacttcactctgtaaacagcccttcacaaaccaaaacttcactttacttctttcaattacctagaaaaatgtccttatgcatgtgaattaaaacaaacagtttccgatttggtgtgagggaggagtgaaagaggagataaagaggtagaaatccttaatgaatcttaataaatcaaaacagaggcgaaggtaaagggaaaattttaatcagaaagtcaaaaatatatgtcaaatctacagaacaaatccataacaaaataagaaattagatggcaaaagtagtgtctagcagagttaaaattatggcagggtgagatgggacagtctgagccatgcgagaatttgtccaaaagtagaaactggaccctggggtgcttagcatttattgtgttgatggacacgtcatctttaaaaattatgtattcatggtctacattgccagataaaacttccctaaatgataagatattgcgtcatagacaagcctacaggtacaggtatttatatggataggttgattattaaaaactcgtggaaatatttgaggcaagcttataataatgcacagatctaccttggttgcatgttttattatacctcaattaaataagcaagctaagatcacattccacccataatttatcatctaatctatattagtatctagtagcatgaattctgagggatacttaacaaatcttaataaaattattatgacatttattatcacttgtccaaatgatttgagtataaatctataaaaccaagtaaaaaggatataaacattaaccttttctacctagttataaatcgtttgctagccatagactatatcagtggcaatacataaaattttgctgctccaattgtacctttatctcaggaaatctttttagattgcaccttcagaatacagctccttgctattcaaggtgcagctcatggactagcaccaagcctggaggcttgttagacatgcagaattgcagactccctgcctcaaacttacttacataggtgattcatatgcatatcactctttgtaagtttattatatattaaacctcttctcttactcccttgaatttaacattttgtcattcctagttgtagtttttacttcaactcagtgtaatatataccattctccctgaaatagtaaaataaaaagggaagttataaaagtgataagttaatcaacctgtattctctatttactatttattttattcagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctggtatgtatatacaagaaacttgaaattttaaaagatttctaaatacagtgccactttcatatatggttgaatgtatttgaaaataatgctctgaggtaagtgattcatctgaaaagcatgtgtgtgtatttcactatcaagacagtcaaaaatcaaaagaggaaatatgaagtttaagaatattttaagacagtcaaaaatcaaaagaggaaatatgaagtttaagaatatattaattaagaattaatatagaggaagaggtgaataggaactactgaaatgccactggagaccattggaatgacgtaagtatttagattataaactttaatgtaaattctgaatcttaactaggcagactcttgcttgattaaacatgtttcatgatttagaaggttcataattctgtgtctctctcgaactcatttataactgaatggccaagtcggtggatattttatggtaaataccaactgcaattaaatagtgccaaaattttaggtttgatattacttggaaataattttttcctaacatttaaggataagtagacatcatggtaaatattcttcagagttacatgcgaaccactgatagtgagcatatcacttctagatatgatcttaagtattcagagtccagagtgttcaccattaccccgtggaaccagctctagatatgatcttaagtataaattatattcagacatttaggtatgaaagaattagattgaatctctccgagacattgtttttgttattattattcttaaaaaatatttaatgttgtcacttctactttgagattaaaaaataatttaagacagatcttatggtaatcatgtctagatgatgagcctatatattgtaaagaaatcattttctgagataaataatacagataatatttgcaacaaaattccaagaaagaaggagggaggcctacatctattatcagtgtcaaagaaagtatcctttctctctgacgatttttacttcaaagaatggtgttcagctaagacttaggtcatattgtattagtcaagaaatcacagaaaattaattaaactccatgattaaaggtctgtatttgagataggtaagtaaaaatattttacctgagatgtttgtttagaccaatttaatcacttagtatttttctgcaattttagtgaatgcttgttaaatcaaatcaaatacatgatctgtcagtataaaattacataggtaaaccaccagtggaatcatgccacagtttctttatatttttgtttttaaagaaagagcaacagtgttcggtccataatacagaagcctctattacaaacatatgcagctctagggaataataataaaaaccaaacacaagaatcctggctatgtggtatctgtctcctataaagcttcatcttagattacctacatatcctgatgaaatttctgtgaggtagagaaaagcaaacactagtgttcattttgtaggtggatatgctaacacaaaaaatttagtgtttaggtcatatctagtatcatagttaaggttgaaatctaagtttctattagaactctaataaagattcatataaatagatgtgtttctagaatcctgcttgagaagccgactttgagaaaactcaatgtatgagaacagctgtcagatctaaatttgaattctgaatcttgcaattagtcatattaacttagataaactatttagtgtctctgagtttattgcccattaatgaacatgagcataggactacctatgtcaaaatgttattatgaggattaaatgaaatggatgtgaaaatattgaacatagaccaagtattttagtgctttggccccttaatttcagaattatccttttttatctaataaattacattaaattacatgaaactttaagagatagtttacttatagcagtccctgtttaaagacattagaactcataactatatttagaagttaggccaaggaactgaggtaaacagaaatgtagagaagtgatattaagagatcacagtagcattttaatggaactctgccattcatttaaaatcttctctacaccatctaaaacactgaagtttggcaagtcctagtcaaatgagctcagagaggctacattttttttttgatatagggaataataaaagaagagctatcattagaatcagaacaacatttttccttagtgatataggggagaaggaaaaaataatagagtatttcctgctctaaaggcacagttgttactttaaaccaacttatttttgtcatcaccttctttaggcatcacctcttacattttctcaaatggtattttgttaaggacttagttccccatctgatgtgcttacaaaataacttcccttacaagccattagagccaaggccaaaagcaaacacacctattcacagagtaagatacaaccttgtagtgatatgagatgattcattcttctcaattgtaaaaaaaaaattaattctgtaacttctaacacatttgttaatctatcatcagaaaatattttgagatctttgattaataaactcattactatagtttacacatttgcagtatattgtcagacacagtgcttagttctctgtttgcattgcttaagttaattcccacaataactttatgaaacagatgaggaagttaagattacacccagctaatgtgaggcagagctgggattcaaatctaggtgtttctcatctaaaggctttgctcctaaaccactttctgaagacagtgggcagtattgtggctccgggccactgatcctttggtggaatgcccgcattattatctaaaagctatgtaatttgaggcacattacttaacctctgagcctcacttttttttttttttagacagttcagtggctctttttttggagtgcagtggcacaatcacagctcactgcagcctcgacctccaggtctcaagctaccctactgcctcagccatcctagtagctcggattacaggggcttgtcaccacgcccagctattttgtgtgttttttggtagagactgggtttctccatgttgcccagctgatcttgaactcctgggctgatgcaatccacccaccttggcctcccaaagtgttgggattacaggcatgagccaccgggtctggcctgagtctcacttttttcatttctaaatgggaatcatttatcttaagggatgatttttatgtttacaaacatattaggaaagcagttagcactgcactgcatagtatttgctcaataaaatttatttattatgctattaaatgtcctttaaaaatttaatatgcttacaagaaaatatggtctcctgtctactttgtaatggattacccatttagcaatacatttccaatttttataagcatagaagaaagatcatataattttatgtaattttcaataatcttttaaaagtcattttatgtatttgatataaaattctacagaatttctctactgttttgccatttacttgctttattaaaattgaatatgcatcaaattggacatttacatttttcatttttataagaaaataaaaatactttctaaatgagggatgtttgtcttgtcgtgtaccattataacaactctctaagagatgccagcatatgctatgtgggacaaaggctggttcccatttgatggaaaggttggtccccagcctcattatgctgattgaaagacatgacattatccaatgccacacatgcccttatctgtccaattacttaatgttaagatctcagcgcacacttgggtgcattctttggattcagacacgtgcattataaaatggatgctcccaaatgaaaaattagaagatgtatttgtaattcattttaacccatttaattttgactgtagaaaagagataacaaaagtaccctttgaaataatgtgtcattgtaagacatgcccccatggctaatagctctgcaggttcagttggtgagtccacatcctaaaatggtacattcaggtttgttttaacagctttctttattagccagatcaagccagtcaaagaaaggaaagagaaaaaagaataaaaccaggaacaacactttcatattatgtataaagccttgatttcatgcctaatgaaggtctgttgttctttcatttagtattctttctcattctttcttttttctttctctttttcacacatatttgataaaagagaagaatagaactaagaaaatattttatagctggtaaggtactatgtgatgttagttgctgtcattaatacttaaatagataaatctttaaaagaagcaaagaggatagatttttaagccatctgaagacctgaattaaagatggcagcttctccacatgtaagcagtataatctgggcaagttaattagtgtattcgggacacatttgcctttcctattaagagaggggataatgccaattctccatgatgctgatctgggtatccaattagatgaagtatatgaaaataacttctaagttctagatgtgtgtattattaagctgagatcattcattcagcaaacttttatatttaacatatcgaattaaaactagttgtacatatttattttttaccactatgagaaaatcatatccagtactggaatctgattttattcatattgttatctttagtgcttcacacaacacaatgtccatagttggtactcaaaaatatttgtagaagataaaaaggagaaaccaggagggtaagatgatgattggggctattggaagttaattgaggatgatgaaaaaaaaaggagtgatcaaggcaacaatagatttgcatattataatttagaagaatctattgccaaatacattgtgttttgatgattgaaaacaagtttaacatatacattcgatgctattgtccatatactgatgaaagaagaaagcggtcattttttaacttaatttaaacaaatagtctgtaactggtttggattcttcataagaattttactgtggataattataattttaatgtaaagaattcttttctgcccatccaaacattttccccaactgacttattcttagattatcatttcattgtgcaactaaaaactcattctgcttcacctatttaaatttcttgtttgaaaacaaggcctataacaataaacaaacctacaatttctatctgatgagacataactatctgtgaccctctatctttttaagctacaatgggaacatcattttaacatggtggattatattaggggtgttagcaatccactcctctatcagagcaagcgctcagaagagttgcaaagaactattctcattttaatattaaaatattatatagttcatttgatttttttgatagctcttcagaattatatacttaagtgcttaaagtataataaaaaagaatgtatgtataaatatagaattaatgcaggtgttagacttcagtccttttggttttccaaactagagcactatttacataaccatgttgaatctcttactaaaaaaattgtattaaatcaccatgaaattccaatgcaagttaaagtaaaaagttacattcatgattaacttttcatctgtaaaaatgactgtataagttaaagttataattaacaagaattaaagtagtcaatatgttttcaatcaagagcttatcttcatatactttataatttttataatttaggatttgtcacaagccaatttgtacattcttaaataaaacatcaaagcccaaagagatacttatatgcaaattatttaagcattcagatctgaaaggaaaattggcagcattaatttcttttcatgggaaagaatagtcatggcattggcttgattttctttaaaaaaaatttttagatctatgactgaaatacagaagcactcttataagcatcataagggaattactattaaatagaaattaagacaaaaggacaagttaaagcagctcactatttttaaccgttcacagtaaaattatacatgttattaataaatgattaataattcaataatttttctgaatagtttaaattctttttaatgatttattgtgtaaagaatgtctagtttgtttcctgttaagtgcactggagcctaaacttaagcttccttgtacttagggtgatttacttccctgaaacaaatcatgctttggccaagtccccatttctgcagggctgagtgcaaatagagcacctaactcctctattctcagattcatgttaaatatgtaggttttgtgtcaattccacctgtgaaaaactttttctaatatgctaaggctacaattgaacattcaaagctaaatgagagaaattaaatcaataatccaagtaagatataaaaacactttattaagagaagcagttactgttcttctgtgctttttttttttttttttttttttgagacagcatcttgctctgtcgcccaggctggagtgcagtggcaggatctcggctcacagcaagctctgcctcccaggttcacgccattctcctgcctcagccttccaagtagctgggactacaggcgctcaccaccacgcccagctagttttgtttttgtatttttagtagagatggggtttcactgtgttagccagggtggtcttgatctcctgacctcgtgatccgcccgcctcagcctcccaaagtgctagattacagatgtgagctaccatgtccggcctattctgtgcttttgtttatgtcccattttccatggactgagctcagtgaatgatctctgaagagcaaatcagtcttgaaaatatattacaaagtgcttaaaagaaacatgataaaatggaaagagatattcaatctaatttaaacatactccatttttaggtctgttccaaataaaaaggctaatattgcttataatgaaaaacatttcagtaaaatgctttaacaaataatacttgtcctaaggaaggcaatatttgattcaacaaattgcagtataatattttagagttatttttgaaattatttgcctgtgactactatacttgtacttaaacacccttattgtttgattataggacaacttactttttgttttcctatagcatgaaaagttttaacttcagaatatgagttataggggtaaaagagttcctagaagttattttaatactccagctcttaatatatattatatctaaagtgctacaaattattttttaaccctgtgtagtcagtttcattttctaacagtcatgtaatcacagttgaatagtaaaataaaatctctcaaacttcatattattaataatttctctatggggaaacaaaataatcatatagttttattttttttaattttaagttaagaggtacatgtgcaggtttattatataatgtaaacttctgtcatgggggttagttgtacagattattttgttaactaggtattaagcatagtacccattagttgtttttcctgattctctcccaacttccaccctctactcttcaatatgccccagtatgtgttgttcccttttatgtgtccaggtgttctcatcatttagcctccacttataagtgagagcatgcagtatttggttttctgttcttgcactaatttgctaaggataatgacttcctgctccatccatgtccctgcaaagtacatggtcttgttcttttttatggctgcatagtattccatggtgtatatgtaccacattttctttatgcagtctatcactgatgggcatttaggctgattccatgtcattgctattgtgaatagtgctgcaatgaatactcatgcatgggtctttagaatagagcaatttgtattcttttgggtatatactcagtaattggattgctaggtcgaatagtatttatgttttcaggtctttcaggaactgacacactgtcttccacaatagtgtataagtgttccctttttctccacaactttgccagcatctgttattttttgactttttaataatatccattctgactaatgtgagatagtatctcattatggttttgatttgcctttctctaatgatcattatgtggagcttttttcatatgattgttggccatatgtgtgtcttcttttgaaaagtgtctattcatgacctttgcccactttttaatggggttgttttttcttgtaaatttaaattctttatagctgctggatattaattagacttttgtcagatgattagtttgcaaaatttttttcccattctctaggttgtctgttcactctgttgtagtttcctttgctgtgcagaagctctttagtttaattagatctaatttgccaatttttgctattgttacaattgcttttggcatcttcatcatgaaatctttgcccattcctatcttctgaaatctttgcccattcctatgtcctgactggtattgcctaagttgtcctccagggtttttatagtttgagattttacatttatgtcttcaattcatcttgagttcattttcatatatggtgtaaggaaggggtccaatttcaatcttctgcatatggcttgccagttatcccaacaccatttattgaatacggtgtcctatccccatttcttgtttttgtcagctttttcaaaaatcagatagctgtaagtgtgtgaccttatttctgggttctctattctgtttcattggtctatgtgtctgtttttatgtaccagtaccatgttttttttgattaccgtagccctgtagaataaagttgggcagtgtgatgcctccagctttgtcctttttacttagggtttgctttggctatttgggcttttattttattttatttttttggttccatgtgaattttaaaagagtcttttctagttctgtgaagaatctcaatggtaatttaataggaatagcattgaatctataaattgctttgggcagtatggccatttttatagtattgatgctttctatccacgagcatggaatgtttttccatttgtttgtatcatctctgatttgtttgagcagtggtttgtagttctccttgtagagatattcatctccctagttgtctgcattcctaggtattttattctttttgtggaaattataaattggattgcattcctcatttggttcttggcatgactgttgttggtgtataggaatgctagagattttcccacattgattttgtatcttgagactttgctgaagttgtttatcagcttaagaagcttttgggctgagactatagggtttctttctttttttttttttttttgagatggagtcttgctctgttgcccaggctggagtgcagtggtgcaatctccgctcactgcaacctctgcctcccggtttaacgccattctcctgcctcggcctcctgagtagctgggaccacaggtgcctaccaccacgctcggctaattctttgtatttttagtagagatggggtttcaccatgttagccagtgtggtctcgatctcctgacctcgtgatccgcctgcctcggcctcccaaagtgctgggattacaggcatgagctgctgcacctggctatgggttttctacatataggatcatgtcatctgcaaactgatatggcttgacatcctctcttcctatgtgtatgtcctttatttctcttgcctgattgccctggctaggacttccaatactgtgttgaccaggagaagtgagagatggtatcctggtcttgtgccagttttcaaggtgaatgattccagcttttgcccattcagtatgatgttggctccgggtttgtcacagatagctgctattattttgaggtatgttccttcaatacctagtatattgacagtttttacatgacggggtgttgaattttatcaaaagccttttctgtatctattgatttaatcatgtggtttttgtctttaattctgtttatgtgatgaatcacatttactgatttgcatatgttaaacaagccttgcttcccagagataaagtctacttgattgccatggatgagctttttgatgtgctgctggatttggtttgccagttatttttttttgaggattttttcgttgatgttcatcaaggatattggcctgaaggtttcttttttgttgtatttctgcctggttttggtatcaggatgatgctagtctcatagaatgagttaaggtggagtccctcctcctcaatttttcggaatagtttcagcaggaatggtaccagctcttctttgtacatttggtagaattcagctgtgaatctatctggtcctgggcttttttttttttggttagttggctatttattactaactcaattttagagctcattattggtctgttcagggattcaatttcttccttgtttagtcttgggagagggtatgtatccaggaatttatccacttcttcaagattttctagtttatgtgtatagaggtgttcataatatcctctggtggtttcttatatttccgtggggtaagtggtaatatccctccttgtcatttctgattgtgtttatttgaatcctctctcttttcttcattagtctagttagcagtctattttatttttttccaaagcaccagctcctagatttgttaatcttttgaatgaaattttgtgtctcaaacttcttcagttgagctgtgactttggttacttcttgtcttctgctagctttaggatttgtttgctctttgttctctagtttttttagttgtgattttaggtttttaacttgagatctttctaactttttgattgggcatttagtgctatgaattttcctcttaacactgcattagctgtgtcccagagattctggtatgttgtatctttgttttcattaattttaaatatcttctcgatttctgctttaattttattatttacccaaatatcattcaggagcagttattcaattttcatgtgattgtatggtgttgagtgaatttcattcttgatttctaatttgattttgctgtggtccaagagattgtttcttattatttcatttcttttgcattttctgaggagtgttttatttccaattatgtgctcaattcttgagcatgtgccatgtggcaatgagaagaatatatattctgttattttggggtggagagttctgtaggtatctatcaggtccatttgatccaatgctgagttcaggtcctgattatctttgttaattttccatcttgatgatctgtctaatattgtcagtgaggtgttaaagactcattattatgtgggagtctgagtctctttaaagctctctaagaatttgctttatgaatctgggtgctcctgtcttaggtgtatacatatttattatagttagattttcttgttgaattgaaccctttaccattatgtaattcccttgactttttttatctttattggttaaaagtctgttttgtcagaaactaggattgcaaaccctactttttactgttttccatttgcttggtggatttttcttcatcactttattttgaggctatgagtgtcattgcatgtgagatggatctcttgaagacaacataccaatgggtcttggttctttatccagcttgccactttgtgtgttttaattggggcatttagtcatttacatttaaggtaactgttgatatgtgtggattttacactgtcattatgacgttagctggttattttgcagacttgtttatgtggttgctttatagtgtcactggtctgtgtaattcagtgtgtttttgtggtgtctggtgctggtctttcctttccatatctagtgattccttcaggagctctggtaaggcaggtctggtggtaataaattccttcagtgtttgcttatctgaaaaggatcttatttctccttggcttatgaagcttagtttggctagatatagaattctggtttggaatttcttttctgtaagaatgttgaatattggccccaaatctcttctggcttgtagggcttctgctgaaaggtccatttttagtctgattggcttcctttgtagttgatctgacctttctctctagctgtctttagcattttttctttcatttcaatctttaaaaatatgatgattatgtgtcttggggatgatcttcttgtgaagtaccttactgtggttctctgcattttctgagtttgaatattggcctcactagttaggttggggaagttctcctggatgatatcctgaaatatggtttccaagttagttccattcttcccatcttcttttccagggacaccaatgagttgcagattcagtcacatattttttgaatttttttcatttctttttattcttttttctctattcctgtctgactgtcttatttcagaaagccagtcttcaagctctgagattatttcctctgcttggtctattctgctgttgatacttgtgattgcattatgaaattcttgtagtgtgtcttttagctctatcaggttggttacattcttttctaaactgtctattttttctgtcagttccttcattgttttataattatttttagcttccttaccttgggttacagtatactgctctagctcagtaatcttcattcctgtggataatctgaattctatttctgtgaatccagccatctgagcccagttcagaacctttgctggagaggtgattccatcatttggaggaaacaaggcactctggctttttcaattttaagccttctcagaggattctttttcatctttgtgggcttatctacctttaagctttgaaattgacaacctttgattttttttctcttttatcctatttgatgaccttgagggtttgattgtggtataaggtagattcagtagactagcttctgcaagattttatggggccaacattcacctcccaattcctggactgcatgctataactctgggggactcatattaggccctgactttgtcctctggctcctcaaggtttggaatccactgcactggaagggagggctaaggtgtagcagctgtagcagagtgctaacaagtgctggggtatctgcctccctgcaggtgttcaccacagtggcagaggcaacacagctggcaggcaggagcagaggacccctgctggagactgtgtgtgggcatgctggaggtggtattagctcaggggctgggtactggtgggaaaagtctggatgtcttctctgtgtcccctaagcaggtgtgatccaccatatagttctgcatatagttttatttgtttctgtgcaattaatgtacatacttcaccaaagaatttacatagctaatatcagaagttttcatgtaggtatctttgaatcacaattattaggagctacaattcagtaaaaggataccttgctttcagcactctaaggaagatgtggctattccaaaatgggagggcatttggggactaatatttcatctctttgaaatgttaacagatttgaggatggtatgtcagactgagtcaaagcatttgcatgggaaaaggtatgtcctctatagaaacatggacttcatccagatggctgggtagctgggtggtgcccagattgcaggaacaaacaatgaatactttgttcatctgtacaaggccagttaggtgctaagcatacaaatccaataaggtacagtgcttacctgaaggagtttgaaggagagagaaaaacttggagagaatcaatgaagaggccattggacttggcagttaaaagcagttttgtgtggttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtcttgatctcctgaccttgtgatccgcccgcctcggcctcccaaagtgctgggattacaggcgtgagccaccgcgcccggccagttttgtgtgtttttaaagagaaatttcagttatttaaagaaatggatatgaagcagctatatcacctggggtatataccctggggtttgtcatcttgcaccaggaaaacttaggacatggactcacacgaggagtttagcagcagaggtttaataggcagaagagaagtgaaagagaaacagttctctctctatagagagaggggtccctcagtggaaaagactggctgtcagtgaatgtgccaaattttatagtcaggtttgaggaggcggtgcctgatttacatagggctcacagattggtttgatcaggtatgacgttcacacaatgcatgcggaaggtggttgtcccactctaatgttagcatgcaaatgggctttccagttgactggtgccatcttctctgcttctcactgtacacttggccgacaaagggaagagaagatggaccatcttgaacatgtatagtccttacttcctgccagcattcacccatgcaagctcccagcttgcttgtttatgtctgcagctcaactttacaggctgctctttgttagaaaatgatttgtggctgcctttcaataaaaagcaaagccttaccaaggactctcattcagttactttctgcctaagtgatttcttaacttctatatcgttcccccctctggagtggtaaccctaattgctgttagtggtcatttgaatgatgactctttctggcaacttcctcctataaaggggcattgtgtggggaacagcagctatggctcctcctggggtcaatctaagggtccttggaagaaaggcatgtccatgtatggttctgtctgcagcaccatttggagtttgattgtttctaaatgagaagagatgaatgttagttcgaatatgactattaagattgccactattagtggaggtaccataggccacaatcataacagtagggtttgttacctgtcagtcattttgatgaaatgaaatactggtttgcttctaccaaatgttgctgtactttatcagaagtgttgatataaaagcaacatttttttttctttgagaaaaacatatatacccccgttgctttgccattaggggataatttctggtctaggtcatcttttttaacttgcaatatgattgggagaaatatgtcattgggtggctagtgtaattttagtgttaaccctagctaaatctttcctgcaattaattccttcacagcttccaccaactatctatgacatgcttaaactttctggcttgtcctaaacatccttctttttaaacaaccaactattctttttaggacatgtatttaccatccttctaatcctttcatgacttccatgaaccatctatgacatgcttaaaccttctgacttgtcctaaacatctctcttttaaacaactagctattttctttaggacaagtatttctcatacaagatcccttcttatataaaatctctttcctttataaccttctttgcaccaaacggtagcatgagcatggagaactaaaaaagcatacttggagtcagtgtaaatgttagctacctttaccttgcttaactcaagtgctcttgtaagagctatcagttcagctggttgagcacttatgcctggagtgagagacacactttcaataacattcagagtgactactgcatatcctgccttctgtactccttgctctgtaaaggagcctctgtccatgaagagggcccaatctggattttctaggggagtttccctgagatcttccctggccgcataggtctgtaccacaacttgttcacagtcatattcaggtcctccagttcccttggggagaaaggtgactgggcttaagcaaaaacaagtttttaactggatggtggaaccctctgatagtagggcttgatatttaaggagcctgctgtctgttaaccaaaggctttccttagaggacagtaatcccaccacattatatggggtataaatagtcatgtcatttcccaggattaatttggaggcttctgggaccagtagagccactgcagcaatggatcaggggcatgctggcaatcctttaaccatcaaattaagttccttactcaggtaacccactggctgttgagctggtccacagacctgtgttaaaactcccaaggtcatttccttcctttctgatacatacagattgaaggcccttcctatggaaaggctgtgactatggcctcagtgagatggaagtcctgaagtagtcttcattccccattgagttttatgtgctcctaacattggggtgttgaatgggctgcttcaggttttgaagaggccctgcatcatcaggttattagtaatggcttctagccctttcctagcctctggcttcagtggatattgtttctggttaggaaaagaagtgggatccttaagatggatctggactggcctagcagttacagctcaactcattgttccttcagttgcccacacttctggattgatattagcttctaccagggggtgacagagtttgtcctggggctataaggatgctggtctgcctgcaagtaaaatatctctacctaataaaggagtggaactttttggcatgattaaaaaagcatgtgtcaataataggtttccccatctgcaacctaaggggttgtgaaaaatattgaattagactttttcctgagatgccctgtgatgcctggtcatgctacagaaagaggggaggcctggattagagaggagaagagagagagagactggctctagtgttcacaaggagatctaccttccttcaatttccagaatcacccagggctcctgtgctgtatgttggtttgagccactggagctccgggacccatcaatcctgttggacaatctgtgagactggtttggaacccggtgaccttcatctctgggggcagtccgacttccaatggttccttccacaggctagacaaggttaaggtggttttttcttgctgcctgggcactctttcttaaagtgccctgacttgctgcacctatagaaactagcagatgtacctcagggatcctgggctttgtatgtttgcagagcagctattagtgcctctgtccttctcttttgcttcctctctttctcctggatctcctcctcctggtccctattataaaacaccaaagtggtcacccttaggaggttctccaagatgctatctggtgctatagcctccttctgtattttccttctaatattgggaggtgcctttttaataaacttgtcccttaggatgagctgtcctcgactgattcaggggataaaggtatgttttatgagtgcctatcagtctttccataaaggctgcaggattctcatctggttttgttctatcttggaaagtatagagtaattaatagattttgcccttgctcttcataggccctccaatatgtgcattaaatggtgtttccttttccatccatctgtggcatcaccggtgttccaactagggtttgtttttttttttagaggaactgcttcccttcctatcgggaatggtgtttccattatttctttgccttccttatctcctttttcctttttaatctaccacaggagacatgttgttcatcgccagaattttctgctgcctgcagaactgcctgcttttccactgtggttaggatttggcttaagagcagcaaaacatctctccgtgtgtggtgaaacacttgagttaaattttggaagggttctatatacctatcaggatcatcagaaaattggcctaaatcttcctttatttgcctaagattctgtaatgagatgggaacttgaggtgaccccaaataacggggattctcagatggctcctctggaagttgcttttctagtcttagggaatcattccctttgggcctgcctgatatgattgctacacttgcaaaggtctagtaagaaggccatgcccttgtgcaaaagaaaatgagccattttttcttcaaagtctcaggatcaaaggagtccctgtgcttcagaatgcactccagaggagtacaggccttagatgataaagagaaggaaaaaaaggcatccctttagtctccttccttttgatgtgacccagggtgggagaaagacagtgggggtgtccccctgttgttttctctccatggttcctggcatcctggcaccttgttaaatgtgctgcccatggttgcaggtgtggcttccccagccatggaaccagaggaactaagtggtgggttttagtcaccctcacccatgcaactctagtcctctgcctagactttggggctctctgaaaaatggatcttgggaaagactatgtaacagttgcatttgggcaattgttgcactcgcctccttaatggaggaagcgtgctggtttgagctctatatcctgctattatggcccatgctaaagtgtttacccttagagaatcattccagttaacttctgacttaaaatccccttactaattaagtaccattctaattggaggcagaataggtatcttaaaagaatgtagggaccaaatggccattttcctgaaggaaggacagtattaagactaaaatttggttttggaggacattttactcctaattgctgaaggcagagttttcccattcacagaaacagcataaagcctggtttctagtagagaggcgtaaaaaggggagagaattgggaagctagagtgcttgggtaaaggagaggattcctattccactaggtggtgctgctgactttgagatgccatgtgctctccagaccaagggcagagtgaccttgacatgccatgtgctctccagatcaagggcagagagagagagacctggaaatgccatgtgctctctagaacaagggcagggagagatgctcactgggggtaccctctgtttctagaacatcacaaaaacaccttcccttgagctatatgcccatttactatgacattatctgatcttgccaaacaggattccttccctgaaccataaatcttcccacacattgcatacacagagaggataagagttatgacagttgccaacaggaaagaaagaaattatgataggaaagttggagatcttgtggccgatagcccatcagtggggacagaggctggggtcagtccagtagcctttggataacaccagggatagccccagccagaaatcctcagttgctccaggactccttccagccccacatgacggctgagtactccatgaaaggaagctggttcaaacatggccaatatgccaagcaacccatgggttctccatgttctccccagtaagcctgtcccccaagtcttatatggctggcagccacgctaattattttatggctgaagggggtccagtatttggtttgatttggttcttaaatggaggccaatagcctctgaatgaaaggacagagttggagtctgctcctctactcattgtttcaattaatgttgtacgctggtatcatggatgaggtccccagtatgaaatggctatgttgtctggggtatataccctgggattcatcatctcacaccaggaaaacttaggacatggatacacacaaggagtttaggagtggagatttaataggcagaagagaagtgaaagagaaacagctctctttctgtagagggagaggggtccccgagcagaaaagactggctggcgttgaatgcgctggattttatagtcaggtttgaggaggtggtgtctgatttacatagggctcacagattggtttgatcaggtatgatgtttacatagtgcgtggggaaggttggtcactgtaccctaatcttattatgcaaataggctttccagttgatcagtgacatcttgtctgcttcttactgtacatgtggctgagaaagaaaagggaagatggagccgccatcttgaacatgtgtagtccatagttcctgccggcattcacccgttcaagctcccagcttgcttgtttatgtctgcagctcgactttacaggctgctctttcttagaaaatgatttggggctgcttttcattaaaaagcaaagccttaccaaggactcccatacccttactttctgcctcagtgatttcttcttaactcctatattggatatattgtgggttgttaaaaagtgattatggagtgaagtacaaaaaaaaaaatagccatatatcagttcttccatgcagtacagtggcagaaaaggatgtgatggcttagggattaagaagaaagcagtatgacagaaagatttttaagatcagagactacaaagggtctttctagcagggaaactgatactacaagatgatataagagaacgggggagagagtactttggagtcactgacggcgcagtttcagaaaaaattggggaattgaaagtgagagcataagagacgatattagatttataatatttctagatatttggggaaacattatccaatacaaatgcatggtttcttaacatttatttgtagaatgaagcatgaaactaacacaacattaagttgttagaagttcataggcttcaaaagtaaaagtggcaaaatctttttccaacagtctatgtaatctttcaaaatcatactaactgaaaggacaggaaatgggcacacttcctatggcaccaaatcaatttttatcttggcagaaaaactgattattacagctactgtgagccattgttattataattgagtggatcatttgtccagtatgtttttcctagtaaaagaaaaacatttgtggtttctgtggtgaataagaattctaacaccaggaaaaaaatgcaggccctctttttgttgttgttttgcatatatttgtttgtttgtttcagcaccaaatgtggctccttcagatgtaggaggtggaggtggaagaaacagagagctgaccataacatgggcggtaagtattgatgagttgcacatattataggttgctgtatctatatttaacttccaccccattttgtttcctgaaataaattgagatgaaagtgactgcctactgcacaagcaagaatatattactatttttttttcttaaatgcaaatcagattttatctggcttactgtggcttagtgtgtagctcctatgcaagaatgaatcctggatgctaagagatctgttagcctagatgattaaacattcagctgtctgattccagagatactttgatcattgtagtctggtaatctaattgtaattttaaacattgtctctggacattctaaattccaaagattccatttacaaactttgtatcaaaacccatttttaaattggagactgcctcctcacttgaagcttactttgatcactggtgtaatctagcatgataggtcagtcttagaagtcacccatgggactagttactgaggtatccaaagcattttattacagtttcgtgagtcaaagagttctgtatcagagactacaatctctagaaaacaatacatcttggctggatttttgaaataggaaagatattgggaggggtgggaaaagttgtctgacaaaactgtctgacttagacatctggcatttatccagataacatggtttatacagattcatttattcattaaatacacttagtgttgaatcactgcagatagtcaaagagcacaatttaggctccaaaggattttgaagactgtggaaaaaatgacaggttttattctttgcattggtcaaatggatttatttaataaatgaatgtttagcaaaacttgactcactgtgtgctttgtagtcattttctatacttagcatttaaatcacattttaaagcaagatttagcaaaaaaaaactaatctgaatcgtaaaatatttatttctaagtttaactgccaatgaaatgtccaaaaatgcaaatattataaaaattagaacatttcgctctttctcttatggctttttataaattctgtggatatctgctacagaataagatgggccttataaaaaattcagtattggaaattctcctccaaagattcaaattcaggtttctggagatagagcccgagagttgttatttttgaaattttcatagctgattctgttatactctaaattccaaaaactaagtagagaactatcaataagaaaaatgtttaaactattgtagaaatgttaggctatactatctaataatctaaaatcacatacctattaatatattgtgcaaccacatacagcttctaccatttgacctttccacatttctatatcttcctatttaatataagtatgtccaagcaatagtgttatatttacttcaaggttttgcctcaagacatcttaaatttgattttctggtaaaaaaaaaaaaaagtaaatatacaatgtgcacatttacctaaattgccaaaaaaggctaactgacaagtactcactagaagtagctgtaagtcagtttttattaataataggtgattagggctgacatagacttctttataaggcaatttacatgagtgacaagaaaccttgagaaaatgatgaaaaaccaagcacttgctttagaattggagatagaaacccaaagccatcctcctacaaatgagtgcaatattgtcccttcctccttgtcacctacttttattcctcttaccagtttcttttcgatcacaaggtagatattctaggctagagtcttatataactctcttaccattgcctttcaattctaatgaaattcatttgctcatccctttaatacatattacttgaagccctgttctaggtgctagggataaagaggaaaacaaaactgacaaaaacgctgcattcataaaacgtgtattctagtagttgagagagacaataaagtagataaataagtaaactgtatagactttgttagggttaaagaaaaacaataggtagggtgcgggacatggagcattgtgttggagtcttgcagtggcagaacctgtggtcggagaaaacgtcgaggtgattttacctcgggaaagtgagggggtgggaggagtcacataacatctaggagaacattctaggcagaagaaactgaaaggaaaaaggcccggagtgagaggcccctgaggtgttctaggagtagtgaggctacaatttggtaaataagatcatcccatgtttaagtatgtttttcctctgacatttggaaccagcactaatgtatgaactgtgtatgtttttacaaagagcacgcctccgtgtgtgtcattatccccatagcatttcctccctgttacctgtattactaaaacctactcaatcttttaatttctatttagcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacggtaggtgaaagaaagaccttcttacctgaggagggaggaaaaacgtatttctctagcaggcatttagtttgtttcctttcaggccttacttattaagacctttttatagcattatgcatttagtaaatgagtactattttgaaccaaattaaacatcaccctcttcatctaaatgatgagaatgttgctagagtctttttcatcatttagatcatgcccatggtatgaggaaatccccattaaaataattggctctgacttccatttttgggctcttgattataattttgtagtcagaaactctccatacttgaacagaatctcaacatgtctgtatattcataaagtttataatttaaaacttctataatatggccgggcgtggtggcgcatgcctgtaatcccagcactttgggaggcggaggcaggcagatctgtctggaggacagagcaagactccgtctcaaaaaaaaaaaaaaaaaaatttctgtaatgtatatattatatatattatttgtaaaatggccccaaattctaacctaaaaatgtgtttaattgcagcatttacgtaactttttattacaatacagaacacaaattttgttaaagggaatctagacataattatatgaaaaagaggtcagttgaaattgttttcttgaaaagggaaaaatttgtcctgtagggcatttaggaaaaaaacaatgctaataccagctctttttgtttttctagaaactttaacttaactaaccatggtcatagaagactttatatatttatacaaatgatacacagttttagattgagcataattacattattttctctgatttctgtttaagctgctatacttttgttatttatattcttgttaaaaataatacctttctggcctggcatggtggctcacgcctgtaatcccagcacttagggaggctgaggcaggtggatcacctgaggttgggagttcgagaccagtgtgaccaacatggagaaaccctgtctctactaaaactacaaaatgagccaggattggtggcacatgcctgtaatgccagctacttgggaggctgaggcaggagaatcgcctggacccgggaggtgaagttgccgtgagccgagatcaggccattgcactccagcctgggcaacaaaagcgaaagtccatctcaaaaaaaaaaaataataataataataatagctttctttattcatgtgcactgtgtaaataattaatgactagaaaaacaaatagagatgtcattgccttctgatctttggcaatgtacatttacccttggccaagtttctctttgcacatgtgtgagaagcacaaatagaagagcttgaaaactaaaggtgtgtgaggtactcttctatcattagaggaaatgggctctattggttcacccaacttccattgttttcactccaagatagacatttagccatgccttatacctcaacagaaattctcacgtatattcatcggtcacagaattattagttttagtatttgttaaaaatgtaatatataattaaatcatcctatgatctttacttttattaaacaccattgtattctatatatgtatgtcataataccatgtcatatgtcttaaatatacataacaaaatttaatataaaaggcagttattcatatatgttaaagtatatatgtgtgtatatataagtatatatgtatatatttaaagttatatatatactttttactatattttttactgcatacaaaagtatgtgtattttaatatatgtgtgtgtgtgtgtgtatgtgtatgtgtgtatttttttacttttaagttagcacaaccaaatatgtcaaaagaataaaatgtagaaataatttgtttattatcaaacagtggaaaagtcctgatgacaaacttatattctctatgcttgtgctcattcagcagaaatatgataacttggctgagcgtggtggctcatgcctataatcccagcactttgggaggtcgaggtgggcggatcacctgaagtcaggagttcgagactagcctgaccaacatggagaaaccctatctctactaaaaatacaaaattagccaggtgttgtggcacaagcctgtaatctcagctactcaggaggctgaggcaggagaatcacttgaacctgggaggtggaggttgtggtgaaccgagatcgcgccattgcactccagcctgggcaacaagagcgaaactccatctcaaaaacaaaacaaaacaacaatgaaatatgataacttcactcagttttaataatttgaagaacgagtacatcttacagataaaatgagtgtcttaagcattttacaagttaccttctcacctttttactgctttacttgatgctaaaataagttttcaggcaaatagcttgtcatctatttagtcatggctatttgtatttaattatatttctttcctaaatatttcatgagtctcataaaacttgcatgtgttgaaacttgtataagtgttaatctcttcttccactgctgagaaatcaatcatagtgctacacatttgccttgttttagaaagtcaacagtgttcatgtgtagaacatttttaaacattaaataggattatggcattttaatgaaagacaataaaaattgatcacccctgcttaaagccttcattggtttctttgtgtaaatttcataagggatgtcagttactttttttctgtgaacagagacctttttgatacatatttgacttgatgcccagttggaagattagacatataaaagctttcttgagcccaggaaacagtggatgttacaacttgtttcaaaggctcttaaaaatttttttttaaagatcttagcttgaacataaaaagggaagttttattaataatattgctgtttgtagttagttcacacaaatagcaaataagagaaaatgtattatattgaacaattttctataattccaaatttcctatttctgataatatagagttgacagctaaatattaataattttaatttgcatcaacaggctttcttaagcatatcagttgagagaaattaaaaaaatagtttttttttgctcacagatgtaatagaaattgatgaagctttctgtatttggtaaaagtgtgtgtgggaatgtgtatgtgtatatgtctatattaacatttatgtaaatgaatgtgtgtgtgcacatgtatcactaatgccataaaataaagtaacattagaaaaatacaggaagaggtaatgaaataattgcacttagtttgaaaatagtaaagctattttagaaacattaaaattaaagtatggtccaacatcattcatatagcaaatgatgctattcgaatttcttaaatgtaaatatctcactaataatataatgttctcataaaatttcagctcccagtgaagccccaacagaagtaggtgtaaaagtcttatcatcttctgagatatctgttcattgggaacatgttttagaaaaaatagtggaaagctatcaggtacgttaaatttttatcaaactaaatacatttattcataaatatataagcatacgttttcaaatgtgttgtatgtttcaatgtcccattaatttatgtggcaactaatactttattctctgtgtctagtattgtggtcatatataagttaattgttaagaataaaacaggggttcctaactggcctatctaggggagatgtaaagaaacctaagtcctggcaaacaattggccaaaataaaaactatggtaataacacttatgattacccaaggtctttttaggaaaacattctcataaaaagctagtgaatctcaagttttttggaaagcattttggtaatttatagaagcatcctgaaaatagtcatcctctttgagtcagtagttccatttcgaaaagtccctccaaagtaaacaattttaaatataccgaatatgtcttatgttatctatgaagtaacaatcaaaatgacccaaataaaacttcccttgagcttaattttaaagaaccagtaagaatcagtcagacgcaaatgagaaaacttgtcttagtcaagggagtaaaaactggaaaatcaaaactagagagattagttagggtctttaatacaatgctaatgcaatttagactgagttatgtaggaaatgtgaaatcatcatctcacatttttaagtgcaagaagtgaaaattcaaaggaattaacatggtttttcctttacagatgagcaaatggataccaaagagatttgacaacttgcctgagttgtcacttacagaaagtgtcagagcagtgtctaaaactcaagttgtctgattcaaagttcggggttttattgccacacatcacagacttccctgttttttttttcagtgagtgctgtctagggctgcctctccacccaccccactcccccagccagcttgcattctcagcttcagcaccctcccttatcccttgtccatggaatattagccccatgagggcagggtattgttctattctcagtgccatgcaagaccagtgctgagcacctggcaggctctaaatagatattaattgaatactgataggaataatgaagtatgattaaataaaatgttacaattgggctttctcaaggccatgtttctgagatgtagctgtaaaagaaactcaaggctttgagcagacacacccagaccaacaggaagctttttttttttttttttgacacaataggttataatttgggaagatcttaaagagccctcagatcatctatgcaagggttcagctgaatttattacagtacacagaagagtagactgggaataattagactgagaatacccaatattcataacttactaacctgacaattgtgtttgcggctagtaggaaagagagaaattcactagatgttacaaacccctgtaataaatacgcctgaggtatctttgggagaagacatcaatgtgtagagcttggaaagtaaaattttggagcacaggatttttttcttcttttatattatttatttctaactaataaatattgaaaaaaggataatttaacatataacccatatcattgagtcaaaatgccaaatatatgacatattttactttatttaaaacatgctagaaaattatatattatctttgttaatgccaagaattatatattgacgatttgcttacttttaacaagaagaagacaaaagaaataagaggtaggaagcaacatagtggaaccaatgattcagatgataattaaattaaatatgcttttttaattgggaactaaaccttgattaaggattttcacatagtcagtaaaaagtaatctttatcaaagaagatttttttcaaatgataatttcaagggaaaagtatgtaccatgaggagttggtttcacagatgtctgaccttttccaacttacattaagtaaaaacttatgcactttgctgctgagcaaacatgggtttatatttcagctctgtcacttaagaattttgtagaaaattgatttgaactttgagtttcctcacctataaagtgagaaagtaaccactgcctcatagaactgttatgtgaaagatattaaataacctgtatttaagaattttccctgtttatgtcattgggcattccaagatggtggtgatgatgatgatgctgatggcagtgaggaagatgatgatgatgttaatgatgaaaagactgataacacgtcttgagttcttattgtgctaaacacttaactaagctcattttattaaatccacacaaccctagaggatagacactattattatccctattttagagatgaagaacttgaggattagaaatgtttgtctgagtaataattgtcataatcagattttaatctagttcttgcctctccagagaacggttgattaaaattgctggaagtaaatcatagaattattcttcccattcattctttcttaaaatccttttaaaccttttacacagggtcttggatatcaaagagacaagcacgaacacttaaaagagaaaaatccatattatttattgttctgcaggaaatgctcctgtgactgtggccggtaggggggaggggggtcttgactgactataatgtggttattgtttccattttaaaatatgatgggagaagccaatggtttaacaagatagatgatggtgaaaaccaataccccaatgcacttcccatgaaaatgtacgatggatctctatttttctgtgtataaagatacacagaaagaaagcagcacattgaaaacataaaatataaagctggaaagccctgactcctgcctgattgacaccatctcaaggttcatttcctgacatttcaaatgagaattgtgagcaattgaatttaaagacaatctcttcccttgtggttttaaagtgtatctcagtagaatgtttatgtcacttagtatttttttatcttacttggttaaagagctccccactttcaatcttaatacccagggagtttttctatagtgtaggtaagctagaagaatacaagaagtctttcttatcaagggcattttggaactttgggctcttgcccaggaatccacaaaagacttagtttgctcacacagtgggtaaaatattcacttaattaatttaacaaaaatgagtaaaataggctaccaggaataatgaatgcaaaaactttagcacctaaattagagattaatgcagatgactgatttcagtcatcataaaagatgaacaatcctgtatagtctactcaaatatttttaaagtttaaattattatggtgagccgaaactgattacttagaaagtgctttattttcttattttggagaagacatccgttttggtctgaatctctttgaaacagagcctcaaacaaagatgtggagaaaggttgtttattattgttgttaattgtttgttttcaatatgatcctaggaagcaggtatgaggaaaaggcagagtgaacaggaaagaggggagctcagatacaaacgtgctatttgtcttgttggcaaccactgtgggcaactggtactccatcccttgagacctttgaggagttttataaatgtgcctctgaagctgccctgcttgggatgaaaagggaagcattcatccacttctgaatgtccagaaatgtgctcattcaacacataaacctcacttttgtgaagtgaatttgagccatcctgttgcacttcataatagtttcttacatgtttatgtaaataaaaaatgcaggattatattattattagacattttaatctaggcattttggttaattgtgaaattacaatcccgttattttatagacagggcatctaaaatatgtaaaatatcaggatagttacaaataatccttttctttttattcttatattacatataacatatttttattcattttattcataccttagatataattataaatcttgaatgcaaaaaagcctttatttaaagatgaaaattataatccataacttttcttaaactttaagagaaaagtaatcctgtaattatttgacaaaagtaatcatttctaatgaaaaaatcgataacttttttaaaaattattttatgggtaaataatttctacagtttatccagttattagatatatttctttgatatctagcttctatatgggttcaaaggaaataacattagatacttctgaaaggaggcagaagaaagtattactttagcgtattctaggccacatagtaactatttttatccagcaaaattatattcctctccaactgctttaagaatggctcagaagaagtttgaaatcatgcaaacagaagtaaaacaggaaataaatgataaaaattatagtgacaaatacttccaaatggagaccacttttatattttgaaagtaagtctgcttcaaagtttttgggatttttaaattttttattttttattttttttagtcaatgtaaaacaattttgggcaatgaagtaagactttgattcgcttttggcatctttagtcattcctgccctgtatgctttactatattctaaggctgataaaagggtagatatcattaagaaacatttgaaaatatgatgatcagccaacaccaatggtaatagaaccagttgaagagaacttttcatagctgaagactctaaatcatggcaaaatataactcatcctgaatgtttgcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacgtgagtctcacgttttgtttttagacttgtcaaaaactaccactggattcaatcatgatacgaatatatttgaaggaaatttcctacctagctacctgagcacatttttcaatatcctttacagccacacaagatttcccttaaaacgtgaattattgtagatgatgaaaaaatgtgaaaaataccctcacacgttaaatattccattatagaaataaagttagagaactatccttttgtaaaggctgtcctctcaaattctgtgccattaacttgtctttaccctgtacttattaatttaaacattgttttcataggagtacatcaacagcatgtgaaaactaaaattctgcttatttttacatgctttaatttataaacctctgtcattgcacagtgcaatgcaagttaagtgtgtagcattatgcttactctcttattactgtatgttctagtactgtatgttttaggtggttcataaaacaagaccgcctatccctgctcacgttctggtcattctaatctctctgggttcattttgatatctctgttcttgaacccaagtggaataagtaaaaaggagaatttttatgtaggactctagggaatgtctcaagaatctgaagatgtgattaccattagagtgtgaaaatttatgaaattcactttgggacagagactctcccagtgagatgacagaatgtagtgacaagaactagaatttggtgtctaacatgtgtttgagatctgtctctgccacttgctagatgtatgacaatagataaattacctatttaaacctcagttttctaatttgtaaaaggagcattcatttttgttctttttccatttgttcatgtatttattcattcatcaaaaatatgctgtgtgctcagcactattcttgatggtgaggatacaaaagggatcaaaccagtccaaggtgctattctcgcatggtttacaagctaatgaaatgagatagaaacttcaaacaaacacaaactctgacaaataaataagtgggattaaagcagctgacagggcaataaaatgaataaatagacaaaagtaaagtgacttagataaaagtgaaattctgattgggtggccaggaaaggcctctgagaagatgccagttaagctatgatttgagtgataaatgataagaagaacccactatgtgaatagctttaggcagagccttaaggttctttgcactctaagtagtacaaaaccttaaggtgaagagcacttaaaatattttaggtgtggaaaggccactgggtccagggcataggttctgagtaaggagggggaagtgttctggggcccaattacggagaaccttgtaagtaattgtgatgagtttgagttctttctaaacatgataagaagccattgaaagattttaaaacagagagtgatatctaatttatgatgttgtttttaaaaaagtcattctggcatctgtacagaaaatggattgtggtgggttaacagtggaagcagaaaagccagttaggagactatttcagcagtcaaggagagaattgatagtggctagcactaagtgaaaatggagacagaagtggaaagttttctgtaggcagagttgacaacttgctgccaatttggatgttggcaatgagtgggatgagagactaaataccaaatttctgcttgagaaactagggggttggttgtgccatttgctgacgatggcaaagagtcattggagaaagatttgaggatactcgacattatattacatttgaaaaatgtattacatttgattatattacatttgagaaatcttttagagactcaagtagaaataggctgatatctgcctagacagagagacctatagccacatatgtctagaggttgaaagagagattagggctagagacagaactgtgaatatttaaagccatgggcctaagtgtcagtacttagggaagatccacagagagagtagaaaaggtacatagatgaagtcctaaatcatccaacagttacaagttgacagagggagccagctaagcatgaataatgggaagcagcagcccatgaggtagaaggaaaacccagttgttaagatctgaatttaagaaaaaatgagagattcaagaaagaagatggtcaattctgtgaaatgctccaaaaatgttaaatttaaaaaagaataatcaagtgacattagatttaaccaagtggaggtgattgatgaccttgcaaatagcaatttcaaaagactagtggagaaagaaacccaagtggagcatgatgagaagagaataaaagtcatattacctagctcacagggccatggggtacattaaatggactcatggatgtaaagtgcttagcatagtgcctggcatatagtaaacacttattaaaactagatggtggtggtcattatcatcagcattataatacctgatgcaatagagtatgcagaattgagattggatatagtgaccactgattgcatattactacttttcacagctcctagccagcctccaaggatcatcagttcagtaaggtctggttcacgctatataatcacctgggatcatgtcgttgcactatcaaatgaatctacagtgacgggatataaggtatatacaaatagtgatgattaatgtttgcaattcttgctatttcagtgaaacccaagatgggtttcttttctttttttgagatggaattttgctctgtcacccagaccggagtgcagtggtacaatcttggctcattgcagcctccacttcctgggttcaagtgattctcctgcctcagcctcccaagtagctgggattacaggtgcccacacccacacccggctaatttttgtatttttagtagagacagggtttcaccgtcttggccagggtggtctcgaactcctgaccccaaattatccacctacctcaacttcccaaagtgctgggattacaggcatgagccaccacggctggccccattcaactttcttattctatttaatagttgtagagcagaatcagataacgtagtgccatgatacattttgaaatggaaaacattatcttcagtgaatttcagcaaaatgttatgtcaaaagtgtaagataagtagaatactttaaagataaaatagaataatcagagcttaaggaggagagagaacgaaactatttttgtttggcaatgattatgatagggttgcccagcacccagaaaactccttgataaactgagttactgtttataaatgaataaaaaggagaaaagcttattttaaatatattctttatatcacacactatcacatttttcactggataccaaattttatggaaaatggtaaaaataaaaattgagagacaattttcagaccatttcaatatattttaaaagttctcattttggacttttttcttaaaaagactcattctttctatatttttattttgggtcatctcaaaaaataaaattcagatgcttaagtcacatctccttggataatcctacaaacttgcaaaaatcaactattgtgaattgaaactaacatgatttttttcatctagttttaaatttagtttttcctcttgttttaaatttattactttttgttaatcaaagtataagcatttttattctggttttagtgttagagcattggctcattattatgactttactgcatatttacatttctgtactttataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtaagtgagtcatttaagacacatttcaactaagtacttgtgagtttctagaccctgtggattcccaagggtagggataagcctgatacaccagtgtccatattttcctaagtagattggacatatcaaggattccctgaaacttggtatttctcctcttatgagtcacaaaagtaagtctgtgacataccacatacttcttgattattatctggatgtcaaagcacagttgaaatctttcagacataagacgaacgagtttttgggatccaatatacagtatggaacatattagtttatttgattgtggtaatcattatacaatgtatacatatatcaaatcttcatgttgttcaccttgaatatatttaatctttgtcagttaaatattttcaaataaaaagcacaattaaaatggcataatttattgaatactatataatactaggctattatttaataataaccaaacttctatcaaaaggaaatacactaggctatttttaatactcttataactctttcacttggactatagatattgatatagtagtaaaagagaaaaacactaaattatagcccctttgtcttttctctttctctatcttatctattccttttctacaaactctatttctcacacctttgtttgatttggaaatacatatatttgaggcagtcatttctttttttttatttctggcaatctgttatttaatttttgacatatttttcttaacctatatgcatgatatagtttaattatactgaatttcaatagatgttaatttgagaaatgtatgagaggctttgacattaccagaagatcctagaacaaagatgataataaataatttataagaaaatttggttaatctgtacaacaaaccccatgacacaagtttacctgtataacaaatctgcacatatacccctgaacttaaaataaaagttaaattttaagaaaactaaaaaaaaagaaaattgaaaatttggtgattttgatataaagaaataaatatgctatatattaaaccaacaaaaaatcctttaccacaatgccagagtatttaatggtatttaataaatgctggcttcaattgtatgccatgtttttgtgaagtttgccacaatacatatatacatcctttacaaatcaaaatagaactttgattttttttagtttaatcatcagcaattttgtcttttaagaaaatagagaaattacagagatgtgaaaggaaaagaaaataatcatgttccaaataccctaaaatagctactgttaatgcttagttgaatttacttatagtcactctgtatacatatataatttcatgtttcagcttccatttttgtaaattatttaaaaattataaatgatattctttcaaacaaatatgcaaactcattaaagtttttttctatcataaataatacttttagagtccattttcataaattaatctttcttctggttaaatttaagacaaagtgttttaggttgctaaatttcttcaaaaacacttactaatttctattcctattatcattgagtataagtgcttttctcactgtaccactctaatattattgtctttttagtcattgctaatttgacaggggaaaatagaattttcttatttttgaaacattttctatattcagaactttgtcaacatcttcaatagttttacacttagtgggcagtttcacaaaaggaaatcagagggaaatatggccattatttcaaggaaggtaaagcacaaataactaaataaattgctcttgaaccctgggccttctttctcttgtgtagaagccagccacagcgagcttttgctctctgtactcacccttggttcatcattcctcaccgaaaggagaacctagcttctgggatttagactagaggttttcagcaagagatgatgtagcagtgatggtaacatcagtttacctatcactaatggcactggtaaatgttaaacagtagaatcactagggataggggaaagccctgtttataatgtttgcctgtttctgtggtgtaaatattctcattatgtgtgatttcaagctttccaagtgatgtcacttaatatggagctgtgaagagctacccagtagcacatcattatatgtaattgccaccatacaggtataataagaacctaaaaaacatttgacaacattataatatagtaaaatattaagaaatgatgggttttgagtatttactacatttgttttaagcttttaaatttaagtttacataaattctattttaataattacatttttaacacattgctcatacatttcctaaaaatttaacaattggatttcaggggttgtatcggttgatttcagcataccacagctgtaatttgatatttcagtatatatagctcatgtatagaagagtatttttttaatcccaaacttaggatatttttcatatttttctctttttgccaactaatggacaacattcttattgattttagaatttctattatttatctcttattctgaccataactgtacaaataaactgtagaattaacgttatgaaatgtcagatgcttggtgaataacaccattctagaatattcttgtttttaagtttggattttcaaatcatttaaattattttaatgaggcaaatgtgtaaatacaaacagaaattacaggtttttttctaaatttaaaagactcttagtactttcttttggttttcatgccctaaatacgtagccaggattataacacactactagatcttaatgtttataagcattatgctgtttgttcattcattcattcaacaaatagacattaaatgcctacaatacagcaatcacagttcacatatttaaaatgtgctaagatttacatatttccacatctctgcctggccctgctgcaattctaatgatcctcttgcctcccagtgttggcctctcaaggcctattatctatgcaatagacaggggggttttttaaaacacaaatcaaatcatataactctcctgttagaaagatggctcacagggaatggtgtgaaccctggaggtggtgcttgcagtgagccgaaatcgcgccactgcactccagcctgggcgacagagcgagactccgtctcaaaaaaaaaaaaaaaagaaaaagaaaaaaaagaaagaaagatggctcacaggtaacatctacatttcttactgtggcctatagtggtctatataatccaccctctctctcatctcaattaagtgctttgtccctttctctgttgacatttctcttcttgaacacaccagtgttatccctgccttgaggcatctctacttgttctcccttctgcctggaattctctggatcttggcatgttagtttcattctcatcattcttgtttctgttctgatgtcacttcctcagaaaagctctatatatggccagcaattaaggtagcaggctactctgagtaaatcttccttatatcatagcactgtttacttttcatcctaatgttagtaaccatgtaaaattatcttatttattaatttgtatttgtttatcatgtctctccatccttacttgaagctaagctccatgggagcaagctcttgtttgcctcagttgacctttgaatctccagcacttaggggactatctggcatgtagcagggttttaaaaaataactgttgaattaattcatgatttctgtatagagaaaagcccactaacaagaataacttgggcaacttaaaactatagttttcatctctagaaaactgatatacttccccattaggttcatgatttatattatttcatgtgctgatccgcaaatttgattcttaaaaaaataagacttccttttagacatattttggaaatatttcagatttgattatctgtaactgcacttctatctgacttgaacactgttatccattgctttaataacttattccttattgaatatttgtagtgcatatcaaggcaaatgtaacaccacaaatgtttcatcacacatatactatctctaataattctatattatccttcaaaaaccgtttttaataattatgagcaaattaagaaaatatacatatagctataattttcaatattaatttccataagctaatttggattactacatattttctataaattttagaatatcaattgacaaggatccttggtcataaataaatatcctcagagaagcacatatttaattatttgtagtgagcatgcatattttaagtctttacttttctttttagttttaaatagactatagatagctgaatcaagaaagactgcagaacattttagagtctgaacatttttctacggaaaagaagtagtcatttgaaatttttaaggtaggagtaacatgatcagattttctcacttggaaaatcatattggtgattgtcgaaaatatgtataggaggggactaagatataaggagatgaagtaccaggttattgccatagaatgattaaaagataatgatgtcctgggccgggtgcagtggctcacgcctgtaatcccagcactttgggaggccgaggcaagcggatcgcgaggtcaggagattgagagcatcatggctaacatggtgataccccgtctctactaaaaatacaaaaaaaaaaaaaaaaaattagccgggcgtggtggcgggcacctgtagtcccacctactcgggaggctgaggcaggagaatggtgtgaatccaagaggcggagcttgcagtgagctgagattgagccactgcactccagcctgggcgacagagtgagactccacctcaaaaaaataaaaataaaaaaataatgatgtcatgatgtcctgaactggaaagaaggcagtggtggatgtctagggtagattctaaaagagcaaggcattttttccatttgatttaaagttactatatattcattttgtgtattttgtcttctaataaatctgtaatttatcctgatattaccactgatgatgtaatctgtatatttaacctaatatttttgttaactccaagatattaagttaaactgtataaccaaacccactgacttaaacactgtgatggaaaacacattttgttgttttgctttgtcctctcctgccagtagcagaagaaggtctagaaaactattttttgggtagaacttttatatgtttaactccatcactactcctgtcctcccttctccatttcctaagtattgcagtgtaagagggacaagaggatagtaggatgtttagattcatttcatatgttattacatttagtctgtgattaagatacaatcagatattatcattcaggaaatgctgtctcttcaaccatcttgaaataaccaaatattttgttttcctttaccccatttttcatgggatcaatttgagtattcaagtatataaatctagcctatatattttagattgacaaatagcttacatttaaattacctctaaaatgcatattctcttcattaccattgaatcatgactaatcactcaaagccttgcctaaccacataaatgtacttagcactcccagttttgtaacaaacatgaagttggaagataaattatttggacaaagtaatattgtgtgagtctctaaattcaactttgggaggcaactcatagccttgatgattattaacataactcctgcagtgactaggtttgatccagcagttgttggacaactcccagcacagggagtttccagagccttaattgtccttcagaagctttgagtacaacttctagaagcacattttaatattttaactatatgtcaggccgtgaacagcacctctgtatctaaactaacctaggttttttcaaattttccctaaggtttccattagctgctaccaagttctcacaacaacttcaatattttattttgctcatttagttagactcagaaataattttgctgaaacattccttgatggaacacatgtaagaatggaaaggaaattttaaaataatcctccaagatgtactttctaccagaataattttcattaatgaaataaagtcttagcctccagagttatattttagtattataatgtgccaatgatttttttctacgataaaataaaacttactcttcaaacattacagattttcaaaaacattttgttctctagtaaattaattcattcaataagtgtctaaacaccaaccatatgtcaggcattctgctgggctattggttacaataattgcaaaccctcctgaagctcccattctaatggatatcagaagaataaagaaccaacaaacaaataataaaacaattagatttaataaaaacacaaggaaaaatgagtggctctttatatttttctttatatttaaagagaaaaacaggtacacaagtttttggtaggatgattaggtcaagcctcactaagaaggtgatgtaggctgaaatctaaaggacaggaactagccatatgacaaaagtgtgggtaaaggaagagcttgtcatgtcaaggacctgaaaggaggctggtgtaactagtgtgtagtgaggatacagagtcatatgggatgaggttggagaggtaagaggggtaaagttatgaacagcctggcattgattacatctaaaaggcaatactcagatgtttgtaatttcttgtaagttcaatagaaaaatgttgatgtgctttcaggagatgaaggacatgatctaatttaagatcatttgctgcttttgtgcagaaaatagattggagtgagacaagaggggagggagttgatagagctagtgaaaagaaagcaagtctgagacacaatcagaacaaggcactctctttcagaaataattaatttataggctactgtaggtttttttatgactctaagaagcaaagcaaatcatgacaagatcttttccaggataaatggttaaagagtgtatgtgaagactccagcttcttcttttctatgacttcccaattcttccccttctgccttttggtggcaggagagtctggagggaatgtagtgtccacatttttaccccagggagatgcaggagggcattgagagcaagaagaatgatgctgagattctgagagaaaatgcttcataccttctaaaaaaataaagagttttttatggtaatcatcaagactaacttagagaaccaagccaaatgtggactttttaggaaacatgaaatgaaatgaaagaaggacaataaattagctcttagcttctaaatcagtttcatggtatataaattgatatttttagtagcaccattaaaattatagaacaaaagctccagatgttgaagtgatatgatgatgatatttacaagcaagatttacccaagattcagaaaatagtgattaatataacctaatcaccaaggcccacagataatagtgtagccattatatttagttacttcccatattttcattttcagtattatgataacctcataatggatatctttgtatatagaccttttttctggattcccaattattttcttagaatgattgctagaagtgcaatgactggattaaagggaatgactttttaaaggcttggcatatacttgccaaactgtcatctaaacagcaatgcctgcattttatcattaaacaaatttttgtagcattttgtccttttaaaaatctttgttaagcaaaaatactatttcactattttttgttactattaatgtaaatatacagatgtatttgacagctgtttatagttccatttctgtaaaattctgttcatgccctttctatgtttcatgttaagaactttctttaaaatgttataatcaatgtataaaggaagattataaaacttttcctgccatatttgtgtaaatatttttccaggtttgtttttaaatgttattaatgatggattggtatggtttatttttatgcaaaatgatgaattctgattataaaagttcccaaatatttaacgttgaacataaacagaaagtcacaaaataatacatataaggtcatgcatcacataacaaagtttccatcaatgatgtaccacatataagatggtggtcccataagattataattctacacttttgctgtaccttttctatatttatgtatgtatatatatatacaaatacttgccattgtattacaattggctacagtattcagcacagtaatatgcttatgctgtggaggtctgtatcctgagagcaataggttataaatacactatgccttctaggtatagtcatatgttcgcacaatgaggaagttgcctaatgacatttctgtgaagacattcctgtcattaagcaacgcataactataagcccatttatatgaagtttaaaattagaaaatacattgatgtttaaaggggtttgtgtgtttaatacacacacacacacacacacacacacacacacacacacatatttatatataacatgtgaaacttcctcaaaaaattcagtccagtgttgcctctgtggagtgatgggggaattatcaggaagaggcttctggggtagtgcctgtgttctatttatttgcctggctggtgagtacaaaggcattgatggtattgtttttaaattatgtttttaggccagacatggtggctcatgcctatagtcccagcactttgggaggccaaggtgggtggataacttgaggccagaagtttgagacaagcctgaccaaagtggtgaaaccccatctctactaaaaatatgaaaattagccgggcatggtggcacacacctgtaatcccagctactcaggaggctgatgcaggagaattgcttgaacccaggagactgaagttgcagtgagccaagatggccaccacatgctagcctgggcaacagagtgagagtccatctcaaaaataaatgaataaataaataaataaagttttaaaaattactaatttacataatttattttaaagtggcaaaagtcaaaagaaggttgaagtagttgagtaaaggatagttagtttggcactttggaggtctatgtattagttttctagagctgtcatgacagtacacagactgggtggctttgttcattttctcaattttgggggctagatcaagatgttggcagggttggtgtcttctaaggtccctctccttggcttgtagatggccgtgtcttcccatggccttccctcagtgtgtgtgtgtgcaagcatgtgtgttgtactttcttcttcttataaggactgatttgtattgctttagacccactctaatgactttattgaaagaccctatcccaaatgcagtcactttctgaggtactagggggttagaacttcgatatatgaacttgagagggacaaaattctgcccaaacagaggtcattggtaggttcaagagagcaactttcacaaaatagtgtgggtgaaagtcttatttctctaagcaaacctcatagaactcacattttaaagcgaggaggcaaaataaataatatatagcaatacataaagttttgtcagatagtgatagtatctgaaggtagctgaggaaggtaaagagaggtgggagagagcaagggcatctgttttcactaagagtgcagggaggggcttattctgataaggaaatgcttgaaaaaaaatggaataaagtgagagaaaagttgaagaagttatctggagagaaggaaatgtattcccaccagaacagtacgaaagccctgaactggctgtatgtttagatgttcaaggaacagcaaggagaccagtacggctggggccaagcaagccatgaggtgaatctgaatcatagagttttataggtcctgattaaggactttagattttatcctaaaggtgatgagaagccattgaaccagtttaaggtgggaagtgacatgatcagatttatattttacaatagagcatctcaaccactctttggaagggaagtagaaatctcatgaatggtggtgcaaatctctgtgaatctctggaaacagggggatcagttaggtgatagtccaagcaagagatgaagatagctttgactagtgtactaagagtagaagtgggaggcagttatattaaggatttatatggaggaagacccaacagtattttctgatgattttatgaggtatgtgaaatggatatggcagaactttaaggatttagacagaccagcacaatcatctcctgaaacaactagcagaattatatattaaaacagaatcatctactgaaaatacatgaagaaaagaaggagtacttcaaattttgacaagctgagttcaatatgctagttcaatatgcctatgagacatcccagtggagagagagaaaaagagaatcatctagcaaaactgagaaagcagctgaggtcagatgacataaacttgtcagagaaccaactggcataattatataactttatttgcaatgcataccagcctggatggagatggaggaaacagagatagcagatgtttcttggtgttgcccaaagttggcaaatggcatggttaatataagtggagatcaaggaaaacaaggatttattacttctagttaaagaataattaaaattgctgaacagagtcagtattatatattatgaatattagaatattttcagctgttagtaacaaactctcaactcaactctcaactcaaaattgcttaagaaagcccctgtggaatcagtgtctcaaaaatataactaaagaacaatttttccccatttctccacttgagaggcctcagcttcattctaaggcttgttccctctgtggttgaaagattctgcagatgtgttaggaatcacacagaccctataatgtccaagaaagaagagggtctgtctcttttgaagcttcatcttcaaaggaagcccagcttttaacagaagctcctcagaaaaaccttccccataatgttcagaagtgtgtcaaaagtctttccttaaactagttaaatatcatttctataattgctcaaagcgatcaagattcatggctggtctgtgattgagaaaaccttccttgatgagtgaataatatctgaacaaaatatgaagagtattagcaaagaagcagagagagaaagattttttgcatgatgttcaaagttaaatagtgaggtaaataaacacagacataggatatacatttagagaaattagagacgaggaaattaggtcaaagagcagcttcataaaaatgcagagaaagttactttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattctattctctttgaagcaattgtgaatgggagttcactcatgatttggctctctgtttgtctgtgattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgactaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttttgcatctattgagataatcatgtggtttttgtctttggttctgtttatatgctggattacatttactgatttgcatatattgaaccagccttgcatcccagggatgaagcccacttgatcatggtggataagctttttgatgtgctgctggatttgacttgccagtattttattgaggatttttgcatcaatgttcatcaaggatattggtctaaaattttcttttttggttgtgtctctgcccggctttggtatcaggatgatgccggcctcataaaatgagttagggaggattccctctttttctattgattggaatagtttcagaaggaatggtatcagtttctccttgtacctctggtagaatttggctgtgaatccatctggtcctggactctttttggttggtaaactattgattattgccacaatttcagagcctgttattggtctattcagagagtcaacttcgtcctggtttagtcttgggagggtgtatgtgtcaaggaatttatccatttcttctagattttctagtttatttgcgtagaggtgtttgtggtattctccaatggtagtttgtatttctgtgggatcagtggtgatatcctctttatcattttttattgcgtctgtttgattcttctctcttttcttctttatttgtcttgctagcggtctatcaattttgttgatcctttcaaaaaactagctcctgggggctttaattttttgaagggttttttctgtctctatttccttcagttctgctctgattttagttatttcttgccttctgctagcttttgaatatgtttgctcttgcttttctagttcttttaattgtgatgttagggtgtcagttttggatctttcctgctttctcttatgggcatttagtattataaatttccccctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagttttgagtgggtttcttaatcctgagttctagtttgattgcactgtggtctgagagacagtttgttataatttctgttcttttacatttgctgaggagtgctttacttccaactgtgtggtcaattttggaataggtgtggtgtggtgctgaaaaaaaatgtatattctgttgatttggggtggagagttctgtagatgtctattaggtccgcttggtgcagagctgaggtcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgccatccccctcaagctaccaatgactttcttcacagaattggaaaaaactactttaaagttcatatggaaccaaaaaagagcctgcattgccaagtcaatcctaagccaaaagaactaagctggaggcatcacactacctgacttcaaactatactacaagtctacagtaaccaaaacagcatggtactggtaccaaaacagagatatagatcaatggaacagaacagagccctcagaaataatgccgcatatctacaactatctgatctttgacaaacctgggaaaaacaagcaatggggaaaggattccctatttaataaatggtgctgggaaaactggctagccatatgtagaaagctgaaactggatcccttctttacaccttatacaaaaattaattcaagatggattaaagacttacatgttagacctaaaaccataaaaaccctagaagaaaacctaggcattaccattcaagacataggcatgggcaaggacttcatgtctaaaacaccaaaagcaatggcaacaaaagccaaaattgacaaatgggatctaattaaactaaagagctcctgcacagcaaaagaaactaccatcagagtgaacaggcaacctacaaaatgggagaaaatttttgccacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacatgaaaaaatgctcatcatcactggccatcagagaaatgcaaatgaaaaccacaatgagataccatcttacaccagttagaatggtgatcattaaaaagtcaggaaacaacaggtgctggagaggatatggagaaataggaacacttttacactgttggtgggactgtaaactagttcaaccattgtggaagtccgtgtggcaattcctcaggggtctagaactagaaataccatttgacccagccatcccattactgggtatatacccaaaggactttaaatcatgctgctataaagacacatgcacacgtatgtttatagaggcactattcccaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggaggggggtgggatagcattaggagatatacctaatgctaaatgacgagttaatgggtgcagcacaacagcatggcacatgtatatatatgtaactaacctgcacattgtgcacatgtaccctaaaacttaaagtataataataataaaataaataaaaaaataaaataaaaaattcagagaaagagtaatggaaatttacagaaaggctaggatgttagcttcaaaatgcaggattgttttggattcaagaaacagaaattgctgacaagatggatactgagattaaaacaatttatgatgctgggtaaattgccaaggattatgtcaataagttgagttgtaagaattctggtgcaaacaaagtcagtaaacacaggtttatcctttaaaaatatattatttggctctatcactgttaaataacatttaagtagtcaagtagagaggaatatttaaggattggtttacatcattaatgacataaaaattgtaaatgtttttgttttgttttatattttagattagttattccacaattttgaaatctatgaggcaaatccttcacctcaaataactgcatttggtgatgtgttctaaatttagaatgttatactgggagggtagaatctggaaagaatattgctgaaggaactaaaattggaatctagcatgaggaggaactcccatatatagtgagtgctttggaaaaggacgtcagaaattaaagaaattaatcatttttggagaatgtaattatagtgaagaattttcggagaatgaaccaatagtcctaagggagatacctttattcaaagatgatttcatttttctgagtattgggtattagcaaaattttaattttactaaaaagtaatgtgtttctcttacctgtaagtataacaccaaggtttgagaaacttcgttgtaaagtttcaaccaatttatgatatatgcatgaataaattattcatgagaaaatggataatcttttacaatgatttatatgaagaattttaattattggtaagcctaattttgtatttttctatgaatgttgatttactaatgacataaaaagttacattaagatatctattctttacactcaagtggattgaaaacatcctgttcctaaggatgaactaagatacacctacccccgccccaaatcataggatattactttaccttctcttctgaaataagagcaacacaaaagttaattaaaacaatcagattatctttaatagatatatgcatcaaccatcagaacaagacttcaaaattcactttcctttgaaacattataggctgtgttgaaatttgtaaccctcttaggaaaatataaaaacaattgtctgttctgagaaagggagttgggttttaaattttctctcctgaggtttgacacttattcactataacataaatttgaaaaccatttagaaaggaaagtgactttgtgatttttaaaaataaaacccttgaaatttctcataaatattactggaagcctttaatgccatagtaagagggaatataaaatgcttaaactggaaagtgatatgtcaacatattaaaatggtccattcgatactacattagggaccagctttagtgatttatgaaggagcatttaggtctcaaagtaattcccatagttgggtaaggctagaagccaggcctcttggtagattcttcacagtatgagagcagtgcaaaggacattccagaggcagtttttatagacacattctgcaaaatcatccagaccaaaacaaaataaataatttagaacaatttcaagagtatgagattatccagccagtagtccttcttctataaccttccattttagggcctgcatacttgactctcacttctttttcttaaaaatgggctcaaaagcaaataatcagtcttgggtcacatggccaggagaagtaagaagagtgaaggttattgaaggttacagaaaatgcaggaagagtcgagggtgtggcagagtacagagactaactcctcaagtcccttagcccatagagatgccttagaattctgatgtgcctgaaagttgtgaatctttaggatatcaacatccatgtagatgattcatccaatgccatagcttcttaatttatctaacttttcttttctgatgatcttgtcctgtgtcctgcctcagccacccactcatgatcacaaccgaaacaggaattcacagatttcagtgtgaatttgaatttgagggatttctgaaacttggatggtaaaaaattacattataattttcatgaatttctaactgaaatttggcattttaaaatatatgaatttaggtcacatattactctgtcaccaataacaatcaaacatattctcatatatttcagctgttgaagtattacttcaataatacatttcttaaatctgctcctagatcctgttatttaatgtgttaataagcatactatttgaatgtgttagtaacttacatttggtttcttgatacttttataaatgaatttcaatacaataggtttttaaaaaactctatgtattatattttatgcatgtaataagagcattattctcagtattttcagaaatccacagaccactaaacgggtccatgacaccaaaaagtttaagaacccctgtaaatcttaatattactaataactgcaaatttttttctttaattttgattttaaatactgtgttctctgaccactgattcttctttttctagtttatttccttaaatctcctcccaactccagcagttcttctactttcccctacccagactaccagtgatcttattgcttatttcttttttttttttttttttttgtccttcattcatcctcatgtcctcagctcctgccttgaatgtcagctcagattccacggttcatattgaaaacaactgccctatataccttgtccctttccctctttatgcttctcacttggccaaacccaaactcatattaaatataactgttcacattttatgtgtccacatccaggcagaaggcagaagccatatgcccctaccaagatctcccctttgcattcccatcccccttgcattcccatccccaacattcaccctctcaccagcaccacatacctagagactctgagatataatctgttcatgcccttcagccttgtttatgacagtcacctacagaaacccaggagtctctgattaacacggatccaggtgcccattttctgacatctctattcatactttactcttaaaaccttcccactgttccctctaaaactcaccatcagttatcagtagagtcttctgtaacttccatctactcactgagtgcttccttcaccttttaactttatctgaagtcttgctctccctgatgacattgctccttctgcagtctattcaaaagtggtggttctctctcataccccttgaaggctgcacctggtggagggtagttgaccttcctttttgtcacttctacagtattctctttctctcttgcctaaaaagctctgcttggaatcataccatcaccctctcccacccatttccccttcttgtccaagttttctactagcctctagggccactcttactcattccatggagactttacttttcagataattttcattctttccaaatgacattggagagaatgccattctcttttatacttctttcataagttctagtgatacaatgtaggcataaatgatttttgcattactctgtcctctccatttctttctcttattgatgttcttcccacggttctaccctagcccttttcattactatctacataatctcaaacatcctatcctctgcccacttcctatctttactcttacctctggtactcagactcccaaaagtttttgacctatcaggaaggacaagccattgatctgaccactgtctgtgtcccttaccttccttgtatcctcactctttccatatccagcttaaatcccacagccatataatataattattcccttgcatagaccacccattccacccagaagttcccttttgctactctaacttcaccatactcacttggctaaaggagtggattaaatttaactcactacttgctccaagcctacactttcatggctaaaggtggccagagaagaatgccaacacgaacactggtttcaccttgaattcatgaccacaaaacttcaagtgggcccatagtgctgctgggccattccactagattttcctagcacatccactctttctttcacctagaaacctatttcacaccttctttttttctttcctttaatttctaacacatctttaccatcttctctctttagtcaatgaccttgcttcctatttctctgagaaataaaagcaatctgaagcagtcgacacctacacatacgcccatgtgacctgcctttctttctaagatcctggctgaatgttctatgttcctaaggacacccctccacatggaagccagattctaacacctctcgttaattcaagaatattgcttcaactaccctttccttcctcttctacatcattatatttctttttttctatttgatttttctcatcaccatacaagtattctgcaatattgcccacttttaaggggggaaaatacaaataagacaaaacaaaacagagcaacaattgaaagaaagaagaaggaaaaaaatgaaggaaggaaagagggaaggaaggagagaaagagaagaaggagagaaagagaaggaaggaaggaaggaacgaagaaaaacaaaaaaagaaaatctcttccagtaactaacgcatgttctattatcttctttggagtaaaattcaacaaataatttatcatcttcaccacctaattcctcttccaaaattctatcttaaatttgttccaatcagattttcaccacaacaccctgtcaaaacagctcttgtcgaggttgctaatgacctccatgtttctaatttaggagtagtcctctccttactcaagctctcagcagcactgatgcatatggccactttctctttcttggctttctgggcaccagtctgttttgatttttcttttccccttaagagctgccattctcagtctccttttctggtttctggtaatcattccaacctttgaactttaaagtctcccaggactcagtacgtcagtaattcttttcctcttagcccttaggtaatctcatgcagtctcgaggctttaagtgcatgacatgtatttgtagaaaacaatcaaatgtcagtcttctctgatttattcagctgcctgattgctatctccattcagacatctaatttaaactcttccccatctccctttgtttgctttttctgcagttttacccatctcaataaagtatctccaatcttctttgaagtaatttttggcatcattttctttaacacaccacattcatttcatcaagaaatcctgttggttttaccactaaaataaatgtattgagaaacatccacctctgctgctaccatcatagggtccagtcactgtgccttgtctccaggattgttgcactaaccatctaattgtgctcttcgcttggtgcttaacacctacaattcattcttaatataatgaccacagtgattattttaaaatatgtcagctcttctcatgtctctgcacaaaaacctttaatggcttcctatctgagaaggggactagatcatattcatatttgtattttgcctgatctctgccaatctgggtcactaccattaactccccagctcatgacatataaaccagtttctggaaaacataagcctgtttattttatttcccaatgtcctgcaaaatttgatttaactaattaagatgtctgtaatttttttgttttgagatggagtcttgctctatcacccagtctggagtgcagagtagcacaatctcggcttactgcaacctccacctcccaggttcaggcagttatcctgtctcagcctcccaagtagctgggattacaggtgcatgccactaggcccagctaatttttgtacttttagtagagacagggttttgccatgttggccaggctggtcttgaactcctgacctcaggtgatccgcctgcctcggcctcccaaagtgctgggattacaggtgagagccactgcacccagtcaagatgtctataatattattataaatttatgtatgtttttattatttatatgttgcattagtccattctcatactgctataaagaactacctgaaactgggtaatttataaagaaaagaggtttaattgactcacagtttcacaggctgtgcaggaagcatggctgggaaggcctcaggaaacttataatcatggcagaagggtaaaggggaagcaagcacatttgcacacagtggcaagaaagagagaagggggaagtgctacacacttttaaacaaccaggtctcatgagaactcactcactatcacaagaacagcaagggagacattcatccccatgatccaatcaccttccaccaggtccctcccccaacactggggattacagttcaatctgagacttgggtggggacacagccaaaccattatcatatgccttgattatttaacataggtatgttctctttttgcataaatgagaataatggtgtctacctttgatatgagccataaatgaataaattaaacctgtttttatatatcttaaacctttgccacccaattataaccggaagtatgagtgggaaagacaacactctatatcagcatttctcaaactttcttcattattgcctccctaggaagcctcgttacatattatttttccaagtgttaccacttatgaaattttaataccaaaaatctactgtatagctgtttatgttatgtggccctttagagatccaaaactattatgagatttcagattttcccaccccacaagaaccaactttcacttagttggaggccatgttggccctattgagaatgcatgctcggtggagattctcactcattccactccctggagacacagtaaattctatgaatcaatcagtccaaaccttcagtgagctgtgtttttagaacatattgctttgtgatcttttttttttttttttttttgagacggagtcttgctctgtcacccaggctggagtgcagtggtgagatctcggctcactgcaagctctgcctcccaggttcacgccattctcctgcctcagcctcccaagtagctgggactacaggtgcccgccaccatgcccagataatttttttttttattttttagtagagacagcatttcaccgtgttagccaggatggtttcgatctcctgacctcgtgatccacccacctcggcctcccaaagtgctgggattacaggtgtgagccaccgcacccagcctgttttgtgatcttatataattaattttgtattgaattgtactttagtcttatgctattggcttagactgagggcaattaaaaataaagtagagaaacaaaaccaaaaaaaatacacaaaatctactattatattattctacaattgttgaggatatatttctataaaacacatacaaaaatgtcctctttttaaggaactgtgaatgaaagttctctcaggtaggggtgaacctatagaagtgagcaccctggtctaggccaataaataaatatttaatgtctaaataaaataatttaatattaacattaaattagtcttgaaattcctgcatactatgtatttaatggagaagatgagatcttgtaagaggaagaatgcaaggaggatcacttctgtctaaactctggaacagttcatctcctaacatccaccccacacaaacacacacacacacacacacacacacacacacacacacacacacacaaagaaacctacagttaaataatccattctctgtgagcagtgtagatattacttattggaatgtattaaatagcagactcactctccacacacacacactctaaatagcttatcagcatcttccttcagtagagaactgtgggggtagaatactgtgataaatatgctttcccaatttcttgtatttctagtactgtgttggcatccagtacagtttatatcccggatatctgcccaactagactgttccataaactttgtctctggtcttaagaccagaagtagataagctcttcctgagacattacttgtttttatcttttggataaagacattggaaactcaatggctgatgtatttccgtgtttgcactgcatggccaaagctcagagccaaatctgctacatgcctatagcaaaatatataaagtattgtatattttactttaaaatgtctgaatatatatgcagtggctttaaaaagtgcctggaacaacacagacacaataaatattagcaatatttgtactagctttagttgatgttgctgctattttggtattacctcttattttgtatcatgtttcctaactttatcttttttcctctcaattttcttatttgttttctttatcatactttatctatctttgtaaactatcagaaagtctttttagaatgaagtagcctataacttataagtaaatatttatattttatcccccaaagaacctggcaaaccattttgactcagtgtttgttttttcaatttaactagcaaaaaaagttctctagataaatactgttggattacaatatctggaagacttcaatagtaaatgtcttaagaacatttatttatcctcaagaactacaaaacatgaatcggatttccagtatatgctttataattaaatttaagccaaaaagaattcttgaaatattatttaaagttataaagaatgcatctaaaatgtgagagccaataaaatctaaagagaaaattcttaaaataaaatggacacaagaagaaaaatgaattaaaaagcacttacatatttagtaaaataaatgtgcttagaaaatagagaactggcatgtgtgatcctaagactacatagatattataatccaagcagaagtctaaaatataaagcaaaccaatttgatagagaaatatttgaagtagaaaaaataatgatgccatcacatttgaaaaatatagtcttcataattcttacattctttcaagtatcccaagtgctttcgtgacattatatagtctgagtttatttttagaaagccttggtttttataaataaaaagacattctttctttttatagagtcactatgaatggctgactaaacttctaaacatataaatacactgccatggatatatgatacccaaaatgaatttgatgtagaggaaaaagtagttcacagacaaaatttatttagattttgtctctttcatgttttcactaaatatatatatatatatatatatatatatatatatatatatttgccaataatgcagtgtcagttctttataaggtggcttattcctggaaactcttgttattttgtaattttgttaattatgttgccctttatattgatgatttagatgtttgaacatatcttttgtagctctctgcagccacatgttattctttttgcttttgctcctgggactgaaaactgtcgtcatcaagaacttttaactaatctttaacagattttaaaataactaacatatatttaaatgtcattacaaataatataatgctagctcatatttattattatacttgttgaactttggattcagttaaaggaataaagaattatttaacttagcattttcttactctgactttttaatccttttttacccatttttaaaataaatacagtgtaccactaaggcaaaagtccccaaaactctattgtcttcttgttctttcattctttaaaaatatatattgtatgccagctcttaattgtgttcatggaaacttgtaaaacactaatcaatattctataagccagataaaataaatataaaaggaaacattttatatctgaattttagaggctaattccctttcctcaaagaaagagaagttatattattctcaaattaaagtgaaaatgagtatgctttcttattgctacttgattatttaggactatatagtgccttaaagtctctatactatcctttctggtataagatttatttttctaaaatttgagaatgataaaattagtaataaattttgctaggagttatagcatcgatattgggaaaaaataaggcaactatattacaggcactagtaaacatagtattatacatatttcctagaacatatttgactataaacatttttctacaaattaagtagatattgttgtcaatgcctaatatcttacctatttttcatggaacataacatgtatgaggcaaggttagttatacacaagatgaaaaatcatggtgaaaatatgattagagtatctgctttagcaaagagagaaatggtaattctctcctcattttaaacataaacaagtttcctatctttataattaacctattgataatataaaccaaagcacttatcacagaacatagcagttgctcaattattttattgatcttcagcagttactaatacattctgtaagctagcacacaaataaggtacttcacatagaataatgtctttaaattacactatcagttgccatgtcacatttaaagaactcattctctagttattagatgtacttgaatgtacttatgtgatttagagaatgtcaagtcatgcaatatatttttgcaaatttgatgaattttcatttatatgtgttaattttaaaatattgtttcaatcatttaatatattttctacacagctctgctgcatggtcaatgaacagtatgtcatttgtggtttatcgtcagccatttttaattagacgaaatccaacattgcaagttttaaaactgaagattaggcatcattccaagtagcaaatatttttgttttggttttcttctaggttaataacttctctgacatttgcacaactgtgtttgaaatatagtctaatagaatatgtatttgccttctataaaattaatgtcctagacgatgataaaatatgttgaagttttaagggaattattttttttattatcttggattggtctatgaattaatgaaatggaaattaatatacatgagaggatcaactataactttacattaatttagagtattataagcagtggcttagaataagagtttactttttgtgaatatccaggataactttcactagcttctccctttttcacaatgcatttcttggtaaatattttgttatcatcacgacagtgggtgtttctaaaacccattcatatattttgccccatctcttcttccttagtgtgttttcctcctcctccaggaaaccccttttctgctgccacctggaagtaccctcctttttgctcccctcatatctttggcattctaagtgcaattgtgtttaccacaccgtactacagttgtggtttactatcattcaaccaagatctcttgagaagaagaaaggccatttctgcacccagtactgaccacagaagtagtgggttcttattaaattgaaattcatgaatggaggtttggcagttaagttttttcctgttatattaaaactgagaagcaatcctaaagaaagaaaaatgacttggatagaaactcacattttaatcacatttagatggttcctgcccacttagttaaaacaactagcatctttatctataagttggatcatgtcaatgtacctttctcagcagtgacttcctctctcttccctctcagcttcccacacagggacattacagccacggatttgctcttactttgaagaagcacgggtacctcagtacctagatcttcttttgagtttgcacaaccttggagatgcagagtagttaagttgtagtcagaagagccctgattcctcccggcttggattaagtggtaccctaaatcctaaataccttctaatgccctttagtctgggcctggccagatacttctttcctgagtccattaccagaaatctttggaatgtggcctgcagagaccacagacaattggcactcatttttcaacaaacaaagtaggttagaaaataattttccagctataataatacaaagagccaccaatcatgaaatatttatttataatagcaatgcactctgtatctttgttaaaataacacaattagctaattgttactatcaccattttactgatgaagtcactgaaattcagagagtttatgtaacttgtccaaagtcctacagctggttaagctaggagccagaattcaaatgatttagttctaacactaaagcatgtgctcttaatctgtatactatgttaggatgggattagttccatatggcaatttttagcaagaacctgatattgggacatgacatagcaacaagagaagagaaacagagatacccagaaatacacaggtcattctataagtaactactatattgcagaataaatagtgaatgccagataggcacagctaaaatttctagcactccaactccaaaccaaattttgttaactatttgggagaggacctgacatagcttctgccattatctaaacagacagaatccacatgattcttggaggaggaaaaaattaaataaactcagattactttcttttaatcttctagactccatccgtacaagtggaaaattcatctgactcagttaaaactaacatatttaaagcaccaattatatagtccaattaaagtattatctaaatataacatttagatcataatttattatattataaatatttggatatttataaatattatatttagatatttataaatatttataatatttagatatttataaatatttataatatttagatatttataaatattataaatatttagatatttataaatattataaatatttagatatttataaatgatatttataaatattataaatatttagatatttataaatattataaatatttagatatttataaatattataaatatttagatatttataaatattatatttagatatttataaatattatatttagatatttataaatattaagatatttatattataaatatttagatatttatattattatatttagatatttataaatattattataaatatttagatattatttataaatatttagataatattttatttcctctaaagaaagagccatgtattcctggtccaagattatattctaaacacaggcttaacttaaaatagaccatgatcactacaaaaaggaagaaaggtgataaataacacttaaaaatctcacatgtacattagtagaccctttacaaggaaaatattattaaagtttaatgtgcaactaatttagctcggtgaaatatttttgatatgtattaaaaaatcaacctatggctagctaacaatgtaattctcagaatatgcaatatcaacataagactctgttcatatttctgaattaagcactttagtggatattggtttagatgggctgattgcttgattttaaatcttatttgatgaatttggaatggaagattaagaaataaaggtagagaggtatgattggagtataagttatatttagactgtgaaaagggagaagattaagtttgtggtctttgctttttgttttctggcgttttggcgtgattttttttatttttatattttgcttttcttatacataagcatgagatgatgagatcctaaacttctaatgcacaggcaataaaggtgaagagtcgtgagagattctagagctatactggagatcaaatcagttggacttggcacccaagttgatatattacaggcgaggaagaaaaagcactttgcaaatgacggcattttctattatgaataattaagtgcatggtacctcatgaactgaactaagtagtgcaggaggatggacaatttttataggagtagtggcaggaatagggagtatagagggagagagaagtggtcctgtgacaaacgcaagaacctcaacatggaaaaacaggtaaagtgaacaagagataaaacaatccaggtaagacatagtaaatccaaaatgagtcaatgctcccaagcttctttttaggtttcctaacatttctctcaacacctagaaaattcattatgaattacttcatacatgttactatatcatcattgacaaacacctaaaagtccctgtttccactgtcaagataaatgagtataataagacacaagtcttgaaaagagaaaaagcaataataaccaaaaattgtatgatggaatgaataaaagaagcctggcaatactgatagaaatgctggtattgaaggaatttcagttccattcacttgtgggaatttgatttgttcaatgtaaacaaaatggtttcttaaagaatttcccagaattccaaatggttagaaagaagtaactactctgctgattttataaataaactcctgcaaaagtgatgaaagttaatctttttttcccctttttttaacttaaaaagaatttgaaaagaacttaaaatttcaaggtttaacaccatgaaactatgactaaggatgagccttttcagaaaagaaggaagtctgaaaaatatataaacagaaccaaggaaattctgtgcagatacaatccaaggtgattagaattattttatatcttcaggttgagaaactgaacaagcacaatctcttagaaattttttagactagtcaatgtccaattctagccagtgactccttacacacttcagactatagttaaaatagctgaaaaattatttctgctgtgaaagtacaaagagaagattcagcttgttatgatcctcttaatagtttcagtgattcaatgaatttggacaatttcttataagaacttcatgtgcatatagcaaaacagagagacaccaattaatcctttttgatagatggatgacactgaattgtgaaataaggtcccaagatctaacaaacaaatgaattcaaggtcataaaaagaagaaaaatcttaatagcaaataccaaataccaatacactaggagaaaaatcttaataccaaataccaaatcttaatgcccttaataccaaataccgatcttaataccaaataccaaaatacagcctcaaacaggtgaatcactcatttgtcatagcctcaaagccaaagatgactgaagaccaacagaactttttgccccagttttatcctgagaaagtttccagggtagttctgtctctgcatcaccatttgaaaccagtgagagaatgggattattggctgtcattgctattgaggcttttagaaacctctagtcattttcaactctcaactcattacattaaggaaggcggcatcactgcattctctagtaatgtttaaagatgtttatgaagcagccaggatgtagaggaaatagtactgggcttagattctggtttatgttcaatacctaagtttactgtcttttaggtatgtaaatataagccctaggtccctaatctgtaaatacaaataatgatacatactttaactgtatcttataagaatttagtaaaataaatgttgtaatgtgtcctagacaaattaggcacttactaagtggtttaaaagaattaaaaaatccattgaacaggccaagtgcagtggcctgagcctgtaatccgagtactttgcagggtcgaggtgagaggattgcttgaatccaggagttccagaccagcctgggcaacattgtgagaccctatatctacgaaaaatataaaaacttagctgggaatggtcatgcatgtctctaatcccatctactcagaaggctgaagtgagaggatcacttgagcctgggaagtaaaggctttggtgagctgtgatcgcatctttgcactcactcaggcaactgagtgagtttgtcggaaaaaaaaaatgaacagatatttgttaatgacatattatggatcaggctgtccagaatcttatgaataaatgaaataattttaaggaaaattgagtctcatggccagttagtttcactctttctctttattgtcaatacccacaaacaccagccagtctccacaaaaaaagagaagcaaagcaatagaacgagcaatttttgtggtgggggatgattgcaagggacagtctttctttgtatgtaaataaacccacagggccatgtatctgttgaaaatgtccaagaagtcctagtcacagtgctcaactggtccttcaagacttgcactgaagaggaaccattaaccttggcatagtggaacatgtaaattttcaaactttctctctggttctacttgtctctttgcctcaaaaactaatttggagaaggcaaggtagaggcagtggaaggaataatttagcacttgtttttataagtatggcaaaatggaatgggcatttgaagttgccagtctttctaactttgattgaggctgagaaaagttactcctggtgataactcagtgtatttcacaaagttggggctgtaaatgtgagaacattctgtcaaatagctatttccaaagccaagtgcacagattacctaataaactggctctggttgttggttaattaatcacaaattaaaaacttgaatgttatttataaaatattttgtatacgttgggaataaaacaaacccatgaaacccattatacataattctatgtattctatagaacagaacccagataccaaggtctgagtctcttctgtcttattccagactgagtatgttctcactaaatactcactaaaaaatcaaatatctttttaaatgaatgaactacatttaatattgcaaattcacaattcatagatggtttttactttgcattttaaccccattatgtaagtattagactcccaattttacaaataagtaaatggagcacagagagatttagtaccttatgagaggccacacactcaagtgagtggtaacagtatgcagatagaattgtctcacctcaagtctcatgcttttgtgtaaatgtcaccttgcatttctaaagaagtaggtaagccagttttaaaagtcctcataattatggtctcaccttgccccaaaatatcaaaattgggcttgttgagcatgtgcttattggccagcttcttataaaagctagaagttgcttttatatttcccagcaaatcaactggtcatcactctattggaaatgctcactcctttctcaaagaggaaatgcatcctggtgatctggtgttttctgacagggaaagggccagagtcaacagtaaggaacaaatacaactgccaggataagctgccagaaaaccatgtacctctgccaaacaaacaaagatctattttgcttggcatgtgggtttgggttcacaattgccaaacgaataggagcagaaagattagtgggcttcactggatggaaaaacccaccgaagccactagcacttagatgatcaagcacttaatgtatatttataaactaatatcaactttgattagcataaataagggaaaatgtaacaaatatgtttgcaaattttatggctcaatgcttgatattctcaaatatattatggtttgcctagaattacagactcagggctgtagtaggaaccttaaaacttataacattaaaccctatcattttacagaaggaaaatccacatccttgagaagtaaaacagccaaagatcacagaagcatcagaaccatgtcttgagcccaaatattctctgttgctaaagttatataactagctattgacagaactagaggtaggtcttaagctgtcttttttcttctctacctagcttagtatttgagtgttgctatctcaagtaggcaaagggaaataaaatcatcaaaagcaaaataagcaagctgatacacagacaatatcataaaatagatattttagggaaaaaacaaaaatcatcaaatgtgcaaaaattctgctgaacctcaaagatcaaacccattttattttctgatttctctttgggtctcttctttagaaactcttaaaaccaattagtgtgactatccattactttattttgtcaaagtcatgaagttaatgcttataataatctaaaattgaaaattacattaacgttttccccaagaaactggtttgaagccaattcagctaactttctaaaaagacacctcctttgttaacattagaccattcataaaaataacaattttgatatatagttcaaagaaaatgttaacagtaacctcactgaattacagcagtgttactgaaaattgtatgctagtttccaggcaagtacaacttttctaccttacagatttgcaagttttacatctcaactctagtctatacttgcattgttgataacatttagacaggatggaaacctggaaagaaaaaaattatgcaagagaaaatgtgcaaggagaaagagacaaagatgagacagaaatgctaaaaatgaatcaagcaataattcaaagattcctttgtttcagacatttcataaaatctcagttaatacatttaaaacatttgtttttacctcaatagcttcacattgaccaagtgttaattcaaggaagtaaatgggactgcatgaattttttaaaattatcattgtcagaaaattaaccatacaataaagtagatttcagtgtctcaaagtaaaacatacctcttcttcttttaatgtttgtttttatatatttctgccacaaaatttaataaaataaatacctaactgatttcctcacctagttctgacagcaatccaatggagaaacaaacacaattcagtaatttgcagaatggaacaccaccagtaaaagaaccccagaaaattcccaactgattagactaagtccaaaacaaagctcttcaccataaatttaccattttttcagacaaattcttatgagtgactaaatttgcaaagtggcaaactcacaccaggcctttctgtacaaataaataagataaaaaatgctgaaaaattcgaacgctgcacctaccttgactgcgtcccagtggttactcataaaaatggatccagtactctgacaagttcactgaaagtgttgtcttcagtagctaaagagagcacttgcttttcttgtgttgattagcctcaagcaattgggaaaatagctaaaagctgagaaaggcaaattagagaggttttaaatgatacaggtgagcaaagtcctgaaacacgtttttccaattaccacaaatttaccagaaaacgtacttttccacagctatgggcagaatataattcctgtgtgatggtccttgatagaaagttactgtggtcaacaagtttgggagatactgattatcctctgttgctttgatgattctcaacatgcatttatttgcactttttagatgagagtagtctcttttttgccccagaactcctcttttgctcctggatccacacagccctttcactgggcaaagtaccgttcctcctgagataagaatgaaagctaccatcttcttacatggccctgcttccttggccagagtgattggttgagtgatggaaagcttctccaaactagttcaatcaaagaagccactaactcagccacagttattggtctggggataggtgtgtgacctgatgtttgcaaagcagagcctttccttaagaatttttcattagtgttggggtaaaacgatagcccagtctgtttgttcttaagaatacgtgatgtgagctaggagctcatatctctcttgagagaagtcagtctgagaatgtgaggcaacaggccgggcgcggtagctcacgcctgtaatcccagcattttgggaagccgaggcgggcggatcacgaggtcaggagttgagaccatcctggctagcacagtgaaaccccatctctactaaaaatacaaaaattagccgggcatggtggcgggcgcctgtagtcccagctactcgggaggctgaggcaggagaatggcgtgaacccgggaggcagagctttcagttagccgagatcgcgccactgcactgcagcctgggcgactgagtgagactccatctcaaaaaaaaaaaaaaaaacaatgtgaggcaaattgtaaaagaacaagaggtgaaagccagagacttggaagatgcaggcattcaattatctgctccagtgtgcctgtaaaacatcagctgttaggttggggttctgtttcttaaaaccaaagatccctgactaccatgctacacaaacactggagctggaagctagactcttacagaaaaactcagtatgcccagcttatgccattgtttgctttattttatccaactacttttccagaaatacagtgcaggtctagaacaagaaataaacttcatgaaatgtagtaggaattgctaccatttactgggagttatctattaatcatgcatttctgaaatgctttacataaagcagttgttttcaaaccgtgataagcagagtcccacatgttccatggggtgatagagttgcgggaagtacaggtgccagcatgaaaatagagaagacaaaaatctggtggtttcctgctcttaaacccatctttgagtaaagcatccccctttcacccagttcaataatggatttccacatataattacttctgaagaaaggttatgctacctctctagatagatagatagatagatagatagatagatgccatgagacatattattatccctattttatagttgaaggaaaaaggtttaatttttttttaattttttcaaattaaaaaaattaaagaacatgctcaagattacccagattatgcagccagtaaaaggcagaggtagagtttgaactttgctttgcctgtttccagaacgtctgactcagctgccatgtgatactgttcccaatatatccttgtggctcctactaggacaggcactcattgcttgctttattttatttttttatttttttgagacggagtctcgctctgtcgcccgggctggagtgcagtggcgccatctccgctcactgcaagctctgcctcccgggttcacgccattctcctgcctcagcctcccgagtagctgggactataggtgcctgccaccaagcccggctacttttttgtatttttagtagaaacggggtttcaccgtgttagccaggatggtctcgaactcctgaccttgtgatccacccgcctgggcctcccaaagtgctgggattacaggcgtgagccaccgcacccggcctcattgcttgctttattgatactcatattagccagcttgtcctgttaaaattaaatagccaaagatcaaacagaaacctgtagtccgacaaagccagagttattgactggatgtagcaaggaaacacacaccagagcaatcatggaataccatgcaggtgcgaaggagaagtgtcttatgtaaggtttgagttcctgctgaagaattctgaggagggtggaaataaactggcagtcagatctggattagttctgtttctgaagtgggaataggagaagcaggaattaactagagctggggctgtcatgaggggagtgcagtccagcaattgggtattcccactaataggtgggacaagaagagcagagctggggcatcattggtaacagcaccatccacttggtgaggaggtcatgatggcattctacagcagctctgtgatcttggtagtgtttcctgtgaactttacagttggcattatccatgtctgtcatacgaatctgaataaaggttttgttatttttctgcctcagctgattttcactctaatcatagggatgtttttactctttcagttctcaaacgtgctgtcccagcaggagttttattgaactcaacaattttcaacgcaagcatccattcatgtgtacctaatatacctcatatatattaggcacacctctaggcagtggggaatcaaccatctaataaaaacactttcttccatatggccagggccattaatagacctcggaagaataaaaaataatgtcggaccaggactagttggaggactcctggactgagtagtaaaatcattgccttctgatattatattatgaatttttaatattatctctttaataggaaaaaactattttctgaggaaaagtaatcataggaaggtataacccctttctttgtccaggttcctagaagttagagagattatgcaatatagaataaaataaaaagaaatatcaggggtcacactgaaggtcacagtggtttcctctaaccatcttcttccttagaccccctgtgctctgtaataagaaaaaattcagggcctacaatggaggcataactcaatcatttaacattataggttgagtactttctatgcactaggcttggtattagtcaacacagctaaaacataatttggatatcatctctgtcttgaagttgttcataatatagagatattagcagttgtggtcacaaaatgtgacaccacaaagagaaaattctaaatgttatggcatcgtcagcaataggcaagcagtagaaacaaagactgcatcacagtgtccagattgaagaatcagaaaggaagtttgtattaaaaaccaagtagagcagttttctacttatcagaaagcctgcagtactgctcaacttttaattgaaatgtctgttttcagcatcactctccatatagcgggaattctccctgaaggaagtatgaaatcaaagtttagatttaaaaaaaaatcaagaattcccatggaagagatatagtactccaaattggttttacatttcttctgatagagaaaaattattcacaagatcaatgatttgttcaggtttaacattcatcagctatgtgaaaagcaaaatatgtgtttactatataacacataagtaccagaattatgattgatagcagtattctgatatatatgttgttagattcaaaaccaatatatattgaaaaactcctcaagaatatatgtcatttaaaatgacattagatagtacttcaattcggtctctaatttctgtttggaatgtgggatagaagtaaagatgaagaccaaaattacataagcttgagccattagagaaattaaatataacacacgtaaacatggagagtttatttcaaatatcctgatgtcaaagccacaaattatgaaattgtatttggttttcatactagtaccaaaacatcaagatggcatccacaattcactaaatttctttcgagcagccacagtttgtactttgccaacccacatattcagccaagtacataaacatgtccccatgatagatgtaatttgtggtcaaaagacagagcattgtggagaccctgcagtcatcctcagacaaaaaaggcttcagaatgatgatttccaattcctatcacaagaacaaaaaaccaaacaccgcatattctcactcataggtgggaattgaacaatgagatcacatggacacaggaaggggaatatcacactctggggactgtggtggggtgggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaggcttcaggatggatcatttacactgggtcaaacattgacgtttaaaggttttactgtgtgattgaggtttattattgggcatcttatcagaataaaataatgtgtggtctgtggcatattttaaaaaatttgtagaaaagtagaagataaaaaaaattacaagaatacaaagatctctttgaaacagtttatgtgttagcttttttccatatgacatttattattttccttctgtgcccttgccttgatacattaagtgcagagcgcagtttccttctgcatttctaaaaccagtcccttgctaaagctacctgcaagaacacggcagagaggtcaaaagtgcatggcctttgcagctggacaaatttgaattctaatcccttctctgccctctagtgactattggacttgagcaactcattttacctgactcagttacaaaatatataaaattagggtaaaagacctaccattgtaggttgttgtagtcatgtcataatctacataatgagccaacatagtcttgtagctggctgtagggcagtaagtagcatctctcaaagtaatgataagtttactattgttattgatagtgtccttaggagctctgctacttgagggctgtttatattccccttgttatctgccctcaccttttgaccctcactttcctgctcatttctaagaactactttatctgtatccgataaagctttccctcttatgtttccaggcagctccaaaagccccaggcagggcaatgttgaagacaagcaagcagacagacactattatcttccaccttatagggaacatgaatgtgcttttaatgaccagagattcaggagaaatgcactaaatctccctgaatataaaaggaccatgccaaagaatgagctgtttatggtcacttttaatgtgatagataataataatttatttggtggtttcaaatttagagagtaaacttccaaaaattaatgaaaactgttatattagtaagccattgactaaattttttaggtcttcactcattctagcagcatgttcattgaagatagtgccagccaggcatggtggcttatgcctgtaatcccagcactttgggagactgaggcaggaggatcacatgggcccaggagtttgaggctgcagtcagctatgactgaaccactgcactccagcctgagcaatagaacaagaccctgtatcttaaaaaataataattaatttatttaaaaagaagatagtgcctaatagttgtggacattgggaagaaagagtatgactttttggtcctactttacaatagtttctcaaaaattctcatgtcggcaggacacggacccataaacttacttgactacaggagtagcccttctaagtgtcacccaagacgtaaattaagtccatagcatattataatacatcatttcaatttttaattcacagtgtaatatctcagggcaattgttctttagataaaaattgaatgagattatttaatatcagaaatacattacttaagtcattctgtataaatgtataaatgtcttaaaaccattgggatgtgaaattatgcaagatttacctagcatacctatgttgtcattgtttcaggaaaaattattagtatttttactgtatctctttttttacattttattattattatactttaagttttagggtacatgtgcacaatgtgcaggtttgttacatatgtatacaagtgccatgttggtgtgctgcacccattaactcgtcatttagcattaggtatatctcctaatgctatccctccccactccccccaccccacaactttatcttatttttaaaacttacttttttaatgcatgtatatatgtttcttgacattttgccttctggtaggaatttgggactgctggatcatagggacagcatacacatttgtgatcatattattttaaatgattaatcatgttgtgtaaacagttcacatggtctcacacagaaaatctttgatcaaaagcttttgtttttcttaaatcatgtaagaataagagattctgttttgtgaaaggacccatttgttttccagggctatgcaatctcgccttagctgaagcagactaaatgagcaatagtgacatgtatcaatgaaataatatgcacacttttggtttaccttgcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactg

SEQ ID NO: 23 - DNA, 91060 bp, Homo sapiens
agtgttttgaaatgtgcaaagctttctagaaacagaagttcttactcaagtattttcccgaagctttggcaagataaccatttttattaccccgtctgtgcctagaatgggcctataagcgccacaatcagaatcattagatatagaaattaagagaaatgtagcctccttttttttgccggtgaacagagctttggttaacagaaaaccaaggcgattttaattgctggtttttctatttgaagggggaagttattagtagaagtctcaattcagaaacttcaagaagaaatgggagggtgtggtgagggtaagcgggggactgcatttcctgttttcctttcagatggtgttggaaaacattgcaggaaaaccatggatacccacgaagaaattccaaaatttattctttttgacgccaagggcccagcccaaaaggtgacgagtaggagtggtcaatttttttttttaagagttggggcttgcaggagtccagctaaacgcttgtagggtgaagacagaattcagagggtgacatcagcctgagcgggggccagaagaaacagagtggaggagtctggtttcatttacagttttgggtcagttctgcagtgaggagggggagaggaggggtccgggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggtaagtgtgatttctcttctgtttttccaggtttggggctagaaggaaatgctcttaacctgaagtgatcctttctaggtagcgttagtggctcttacgttcatgctgatcgccagttttctgtacatgttttaggtctctggaagattccgctgatttttctttctcactttatggcaatgggatttccttaaattggttaaggtcatgattgcctaagagtgtgagcacttttccaccgcgtgtctgtggctgctacacgcgccctgtgcattccgggcggcagtgtgtttcggcccatgatttatttaagttactgccgccttctaaaacccattcgggatccgctttgtttgcagaagcgtctttgctgaggactagcatagctccctgccgggcggctccgctgggagatgttctctgagctctctgggtggtgacactaggtcagggtgcaacaacctgcatgggttttctgcccagggccgcccatgggaaggtcctggtggagcacatttgctgctttcacaagattggagtaactctggtgctcaggatcagggccaagtaaagggtcgctcagtcattgccgtcaagctttcgtctttccaggaacctgaagtctctattggagactttgtcccttggggttgcttaaaggagttgcaggggtcagaggagaagaaggaattgggcatttgggcagcatgctgagtgtctaaggcagggcccctggggctgcagggccagcccatgctgcacagaggtgaggccagtgccgagctgggaggccccgagggctgttctctggcccggaggatgcagggtggggctcgggccctctcttgctgaggatggacacgttcgctgacagtggccagcctgtttggggaacctgtttcaaggggcctactatgttggataatgaacgggtattgaagtatgggtggggtcactgggagggactagggagtggttaaagaaaaatctgcttccacaggaagccccaggagccagtttcgaggccggtgcagaccccaggagcaaacccctctgagcacaggggagtctgctgtgctggatggggaggcagggctgtggccccggctgactggcttctctccccacatacagctcaccccggcgaggaccacagggtgctagagctgcagggtgctcagagctcacggggatggtggatgctcaacctgggatcccccagctccccagggtcccattcttaatgctgtaaaaaacaaccgaaatggctttaaaatcaaagttacattgctcctaagcaaaactatattgaaaactgagtgggtggccgttgatgacattactgggacttctgaggtttttgttgggctaaagataatggaagagatttttggtcagaagccactgatgcagtagtttcctggttttcaaaatgagcaaccaggggctctgagatgcggaattccttgcccaggccagggagcgagtgcctgagatggcagtgaaatccttccccattgaaggagagcagacaagccagtgacggaggatcccaaataactcacatctcgttgggaaaactgctttgggctcactaagactctaccaatgaaccgagaaagaagggaggtggaccgtggggcgggggcatcggttccgtgaccggaataccggggctggccgccctgctcaggccacctcctgggggtggagggcgctgaaggaggggacctgtatgctcttctttctgaagtgggcttgtagctgaggatgaaagcctgggtggggaggcgtggcttttacaaagatcaggatgtaggaacagctgcctgtctggacttctttgtttagggggtttcttgctacccagaggtttagttctctcctttcctcactcatggtcgagagaagccaggaagcagacactgagtggagcagagggcttgggaaggaattccatgttggggtgaagtgaggctgtcctggcttttcctatccaggcattggagggtgtggctacagcacctttctgggaggtggctggggaagcctctagaatgttagcccttggccccgctctttccctgcttggcagggagcgtgttccaccccactatagttgtggcccacaggtgaggggacatgtggcaaatgtccaaacctggggtctgaatgatatttttgatacgaggtaggcacctttctgaaaaattgtctttacttcacacttcattttatttctaaagcattcaggactcagcaaattgcactgactttatcatcagtgccttttgtgatttcctatcctagaacttaatacgtccccgatgagaaagtaggaagaagctcctctcttcagtcgattgttgatttatggttccaatgaggctgctcatcctgaccttagtttcaggaacggaacccatagacctggatgcctaaagccagcttgaaacaagaccgccttctttggaagctttggaagctggcagtgactttttgccagcgaggtttcatttgtttccttgctcagagtgttcagacaactggatcaagcgtagtcttcaccagcggttgatatcacctcccacttatatgtgaaattccatgtttaggacttaaaattcaccggcaagtcgtgaatactattgcgtgacacttccttgcaggcgcagtaacagctttagcaaaaatttttatttgaaagttcagttttgtcactgctctttttggaagaagctgaaaatctgctatctcttgggggaaggattgcaggcggtttccatctgacagggatgttgtgtaccaggcagcttttccaccctgacttacgggagcaaacttttcatggtgtcctggctgcagcaagcaggcagtaaaaaacacatcactgctacataaatagctgacgatttgaggagggacctgacatttaaagaaaatcctattagctctagctaagaaaatgaaagccgcaaaccctccaaattttaaagtgggggagctttaaagtttcctactaattcagacagccatgaactagacaagaatggttatcttcattctcccgtttctagatacagcttctctgtttccactgtaaaacttcagtggaattcagtgtaaaaattcagtgcaaagaaaggacaatcctattctttaaataaaacatgttgcttgccccctctaatgtgtggtcatgaatgtcttatttccagggagtattccacaggtcctgattttgcagagatattcccttcaacaattcactttgttaattttgaaaaatataatttttaatacattctggtcttatagtccattttgggaaagagatgaaattttgagggctgggcactgtggctcatctctgtaatcccagcactttgggaggctgaggtgggcggatcgcttgagcccaggagtttgagacaagcctgggcaacatagggagaccttgtctctacaaaagcgttttaaaaaattaaccaggcatggtggcatgtgcctgtaatctcagctacgaggctgagttgggaggatcacttgagcctgggaggttgaggctgcagtgagccgtgactatgccactgcacttcagcgcctgggcgacagaaccagaccctgtttcagaaaaaaaaaaaaaaaaaaagaaaagaaattttgagttagcacgttcatcctggtctgtttttgaaaaggcagtttggttttctttcctctagagggaggtgtatctctgcgagcttcagaaaaatctctgaagtggtgcctggagtctcccagggtggagtttcagggtttgtagtaactcagtgatgaccatctcagcagagcttgcgggcagttttaggactgatatttcaatacatgattgtcattattatatttattgtggctgttcataataacggaagtgtacatacgttagagctttgtttttcttctctgctcaggtgtaagtgtattgagatgaaattgtgccatcaaaggaggcatctttgttcccaaacaattgcattacaagggtattcagcaaataagacattttataggaagcattttacccatatctaattacagaggtttaaatgaacagtcgggtgcttgagaaccaaagtaggtttgcatattcatgccattgcgtatccctgtagaattaccggattttagaactgtaagggtgctcgtgacatgtcctttgatactttcccctaataatggacaatgggttttaacatacttttaaaaattcacacaagctatgattatgaatgtctcgtcttgaatatttattaatacaaatatatattactgactctcagatttatgtctgttcgcttgagataaccagcattaagactctgagggagacaattctagctcagagcaaaacaaacaaacaaacaaacaaacaaaaaaaacaaaaacctaaccctttggttggtctttgtgttctcatgtttacttaagtttaacaagacctattgtgcatcatggccttgagccctgaggttcagggaggggatatatccctaatgctaaatgacgagttgatgggtccagcacaccaacatggcacatgtatacatatgtaacaaacctgcatgttgtgcacatgtaccctaaaacttaaagtataataataataaaataataaaaaaagagaatacattcttggggaatattaaaaaaatgactaagacatagccccctctcttctggttggcaaacatataatttctgtttggctaattgaaatatcaaaaaaactactaccttggtggatggtttctccacgccctttatgcttcagatgaagaaagagagctcagagaggtatgcccagtgacagggccacagagctagtagcagaattgtctgatgtttccaatatgcagacatcttggaatctggacatttcaagggggacaagcctttaagagtgtattttagggtgccatgtggagaaaggtactcttcccattcccagtcttccttggagtagcctcttttaagttgattcagcagaggagtaactgttgcttaaaaaaatctggaaagaaaaaggagagaagaaaaaaacaaatacgaaaagttctgccaaaccttctcccaaaggcaaattgttagtcttgtaggggtctggctgcattcagcatagtatgatcctactgttctcctgaagtttaaactcatgaattacagagaaacatttgagaattgcaagtggccagggaaaagtacaatgggaaatgtttctgtaaaaccccctgtgtgtgctatacattaggttttcaggaacccagagcatcaggaattggtcactggaaggaagagctcatggctcggtttaatttcaaaattaaaaattgaacagcagctggagttgactcagatctcaagggaaaccattccaggaaactggtttttcacttctggaatcttcattagttgattcagcagcccagggccggtacccagagttagcgccaactcagctaaacccacagccggcccggcggtgcaccagggtgctctgtttctaactggggctgcagaaaacccatcattcatcagagcccagggcaacagatggaagagagcagtcgcaggactatggcctgttcgagcaacaggcaaggagccttcttttacacaaaagggaggctgggagagattggccgaccattgctgacagaggcagtaaggaagtagaatttcccaggttactgcaataaatccagcatggatgatattttatcagatgttccaacttgatttttgaaaaggtttctgttttcaagaatgattttatcttctctacttgattataaattagactagaaaacagacaaaatatctaacttttctctttacaaagagagcacctttcagccactttaatcatttacagtggaacaccacagttttggaaaggtcagtagcaccttagttcattgccaagaaggaaaagacaggaataagtgccaagctccaatttggatccagcagcgtcacgtggcaaggagttggaatggagtgggcatttgtgcaatatttcttgaagcattttctaatgcacctttcttctttaatgttgaaatggaactagtctctgcctgatgtttataattagcagtataagtgcagacaaaatcttgtctggctgccgtatatttcagaatgtggaatgtgttttacatttgcatggtggcgtctagcttttcaaatcacaccagatatggaactttctgcctcatggttattatctgcaatgctaggaatatgttttaaagtaattttttcaaatatctgggtaattaatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggcaggaggatcccttgagcccaagagtttgagaccagcctgggcaatatagtgagatattgtctctaccaaaattcaaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaacattttcttttgaggattctcctttgggtctttcaaacaccaagagcatattaaattccactctcctcctaccctaattgcaggacttaataaatcctttcttagcttcctccctgaggaaaagaacggggactcctttcccaggattcgtgcaaaaagagagagaaagagtgagaaaaagagaaagaaatggggcgctccttcttgcagtctaggaatgggcgtggcaaaggcaagggtggatgagtgcctcaaatttactgaaatttgactttctatttcacagtcagtgtgcacggctctcccactgtggtctttgactatttccactgctcccattttaaacaggacaattaggaactaacagaagtcccagaacttgataggagggacaggctgattttaaaaagcagtgcttggagaaaaccaaataaatgacttcaaaatggaagctctggatttatttgagtctttgttttcaaactatttccttgtgtgcatgcgtgtgtgtctctttcttaaaaaagatttccagacatggaaaatgaaaaaggttttgagtaggctaaatgaaaactaatttacagaattgcaaaatagcttgggaaatcatattcattggaatatgattgaatatgatttcaggttgaagggccatgtagggcaatctttctgatgaaaggtatccttttaaatttcaaagggatagaaactaaacggaaaaaggcacctcaaatcctttttagaatgaggcagagtaaacaaaaagatgaataatcctaaacagaaagatgagaatgaaaatgtgatgaatgtctcttattgaatctgtttcctttaggacacagaatctaggatgaaggaacagaccccttccagcccaaggatctcaagcagccaattctgagtctttttttcatatttgaaagaatgatagtagacagccgacttccattgacatagaatctgtggtgtgtcaccaccaaggaagtctattttttccccaaaaggcatggggagtttccttgagatctgggccaaatctggcacagcctctagggtttcccggggttcttcccatgagctttggaaatgctaacttgggttagggttctggttctatgttgtttttatctatgtagctttgaacaatcactttgccttgctggggtttcaatttctcagctataaaatggagggaaatcagccatcggatggttgggaggagggcgtgaaatcccacccacaagacagaagcccaggaaacgttaccagcactctcctctctccttcctccgggagggtggtgtcggggaatgagcgcggatggctgcctcattccctcttgttgaagagggcgggtggtcatctggtgagatggtgtttgacatcttttaataatctaaatgaaaaagttctccaaaatttgctgccagggaatttcgtttttttataaatggagactccaggacatgacaaacaatagaagagagttaattgcaaacgaaaatatcagcaaatattcaacagctgggctaggagcccacgagccacaagacctgcttcccgcatgatggcaggaaagtgtgtggggccaaaggcgtttttcccacctgggaattcagctcagtcaaaccatatgggttctgaatcatcagtggagcctggataacgcattgtcctacaggcattatctcccgtccttttcagagctggaagggctcctttccttctcttccctcccctcctcttccctcaatatctggatatattctggataaaataattcctgtgcacagtgtatttatcccattactttgtgttccaatgggaagtatctccactgagggggctactcctccaaagattcacatcttgaaaataaaaatctttacatatgattttcaatgaactaaaagttcattttactcagaatggttgaagtaagtgagtgatgtcttagacttcccggattttattttgtaactatttagattgtattgagcactctggaagatgagaaatgtaattttggaattgctccagagtgagcccactcaatgctttatatgtgacagaatcagtggattcaaaggctttcactgtgtgaggtatgggaatgattaagaaaaccattagcaaaacctgctcaaggcataattcacttgtgctctttgtcaatgctccctgcacaggtgtctgcagctcttcccatcccagactcaacagtgaggagacagctctcatcttatcatgtcctattttttccacctggattacaaagccgaatgctttacaaagagcctctataatactcttgtgttctcattcacaaacaaaaataccacttaaaatcatgcctcttgaacatggattaaacatttaaagtaatcgaactggatcttccagaagatttgcattaaaatttttaattgaagcagtgatgcttaaacttttggggggtgaggagtggcacaactgccttttagaatcacatacaaacatggacccttatctccagaaaaaccctcatccatagatgcaattttgcactcaactgtgggaggatcatagactctttgaatctgttgatcccgtattaaaacattgatctggaccagttacaataatacaggttgttttggaaagaacaggccattttcttagaaagaatctagcaggaagcttacctttgctaaaaaaaaattgacgctcaagcttgatagaacgaatcaagaatagcacatataaaatgtacttttatattattctgaagtgtatatcattatttaattgaggtcatacaaaaaattagatattgcaattgctttttttttttatttgaagaaacactcaggaatgggtctaacagactgtagggaagaaaggtagagcttggtggaaaagtctggaaggttcccagggttgcatgggcttgagggattcctagagagtgaaggggcaaagttggggctgtggcacggtgggggtagggtcaacctaagtggagggaggagaacaggcagtccagcctgtcgggggtccctgagccctgctgtgctgcgaccgggctaaagcttgggagcattatcaaaccacagcacaagcactggagactgctcttctacattgtgttaacatatatccatgtccaaaaggcagtgaccattgcaagggaaaaaaaatcgggctgagcttttgcaatactgccgctatcaccactcattgctgtcactttgttgcagaaaaatatctgttctgttgataactggcctcctgagcatcattagaacagcattcctttctcactgttgatgcatttccaagagactgctgtattgacaggtggttctattttagctgctgagatcatggcttcaagttctcagaatctgaatcacagggtacatttgtttcatcacaggtggtactttttgttgactttctttggaaatccaaagccacatgggtcctggtgttcattcccttgtttgtggcttcatctgtctccatctcaccaatttttggcgggtcaggcctagggcccacactgtgttccgtcttcctcatagctgggccgcaagatttggactccagcttctccctctgggcctgacctcaggcaggaggaatttcacggcaaatccacgggactgagcttcaggtttcctttgcacccacttagctcctgtccttgactggcagcctcaatcactctctgtggctctccctgtacctttgctaagtggtccatctggacactagtctgctgctccattcatggcaaagttacatcactcatcagccggacagactctcctctgctatcaatcttcaggtggcaaggctgagaacattagatcatcctcatccctgatttcattagctgtatggggaaaatggaattcctgtgctacacaacagacaaccatgaagacttgcagagcccatgggggcacctgtggagagaggaagattaagatagagatacaaaagctcaggccttgggtggagccgattccaaagctcagaggatactagtcaaggcagaagccatgtttgcaccaggtctgaatgttcatattagattctttcccactttcatgagactctgatcttctttgccaaaccctaacattttgcatgacatatactcttttcttatttctttccaaatcttatttagaagtaagggcaaacattgtgttatttgaatacagcggcatgtagacacactttaggatgtttagttgtactgttttttcctagtagctcttaaactctatcacacctcaaaaaagagatgctgcacttacatcattcctgttaaattgatggctacattttaggggtagttacccatgcttttaaaacctggcaaatgatatttcctgtcctcatttctattttaattgtggtaaaaaccatataacataaaacatactatcttgactatatttaagtgtacagtacagcagtgttaactatacgcaccttgtgctacaacaaatatctataactttttgatcttgcaaaacagaagctctatacctatgggacagtaactacaactgcctccctcctgacagcccatggccaacaccattctaggttctttttctaagactttgactactttaaataccttcacataaatggaattataaagtaatgcatttgtcttttagtgactggcttatttcacttagcataatatcctcaagattcatccatgttgtagtagataaaaggatttcattcttttataaagctgaataatattccttgtatgtggcatgtataagacttagtataatacagtaggccgtgcacagtggctcacgcctgtaatcccagcacttaggaaggctaaggtggaaggatctcttgagcccaggagttcaagaccagcctgggcaacatggcaaaaccctgtctctactaaaaatacaaagcttagctgggtggggtggtgtgtgcctgcagtcccatttactcaggaggctgagaaggaaggattgcttgggcctgggaggttgaggctgcagtgagctgtgatcgtgacactgcactccagtctgggtgacagagggagaccctgtctcaaaaaaaaaaaattacagtataagtggtgtaataacagtgcaaagtcctaggagaactgtaggaatagcagttaatgaatttaacaaatatttattatacacctacaatgatacagacaggcattttgccatactctgtgctcagagtgtggctgagcttcacagtcctggaagactctttgtttatgataaagcagccttggaaatctataatcaatttcataattgcaaaaaattccattgtgtgtgtatatatacatatatatacttaaccaaggaagaaaaaaacctgtgcactaaaaactataaaacactgttgaaatgaattaatttctttattcatctcatctattgatggacttttaagttgtttccatcttttggatattacaaataatgctgaaatgaacatgggtgtgcacatatatctttgagatcctgttttcacttcttttggatatacccaaaagtgggatagatgaattatatgataattctgttttcagttttttgaggaacattcatacgatggaggctagcctttccccactgtgtagctttgttgaagctcaaagatcatatacatgaggttttatttctgggctctctattctgttccattggttcatatgtctgtctttaagtcagcatcatattgatttcattacaccattttgtaatatgttttgaaattataagtgtgaggtctcaagctttgctattttccaccccttcattctgttaatgtggtgtatcacattgattggttttcatacgttgaaacatccttgcattctagaaataagttccacttggttagagtgtataatccttttaatgtgctgttgatttggtcagctagtattgtgttgagaatttttgcatcagtgttcatcagggatattggtctgtatttttcttttcaatattggccttataaaaatgagtttgggggtgttcctttgtctttaatttttttgagaaaagtttgagaaggattagtgttaattcttccttaagtgtttggaagaattttccaggagagacatctggtcctgggttttttgttttttttttatggaaggtttttgattaccgattcaaccccatactaattttaagtctgttcagaattttttttattgcttcatgattcagtcttggtggattgtatatttcaagcaaatatctattttttttctaggttatccagtttcttggtgtgctattttcctcacttcttacagatctcatgtagtcttgtcagtctttccaaagtcttgtataaacaatttcacgtgcctgatttgctctcatttccccttgctttcttcagggaattgccaaattattcctgatgcaggggatataaaaccaatctgtaagcatttggagttttagaattataagatgaaaaaagtcacatttcaaaatctgacatatacttgatacccagaaagatgtttttgattttcattcacactgatgctgaatgcctttacatgctgtaatctgtgaaacagacttctttttaaccttcaaaccctaacagtgaaatgatgatgaaaactcaatctccctagattatatgtatttcagtttcttaagtcaaatggaatttctaatttaactgtagtctacactatatcatttccaatatcaaataattcttcctgaaactcaatataagaaaaaatgacaatattaactagtgtcatgaaagttcatgctgataatgagattgagtctggtccttcccctgggcttctccggggaaatgtcagtcgtctacccattctaattctctcacttggtcacagggaggcagtgagctccaccatcaagggacatgggtcccacttacagttaatggagtccgagagagcagatatttgcaaacccagtgatctgggctcagtggaggcctgggcaggtggagatgcctttggttgctgcttcagaggagtaagagcttagcaaaattagacatggagaggaatagcccatgaaatgtgtttggggaattctgggttaaatcaagtacagcaggtttctttactttatttttcagaactgctatatattaaggtatattgtaactgttccagaaggaggcttggtattcagcactttccaaactgcgttgctcatggaatgcctgtttttccccttagaacatcgaatggaatgggtgttccatgaaatgtgctttgggaaatgctgatgaatgaaacgttgctggagaatggtagttagagttcacttaccatccattccgcgtcaggcatttaccaaacaggctaccacatgctcctcacagagggctggaagagaggcatggctatcattgttctgtgttatagaggaggaaatggaggctttgagcaagtataccacctgcctgaggtagggtatggtggatccaggatccagatttatctgattccaagcaccttgtctttccccaacatctctggctccttttctgattcctaaaaagcccaaattcaggctggtgaacttgattgaaaagttgctatggaatcgtggggttttcatggagaaataaaaatgttcttcttatcctctcatcttatgaaccctcagtgtggcaggtgctattgagcaccaaggtgtctgaatagttgtgcaccttggccacttattctctgcacccccattttttcctgtaagcatgaggatcagcatctacctctaaggataatgtaaagataaataacacacattatgaaaaattatgaaaaactgcaatgatcacatagtagatgctgaataacttttgataacatggcacccaaaacagcggtttaataacatcctagcctacctgtgtcgccaatggccttgttccccagtactgttacccaaacctctgaaaagggaacccctgaccagagagctcctaactggggaacccctggccagtctgggtaagaagagtcactgacatgcacatcattgcaaaatgaaaatgagcttctcgttcaaatgttttaagaattccaagatagcaacatcaaagcatcaaactgagcatggggcccttcagagcacagggtcctgtgggcagccccgtctgtggtctaagaaaaagttaaaggaaaccagaatcctgcattaaggagaggagaaaaaagatgctgtcctggcaaggggacttcagcctagacagaaagaccctagctctctggaggggtcttaagggagaccccagcccccaagctgatctcttagattggagattggagagtgaagaggctgtcacaagatcttgtggtaggaagaaaaggtgttggcaggggaaaggtctgatggcgcacgctactgagctgaagtgaatgtgaacttggctggtggggcatcatgtgtgcggcccccagaggcgcgtgggtatgggagactctgcatcagggcagttagcctccaggtctggcttcacagtcttactaattaaatcaccccaggctcattccactgtgagattggaggttggcatatggcagattttccttggaggaaaagtgctaaatattaatagagaatatggacaaggcttgacatggtcccagctgctgtggttgggttgcatttggtgtaatttgggcaaagcccgttctctccataaactgaaactttcctctgaggttcttttaaacatgacttacaaacttaagctgggtgtcaaaacctgatgccttgtgcctatgagtgcttttactcctgacccatttccattctgctctttgcttaggaatatgctatttccaaattgctgcgtacatcacttagggaggaaaagaaggtttaattgcatagctttttagctgtggccaaagtaatagtcactagattcaaaaattctcatttatatgtttaatcaaaactatctttcataatggataaatttttcattcattagtaatttgaaaaagaaagagaatattttcagattgtggagaaactactatgaatgcctattttctaaaaatgtaattgtgttctttgaactatgtttaagaatgtccagagaggagagtgagcagtgccattacaggtgacctatgttctgctaacaagaagaggtctgaggtccctttagacagagagctctgcctattcacttctcacttacctattctttaccttcctcccaccttcccaccttgcctcctcccttcctccctccctccttccctctctccctccctccctccctctctctctttctttctctctttctttctttccttctctctttctttctttccttctctcctctttgtttttcttctgcttctttctcttcttctccttccttccttccatccttccttccttccctccttccctccctctcgccttcctttctttcccttcctttccttccttcacttcttccttccttcccttctttcacttcttccttccttcccttcccttccttcacttcttccttccttcccttctttcacttcttccttccttcccttcccttaccttccttctcttctcccttcccttcccttctcttcccttcccttctccttccttccttccctccctccctccttccttccttttatatatgcatatatgtgcgcatgtatgtatctgtatagatttttatctatctatctatctatctatctatctatctatctatcatctatctaactgtctatcatccatccttttgctgctggttcaaagaatgaatcagatacaaagtcttcttggaagtctaaaaaggacgtagaaagcatgggattttgagagattttgcataatgagagtcaaaaactgatcattccctttgccctgttttctcttttaggttcatatttggtgcttagacaaattcaaaatgaggaaacatcggcacttgcccttagtggccgtcttttgcctctttctctcaggctttcctacaactcatgcccagcagcagcaagcaggtaagagccagaaacgtccttgattttgtaaaaaggaatatcattctttgattttagatcttagacatcaggcactgacatagagcttagatatgttcttaaggtagctaagccatttattataggatagtcagataggatagttctaggatttataggccttttcagatactctttatccagtgagagatgacctatttttattaaaacttgggtttggtatcttggaattggcttgaaaatgatttgtttttacattggatgtgaacggaaagtttgtatctcaaatgttttaccacctgaagggactttccacatttctggcattggctggtctctgagcacataaagtagggagaagtcaatgattgagagtaaaaactattttccctgaaaaatacaaagatcaccctctctctctaactccagatgcaggaaggcatttttcatctaggatccttgaatctttaagatttctgtttcccaaaacgaattaaaagcatgggttctaattaactctattaagaatttgatttcagagttttagaaaagtgggaaatgcttcatgcattgcaagctggaaaggactcaggtgggtctccctctccttgacccagagagcttggcctctgagggattcttcctccaggccaggttgctcttagatggagggaagtctagtgtcacttcaatggaagaagaacgtgggttggggcatcaggtcagcctgaggtaagtagagtccagcagcaagcctggctcacagctgcagaagggcacctcctggggccactgacagcctgataccctgagctcccacccttgagggagaactgggttcatctggaaatgagatagataatgtttgacatctatggagacttttctggctctgaaaaatatgcagtaactaatagagtacagtttgttcatgctcaaaaaatctggaaaaaataagtcttttcccttctctacatttacacaagtcctcctcgcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagcagtatagtgtaaaccaaatttgtttaggaaggctttgcattgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacaggtaatggcaacgccaccaagctacgccctgccctgctgttcttgggagatgagcttggcaactgctggccttaaagcaacagctaggatggcgggtgggccagggaagagatgagtgttcacaggtttaaaaacaaaggtttgatttggaatattcttccatagtcttctccccaagtagggcattcacctacatacaagaagagtctttttttaaacaactaatattttcagtctaaaaaaacccacattctaatattatgatcccacaaaatacctctgccttccttagaaaagaaagcctcagagtggtgaggtgtgcatctgatcaaactcctctatttggtgttgggatctgtttcctttaaggaaagctccctgttggagagtgcgtgaactgagacgggagcgagggcatctgtttttgtgtccagtggactagcagagagcttctctcttctactttacggagttaatttaagagtgttggtagaatcggaattacaagaaacctcagctatgatccagtctagattgattttggaaaaaatttagtcctgaatggttagtgacagccggagctggaggctgtgcatttgggctgtgggtctggtcttcttatttcttctccatgcggtaatcatggctgtgcccacagagactcttctaattctaatggagttgatgagaaccactctggaagtattgagagcacacggacattgcatcgatgtgtcatgtgcagttgcatgtacagagctaattggccgacaggttatttaaccagttaagcctgttagctctccttccagggctaagtgcctaaatggccaatggggaaggaatttgacaagtacaatttcaaactctaccataccacagcaactgtaatgagtgcccagagcttactcatcagcgatgggcagagcagagggacctccccttgttagaaaatgagtccatgcagccatttgatagttggtagcagagaattctgggtggaatgagcaggaaatgagagaggaatccagggggagagttgagctccagaaaggagacacacatgttctctgagatggagggaaggcatgagaaaaggggctgtgtttccaagatattcaggtggataagaggcacattgagagagttcaagttgagttgacatccatcatctcaataaaggagggaagcagtggggcttgggggcttggagggattgaagttatttttgatcagctgctatagggatgtgaagaggggtcacaaaacattcaggaagcaactgctgatttgaagtggcatccagttgctatcagagattacaagtcagtgggtgtctccattagtgtggatccctgcctttctgcagatatctcaggcactcccaggatcaaaggagttcccagaactggaacttgcaaagagggaacaatagagaggacagaagaaaattttctcagtaaggaaatccagagtggtagctagtaaattcctgaaacagcctgccatggtgtcctagctgcatggggagctaatgagagctggaatgggccaggagacctctgaagagccagaggatgagaggccaggtctcggaaggagagtcctggagacagctgagtgtgcaagttggagacgctgctggtgtgtagacagggagacctctgagggccaatcgcggggctggaggagtttccaatggtgctcagtgtggtcctcagatgtgtaggaactatagagagccagccactgcagaaaccagagagggtggtgctcacaaaggttgtccatacagaccttaaagtctggagatgaccacagagtctgcagtgtgaacgcaggctgaacataatgtaactaaatcatgtaggaatgttggagactctcttctgtgtatttagtaggcatgaggaagtggataattctttgaatcaaaaaagaatgagtgggcaaccacatggcataggggaactgatcataggaagcaagatttatgaacagatttttctcctacacttttaaaaatggttaccaccaagatggccactgggacaggaggtaggaggtgaggtgactgatggagagtcagtctcttgtgaatacacatggatggtggggcaggaaaaagagagttgaggcttggaggcacacatcactctacaggaccacatcggagggacagcagaagaattgcaagattgcaatcagaatgctggagcagttgcagagaagcagtaccagatgtcagtttttcataacaaggattcagaaagcaggagctgaagagagatgacccaacatcagcagaaaggaactagctgtcttgagcaggcagaacttgatgaagaagagggtttcagaactagccagctccagggtgtttcagaagtttgttcataaaatggttttcccagtggttactcctgatttcagctttaacggggctggcagtgctgatgcccttacctgtgggtctgcttctccataggaaagagtgagaggcagttcaaacactgcaaagtgttccctgcttccaaatgacaggcctcacccctggcattaccacacaggcatcagtcctgccaaatgacaggaaaagctgggtgtctccaagagcaccccaaaccaaacactcaggttaccaggaaatgacaagagggtatctacaatgaactgcactcctcgctacgatagtctcagtatcattaattccctgatccatcacatttcggaatatcgggataataacaaagacctaccaaaaaatagtgaaaggggctcacgcctataatcccagcactttgggaggctgagacgggaggatcatctgaggtcaggagtttgagaccagcctggtcaacatggtgaaaccccgtctctaccaaaaatacaaaaattagccaggtgtggtggtgggcgtctgtaatcccgggaggctgaggcaggagaatcgcttgaatccaggaggtggaggttgcagtgagccaaatttgtgacactgcactccagtctgggtgacaagagtgaaactctgtctaaaacaaacaaacaaacaaacaaacaaacaaacaaacaaacaaacagtgaaagggaccagtagagaaatggaacatcttttattgacgttttgttatactcacaaaaatagctgagtttgcctttatgtttaaccattatgtaatggacaaacaatgagattaccatagtgaatgctaaatgaaactaccaacatcgtgtgtttccacacagatgataaaacctttgtttttatgccaagaaagcatctctgtcttctagtgtccaagccactagcagcaccagggcagaaaattaatccattcatgtgtcttttctaattaacatcactctgcagttcctcctagtaccacgtcccgctgcatgttccacggcaaaaacataggataataatcttaggaagaacagtacatctctgcttatagttttttggaaagccagttagaagagcattatagagattgctaattagttagggctgcctcttcttactacctgtctgctgggtaacttccccatagagtgttcttgattataaaacacacatatgtgtaaaatatgaacgatcaccactgttgtcaatgaactctactcaaataatcaatctctaatggttgtgtttttaaaaatccctctgtcattctttaaaaaaatgaatatacctgagatataaaacctttattttaaaacaaaagctaaaggtgacagggaggattttggcatcagctttcttttctctgtaaaggatgaagatttttaaaatttgtaaaatatatatacaattttgtgttttacataggaaacaagaatgggaacttgtttttcttaatgaaaggaggcatcacatgagctaagaaaggcattgtgcccacaccagtgagctcgggaaaagagcttccagggatgtcaaaggaaactgtgaattttccttggacactgtaaaacttttctgtagaaaacaccacagaggatgtgatacataaagcatagaagcagaaaaccagacaattttaaagcttttaaattgtgcatagatctgattccttgtaacattaacattggtcattggtccgccttgctgtacacaagcacacatggcccctgtgtgcccttgaggcttcagctctcttgaataacaaagcatgcccttgtatgtcccattattgtgtgtgtaagaggataatgttgttattcagtgatgacaaattatccaacgtgtttctatgactggccactgtagatgttcagtcttttacaagagaatgttcaaggattttccctcagggtccatttatcttatttgcatgactataaatttcaacccaaaagtaagttacaaatggagaagaaatagtgttatcctgcgacttagggatcatttttaaaagcttgactgtattgatcatatttaatccttcttttaaacgtcttgatatgctgaggaagtggcaaatccttccgtgtcctttgaggtcattggtttaggcctgggaaatgttgaggaattttgtggaatttgtggagcctctgtattatgcaatgatgtaggccatttctatggccttctgtgtaattcacaccccctggcaccacactctcttgaagatccttcaggaatcttatattttggctgaacagtggcaaatgctttgggccctaatcaagggcctagtcttatataaaacttttgtgtggcaattactaaaaacacaagatcttaattactgtagcacaacaattatcctactcattgtatcttataagaaggattgtgatagcaatgttgccaggttaatatatttccctatgcaaagaattaatctgcaaatatattgttaggaactttcttgtatattaggaagggaagagggcagttccgaacctggcaatctctgtttcagttcacacaatgagaagagcttgggtaagaatgtaatttcactagagcagaactcttcaattttgtgagacaagctttggatccttttctacagtgagaacaaaaacaattttgttggcacaaggaaacattaattttaaatataaaatgttcactgtcattgaaaagatcagagatcagagtgaatggtcttacctataatattaccatcatttaaaaatgataccctgagtgtagttttctggaatcccagaatataaatagataagctcaagctcacatataatctcttcttgtccctaacacatactcaagttatcaaaaacatcgactagaataattgtgctcctccttgagtttaaatcagccaaatttaaacattcgaactgatgctgtgaaatctctggccctgacttttagatttctcgatccctattcctccctcagggctgctatataaccccgttctcagcatcaggttgggaattctctgtttgccattatgggggagagaagaggtcttggtcagctgtttttctgccctttgtataaccccaggctaattctaatcagggtttattcgatgctcatggtccttctaggtaactagtttaggatgtcataaaaacaaggttggataattatgtcatgaccggtttcatatcactctgcttaacattgttctgcattaagtgactgaatatagaggcaatgacaaaataaatgaacaaaacatcctgcccaatcccagacctgcatttgagttttatgcaactaaacatcatttgagaaaaaagaacaacaaaaatttcatcaaagtattttttacatgaaaactttaaatgtagtttgagttctgattcacgaagttgcatgtacaaggtcattttggtttttaaagaaaagagaagaaacaatagtttctgaaggcatccagcaacatactgggttgaggaatcaccaaatcgtgactctgttttgtagctgtggatttgtataaaaaattattctaatcatttgaggaggcaggagaaatgaccaaaaattagaaatcatctctaaagttttggtaacctactcattgattttccctggtaggtttggtagtggacaattcatgctactacttttccctccaaatttagtggaaatttctagaatatgtacccaagattgtcccctcagaaaagtgaatatgatgtttggaaatttaactatgaggatggcacaaatgaaaaattgctataaatgtcccttttttacaccatgatttctaagaggttgcctcttatccattcagaatgcagaactgaaagagaatttcacattccttcatcaacatgtgttttgtttgcccatatttcgtgtttcttattggtttccaaagaaacatgtcagaacactgaataatgcatgtggtcacttgttctaatgctttcacattttttgcatttctttcttttaaagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttctccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttggggacctccaggagaaattactgccgtacattgttggcgtggcccaaaggcacattgtcttgaaaccgccaaccattgtcacacaaggtatgtatcctcttctcaccatctgtgtgggagtggggtgttgtgtgtgttggtttacatagacgtaaggtgggtaccagcatgattcgccacgggagaagctgtaagtacccacagtccagtccttccctgatgagctgggtcctggatgtcatgtttgtgatgtcatgtgtgcggaaaaactaaagaccaatgagtgagtgaaagctcttacgagagtatgagttgctgagaaagcgtgcttttaaggctaattcaacaaacctgttgctttgagattattaaacatcaccgtattaactacttataatccagtcttcctaaaaatgggcttgaggggctcattacagttctgagaaagttactccaggactatggcattgagctctaaaagtcagtgttagaagtgtgctcatagacagagtatctttccaaaagcaaagatggagtgagggtgtctcctcaaagtcattttgtgctagggtgctgagagttatacttctgaaggtaagaaataacagtgtaatcacttgatgaaatatttatgaagttttttttttcttgtgcttgtgaagtgtaggagtaattctcctgagtggcaatattaggatacaagctcaaatggagggcctttggcaaaacagccaattggagtggtttaaaaaacaaaaaaaccaaccaagtcacataacaaatatgcacttaacaaacataggaggtatggtgggggcatcaggatgcatagcctcctctaccttttgaactgttttctgagacatcagtcacttttcagacctatcaatttcattacctaggtcaggccaataggatgccatttggtaaatcagggacacagtggcccccaacagtttccagaaacacccaactcacttccagtgttgcttacacactgggatgctctaatgagattagtccttgactataagaccttattcttcattttccttccagagtatgggctcaatgaaaattggtgaatggataccgaggctcctataagactctgattatcatctgcaaccaatcatctaaattttcttgggtgaaataacacattgttacaactcttatttgctaactttataaataaagtctgggtctacaagataaatattgtaataagatactgctttacccattgtatcaattacaattgatcaagggaggttttcctttgataaaggagtgaaaataatttaaaaataaccattttggagaatatgccattgtatgaaattaagagtagaagattttaaagtcttaattaaaaacatcactatctatttatttaaggagctgacctctacttaatagtgccttgctaatcattagttctagttgctgcattcatgtaaaggcaacacaccacatttccttacaagggttacaaaattcacactgagttagattgaacttgcctcaaatgattttaaaccacagcttttgttgtaataaaaattacaggtagaaagctcaggctatggcatctctacttaatctgtgcattggaactgtgaccaggtgatgtagcaagaaaagtatatgtgagtgttgccttctggagaaggctgtgtctggcatttatttaagtttgaaaggtcaattctgtgtggcttagcttttgctgcatacagttttccagcttttcctctcacttgatgggaccataaaattggcccaaatcctccagatgagctaatagagagactagaattttgaaaataatgttctgaatgcaaatggacattgagaagcaatggaaacagtgtacaggactacatgcccggtgcctggagctgctcatgctcattccatcatggtgccgttttgtgactctggcaattaagaaaacaatcaagtgaaaatttatgacctgctgaggtttctctgagcttgcatactattggtgtgcatcccaaagtatagaagcccagagatttccctatgttttgcagacaccgacgatgcaacatggctgtagatgggaaagctggtctctggtcttgggtcttctgtggacctgccatgtgatcctgggcaggtcatgcaacctctctgggtttcgatttcttgaatttatgacaaaggagttgcaccagatgaagatatgtctgtaccaggagaagtttcaactttttaatgaaaatgggcagcacatgacccttgtttcagattttccctagccaagtagagtttcaaccccttgattacaaacatcatgtttaatatcaatgattaacttgtaaatattcaacaaatatccttgactatctggcatgtgccagacactatgccaagcactagagatatggtgctgtttaatgagacagatgtggctgctcgtctgttacaggataatggggaaagagacaataataatataaactagtgaccaggcaaaatattctgagcatgataagttgcattggggcattcaacagggctgtgataggaagactggggaagggaattttagatcaggtggatggaaggccctgagaaggtgtggaaccgaaggcagatgagcatgcggagagcagggggaagagtggtccaggcagaaggaagagcaggaggggtggccctgcaacaagaaggcacttagtcccttcccagaactgtcagaaggcagtgtagctggagcacactggacagggagcctgaggttcagactccctggatgcatggaagctggagaagcagctgctgtagggggatgagaagccacagggagtggagcctgtgggttgggagccaatggcagaggaaggtaggctgtgggttagtggtgggggcaggggctctcctctgagggcttctattttctcagagacagatgaggaggccttggaggcagtggcagagggctgagcagagagcacagccatgagacagtcattctggaggacaggacagccaacttcccaaggaggcatgggaggatggtgggcaggcacaggtctcctgatgggggtctggagttccgagcgtggcatgcaggtaccttgttgtgtggtcttctccaggaatgtccactgcttgggtgatgcatgaggaagactgtgggcctgatggaggctttcaggagagtctgatggaggtgcagggatgaggcatggaggaaaacagagagaggcgtgggaggagggctgaagagggttgtgccatgttggtgaggagtagcaggaccttcaagttcatctcccaacaaggcagtgaagtcaggccctgcagagccacattaaagagataagacagctgtgtttgggttgatatttatgtcaagtggaaggaaatgcgtatgcatccctgacgtggctcacagaagagtcagctgtgagaatcccaaggtttttatcactgggtcagaggagattcatggtgcagcccccagagaaatgaaatgattctgcaaagcctaggtgaattgcgtcagagtcatgaagcaaacataggaattcagttattcttccagttactcaatatttttcagtgtttactatatttggctaagcatggttctaggcatatcatctgtcatgagctcccatgacttgaataaaaatcaaacgtaaatgacctcttacctaatcaaaggggactctgggacagagcctctgggaaccagaggtgcatttcagggttcccagagctgaatccttgttgggtgcaaggagactaggccacttgtttcattagatctagaaggtattccttcccgctggctcatcgggagaacttttagtgatgcagtggtagggggagggaaaacgtgggagggtaggggatgatatttatcttctcccaccccaagagttgtgccattgctggtacttataaagaagaatataacaatctgggccacttggtataggagcaagtagcttctcaggtcattgttatatgagtatttgtctatttttctgtcatgtgtgatatacatagtaaatacatgagtggtagattcatggtatagcatatatggaatttatatgtgtctatatacgtgtatgtgtgtatctatatacatatatattctctctaatggtacaaaggtataagtcttctagagatctacacattagttttatctgcaaagatattttaaatcaaaatgaaggggtagcccagagagacagcatgttctaaattaaatgaaggaaggaaagcccagaatggatgttcataacaatgaccatgaaatattgagaaaaggttcaatgatgttctgcacacattgttacaccagtaggcaactgtgttattgtattaaggacgttggtgcataacatgttacccttctcttagaacatagaccttgtcttgatgctacaggtgagcacccagatgaggcactgctgtcttcatttggcatgtatcagcgattctcaccccaggcatcacgctcccagcttctggtccaaacaactagaaatgaactgcatttcaaaaatgtgttctaggctggatgtggtggctcacccttgtaatcccagcactgtgggaggctgaggcaggtggatcactcaaggtcaggagtttgagaccagcctgaccagcatggtgaaaccccatctctaccaaacaaaacaaaacaaaacaaaaattagccgggcgtggtcgtgcatacctgtaatcccaactactcaggaggctgaggtgggagaatcgcttgaacccaggaagcggaggttgcagtgagctgagatcatgccactgcactccagcctgggtgatagagtgagattctgtcctaaaataaaaataaaaataaaaatatgttctagaaggtagctctgattcttagaaagttcttccttaccttcatcccaaactttgtttcctttgtctgcttttacaaaatcaacttgccatgcaatctatctgatggaatacagtaacagaggactcttttgcaaaacagtccatctcaggtttaatcatttatgttcctctacttcttggaatctctgtcaggtttttgggttaggtgttgtggtcttaacagagttcatggttcttgcaatatgggcagggtgcctgcacatggatacagcagttcacagtcactgtgagacagttatcttattgagatgtttttgctttatggtttgcctttaagttatcactgtcatattacttaggatctttaaaaacaggttttttgttttttttttggagatgaaatctcactctatcacccaggctggagtgcagtggtgcaatcccggcttactggaacctcctccttccaggttcaagtgattctcatgcctcatcctcctgagtagctgggattacaggtgtctgcccccacgctcggctaatttttgtatttttagtagtgatggggtttccccttgttggccaggctggtcttgagctcctgaactcagatgatccacctgcctcagcctcccaaagtgctgggattacaggcgtgagccactgtgcctggccaaaacgcaggtctcttaagtgaaaaatgtttgcggcacttgctggctttgatgctgatttcctttttatacgttttatgttaagtaattctttcgtctgtcaaatgaagacagggaatatagaactgaagagaacagggatgtgcaggctctttcagcttttgcacttgacaatgagcattttgaaatgaagactgtgaggcaaagggttctctgagcagacatcagtggtttctttaattattcaagcaatgacttcactctggccaagttgtgtatttacggcagaagagaacttattgaattttcagtgacagcatacaaaacaggtggctactaaaactaaatttgtttttgtgcaactattttgtaaaaagtactgactgggcagggtggaaggtgagccagctttcctccagcaggtggggaggcaaccataacttatgtgttcattaggacaaattccctttggggtggccctgtggtcacgttggccacagtaaatgagggtgtcctttaaatggagttagctttgttgaaagtcattgttgattgtgcttggtaaggccattctaattgccttataatgttgccacctacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcacgagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgccgatcaggctgagctggaagagatcgctttcgactcctccctggtgttcatcccagctgagttccgagccgccccattgcaaggcatgctgcctggcttgctggcacctctcaggaccctctctggaacccctgaaggtatggtggtgatggcttcagacacacaatggggtggtctccaggcagggcctttaagaacaaaacaaaatgaagtgtgtttgtgtttagctaagagacaacaaatgatgaaaacagcagcaacgaacatgatttattccaggtttccttttgcactgggttcaggattgtatggtttacaatgtcatgcaatgaaatttcatataagaaccatatgatttaaaccacaggaccatgggccaccacctgtctttgaagcttctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctctctcgttaagggattaccctcaatgggaaagcatattgaatggctaagtgtggagttcaaacctagtggttcttcaaatccctcatttaatatgattgccagtggagagttatttttaaagacattatacagatctatgagctaatgagttgaagaaatacaattcactgcccttaatgaagagaagatgagcatcacagaatgatgctttcccaccttgcagactcgatcactagaggattgcctgatgcaggcatgacccatgctgcctggatgcatgctttctcttcacactccctggtcttctatatccatctctttctctctcttttaaaatttttcttaaaacttttaatccacactttcatagccaaagttcaacttaggatacaattagttgtgaggtctaaattacagtagggcatcagggaagaaataaaaaataaaattttaaaggcacatggtaaatgtgttgggtcaaatacactattttgagaattatactttttattcttgatgtgtataagtttggccaagcctagcaactagtctccttctattttgctgtgtatttacggtcccatcatctcactttgggggaattcccctgttggatgattgcctagcaagactgtgacttcctaataggagaagagtcccagtggagaatgacaaacggggaagtctgaagaagacttcaatatgagaccagcctacttttgctattttttttagccttaaggaactcgttttctcaggttagtgagggctaactgcttctgagctatggatggaagaccctctgtttgtgggtagaggtgagccccagaggatccagccaggcaaacttaaacctggctgggatgagtgatatggactgatgcagcaccttcatagtattcatttttagggaaggagtgtttggtttcaaggattctgatcacttttgttgtctgtaaacattctaactttgatgttgtagctctctttgagccaacttggttttgtaaactcggctaccaatatgtctcacaaacaccagccaccaccagaggaaaatatgcagccatctgccatattttacaagatggacatgctttgccatgctgactttctctgtgttctaaatgttggcatgtgtgcacgtgttgtaggcacacatgataaaactctccgtggttgtgtatgtctcacttttttttctgtgcttcactgcagttcactcaaacaaaagggatatcatctttcttttggatggatcagccaacgttggaaaaaccaatttcccttatgtgcgcgactttgtaatgaacctagttaacagccttgatattggaaatgacaatattcgtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccaggtaaacctcccctgttgccgggaactccctctccttcctcagacaccaccctggagggtagtttgccagtctgaactcaagagcactgtggactgtacaaagacaattggctcccttccattgaaatagtttgaatggggacttgagacactgtaccagcaaggctggactctgtctaaagggtgttcacgaaggaaagtctagaacatccagcttatgttctgtccattttgcctcaccctttattcagaaggattttttttcctctaatgactgtgaggattctggagttcgaatccagatttggggatcatggggtggagggagacagagagagatttttcttacatgaatatgccttgggattatttaaacgttgaaattgtatttttacatgatttttaaatgttcaacatctgctgtatctagaaaattatttgttataaaacaaacaaagggtgcatcttcatgcaatggtaaaatggtttctaggggaaggctaacttattattattattgcaaattattatggtggtaagatatggttgtatcagatctaccagtctgctaacatcacacagatgaatggcaagactaaaccaattgaaacctaatcaaaatagttctaagaactgttttaactgagaatgttatttacattacacattgcggtgccatagggcctgtcatctgtgtttcctattgtctcattacaacagattgggaagcattgacaaggagcctgacccacacagcagtaatgggcactattgtgggtcttggcccgtaacctcaaatttaatgatttgatcattcaattacagcagattcatggcaacccagttatctttgagtggttgacccatatcagccccccctttttttttctagagattgagatcaatttttttaagcaaaggtatattaagggccatgttttcaatacttttatttgtaacagtttgaaactgctgtctgttttcctggagcgattgccacctgatgtaagaacacaacccagtggggcttttccctggcttgctttattgaagaagcatgatgctagatgggataggctgttctagttactagctttgcaaatatgcactgatttgaaataggacattttcaagacaagtggtatgaatttgggttttctcttctcttgctggcacagtggtcatcagatgagtttcaccaactcctgttgtcaaatggtgctgggctgaagtcgctttggttcctgttatgctctcgtccctcattgtatcctaatctaccttcattgcagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaacggagcaccagcaccaggtatggtagagaaatgctagttgctctgccactcagttctctaatgcatgagttgagggtaggctgctggccactggtccttagatagaagccctccttgagtttacaggaaaggtggaaaattaatcacctgctggtttcagcaggaacaatagaatatgagatgtccctccttactttgattctctagctgctctctcaggagaatgagggtgagtatttttaagggcattagattatttcatagtaagacatgttataaagatttagatatcagtggttaaaatccttttttaaaaacagtttttatggtatgcataataaaagccatatcatatggttacattgtacctaaaacagccttcatcttcatattcacccaatgcctttatattgttataattccttcattacattcattaaaaattaaaggagtagaagaggtagataactttccaccataaactctgcattaaaatcccccaactgctaattgacactgccatgacttttcatttaacccctttaatttagtgataaaaatgcagtgaagagagtaatttcccctgtatgccttttgatgaaaaatgaagactccagagcctctcctttgattactgggcccattggccgttggcttgggatggtaactccgacatctgggttccgtttcctcccattaacccacttgtgacttgcagcaactcaattgaaacctcccatcgataaaatgctagtggttgtgcaggtgctgccatctcatgtctctcctcccatcccaagttttttcttgaatacatctttgaaagctaacaatactcttcaagcattgaaaagttccaaaataaaaggggtccctatattggtgtattagtttcccattgctgttataacaaagtaacacaaatttagtggccaaaaacaaaacaggccgggtgcggtggctcacacctgtaatcccagcactctgggaggccaaggcgggcccattgcctgaggtcaggagttggagaccagcctgaccaacatggtgaaaccctgtctctaccaaaaatacaaaaattagctgggtgtggtggcgggtgcctgtaatcccagctactctggaggctgaggcagaagaatcacttgaacccgggaggcggaggttgcagtgagctgagattgcgccactgcactctagcctgggcgacaagagcgaaattctgtccaccccccgacccctccactgcaaaacaaaaacaaaaacaaaaacaaaaatccttattatctgacagttttgaaggctggaaattggaaaccagtgttgctaagctaaaatcaaggtgtcaacaggctgtgttctttctgcaggttctaagggattcttcatctgctcaccttttccagcctccaggggctgcctgcattccttgcctcctggccccatcctccatcctcattgccagcagcttggcactttctctcctctctgacttctgtttccatccttacatcttctctctaactctgaccctcttaccccctcttataaggacacttgtgattgattacattgggcccacctggctaattccagggtaatccccccatccccaaatccttacctgaatcacatctgcaaagtccttttctcaagttcggggatttggacttggacatccctgtgatgctcttatgcagcccacctcgttgatatgaaattgctgctctgatgtcctgtgtgagttaccaggctgtcctcctcccagtttcaggtgaaaaggacgtggtgtttctgcttgatggctctgagggcgtcaggagcggcttccctctgttgaaagagtttgtccagagagtggtggaaagcctggatgtgggccaggaccgggtccgcgtggccgtggtgcagtacagcgaccggaccaggcccgagttctacctgaattcatacatgaacaagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacggccgacaggtctggggatgatgtgcggaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtacgcagggaactctttgcatcctcactcagtgtcattgtctggggctacttgtctggactgtgggccacaaggtgttctcaattttgcttttcctgccatgtgaagtgaaaactaaaattacaggaaaatttaggaacccacatgccctttttggcctcgatgggcagaaatggcagaggttcaaggggggagatgctaagattcatgttttggggcaaattaaattctccaaaagggacatatgtgcagcttggaattcaggactccttaactttgcatgaaagcttctgtctagatatccaaagggaggggccgtctaactgataacgcctgttgcgtatcagtcctgcgacccctggtaggtttggtcagcagccttctgtgaggcaggaaggagtctgaccagggacactctgcaagctgggacatagactctgaaatattggtatctccagagccaaggtgtgaagataattttgactttgcttggtgctgagaagtgtcttaactggcaggaaggccacctggctcttatgaccatagtttattctattttctttttcctgttccctctttctaggcctggtacaataaactaaaaaatggtgggagccctggtgctgagaaggaaggaggaaagatatatctacctctcaataaatgtcctccaagggccactctcccgggtcactcgggtggggggggttcacagtggcgaaggaggcagatgcggccttgctccctcatatgcactcacttgcctgctcttccaagaggagagaaaagaaggaaagttggggaggagcggaggaaggagtaaaagcaagtgaaaggaaatcactgcaggatacagtgggtgatgagggaggtgaggatgattatttgggtgcaactgagaggggcttggtttctcctcgctggtgcctggggaagagagcagtgtggcccaccaggtttctgtgggatgttcctgagcatttatgatcaggtaaatttgggcaacagtgggataaacaaagtgaaagaggctttctttcttcctaactaaggcgctttgtgtgtctccaacacaagaaaggaaatgcaacatttccaaaatgtatctgcctgcaggaggcctctgtgatgctgtgtcttggccccagattgccgaggatggactttgggaatattgtcacagtgcgggtgcagcttctgttgtcaggaacgtacatttccacaacgctgtggctctttgcccactcactctcctgcgctccagaacagcctccctctttcccccttctccccattcggaggcttctctcacacctctcctgacccacctgactctcagctggtaatcttgagtcctatttctccaagaaaatgcaagtaaacccaaagagagctgtccccggccacgtcatcccgtggttccttgggtggcctgtctccgcttcctcagctccctttcctctcacctgctcagtggcaccatctgcagttccctttcttgctcttgtgtcaccctttctccactgtgctggatggttccatccatgataaaatgcattgcttcttctctcttaaacaccctctctgatgcgccacttcccctgccagcagcacctgtctcctaaagacttatctatactctaaagttcctttcctcccatcctctctgagcccaccctactttgtcattcacccttgctcctcccccaagtgctccagttgaggtcactccatctgacaaggtccctgtctctggcgaagcccagtggctgaccctcgggtccctgagcagcacctgatgcagtgcaggtcacgtccttcccaagtaccatcctcgctggtgctgatgaggctcttctgattctgcctccgtcgggtttttcatcctttgctccccttctctttgatgtgtaaacactgaaatgcccaggactcccacttcttggacttttaacagtggtgattggtgttaggatcccctgcctgtgaatccatgacaaactgggcggtggctcatgaacgctaagaatttggtgacgatgaaggtgaagccatgctcacatttgtttcgcaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgaacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggcgtcccgcagttcctggtcctcatctcgtctggaaagtctgacgatgaggtggacgacccggcggtggagctcaagcagtttggcgtggcccctttcacgatcgccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgcccttacctttatggtttttattttgagacagggtctggctctgtcgtccaggctggagtgcagtggcatgatcataactcattttaacctctgccttctgggatccagccaacctcccacttcagcctcctcagtagctaggactacaggttcataccaccacgcccggctaattttttgtattttttgtggagacggggtttcaccatgttggccaggctggtctcaagcccctgagctcaagtgatccacctgctgcggcctcccaaagtgctgggattacaggcctgagacaccgcgcccagcacctttatgttcttcatgcccaccagccagaccccaccaggacacacctgcgactgaacaagttgggtctattgctcatggcatccagggagaatgcataccgtggcaaagcatgagggcatctccataggagggtggccggaaggactggggggacttgagctagtggcaggtcattttgtggaaggcttaaagaaatggaactgtggcctggattggatgttgtcaagacgtggaggtgattctgtagctgtatcttaagtcttacctagaagcaggatggccttggtatagattggtagagaagagcagtcactcttattaaccaggacagggagtgtttttgtcctttttgtggtttgcaccatgtttttctttttgtctgtgttcagatagggttacaatgtggtctcattttcatcttgccccattgtgatcacagagtagccttgtctgttgtgggggtcctgtgagatcatgtgtgctcaacaggagaaccccaaggccatgtgtgctggaccagctccccaatgcgggggctgattctctctttcttaaacagctccatcacaagagctgctcagcttccactatgctgcatttacaccgtaaattgcccaattgtgtatgaggcaaagggcaggttgaaatgtgtggagtagcaacatacaagtttaataaaatagcatctgaggagtacctaaaattctaactaataggaaaatgtggctcatctttctcaggatcttttgattaattttattgttaaaaatgcactaggctgggcgtggtggctcacgcctgtaatcccagcactttgggaggccgaggtgggctgatcatgaggccaggagttcgagaccagcctggtcaatatggtgaaaccccatctctactcaaaatacaaaaattagctgggtgtggtggcacacacctgtagtcccagctactcgggaggctgaggcagatgaatcacttgaacctgggaggcagaggttgcagtgagccgagattgcgccactgcactccagcctgggcgacagagcaagactccatctaaaaaaaaaaaaaaaaattaaaccagttatttaatagaattaaatatttttaaaaatgcgctaatgtaaagaaaatgagtcagggtgggtgggggaagctgggcatggcggctcatgcctataattctagcactttgggaggctgaggcaggaggatcacttgggcccaggagttcaagaccagcctgggcaacacagtgagaccctcatccaaaaaattaaaaaaaaaaattttaatgaaatttaaaaaataaaggcacaggcatggtggttcatgtctgtagttccagctacttggaggataaggagggaggattgcttgagcctgggaggtcaaggctgcagtgagctgtgactgtgcaactgcactccagcctgggagatagaaagagaccatgtctcagaaaaaaaaaaaagaaagaaaaggaaatagaggaataatagtgaaaaataaaaacttcatataaatgctagagatgtgtgagcaaaaaggaaatacgagggcacaaatgcctggggagcattaatgtgaccccttggatatggcactgtgttatacgtaccctgcccccatgggctgagattgcgcagcatgctgggatggtgttgggctcctcaggggtctcacttgctaagtgatggccttggacaaggcgagaacctttggcctcagctgtttctcttcttgtacaacaaagatatagatcccagtggccttggtctcttctggtagcaacagttcatgattctgtagattacggtagcccaagattgatttctaaatgctccttacattttagaaatcagtagtaacccagaccacaatgccaaaatttaaatagagtaaattcagaaagacacgttttggataacttcaaatatttcaaggagcagaaattgttttggtgtaaaaggtccaatttttaacggctaatttcaaaaagcccgagatacaaacaacacaggcatcttgggatataatcttaaggttgattaggattatggtgcaaggtgcacaccaaacctgggtgagggctacttacacactgaatgtttccctttttcttctttgatctgcagcagttgagagtgatgctgcagacattgtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagaggggggtccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccggaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccaggtatgcaccgtgtgacccatgactacagagtgtgacatcaacattttttttttagttaaaaaagtaatcagtagtcatttttaataattttcttctctctgggttgtttcttcagataatattagaaattaaatactggaaaagtagttccattgaaattgcagaaggaagcatattattgatcttccatcactcctgagactaatcatagccccattgaaaggttctgcagtgttgcactgagataattacaaactcattggctctcagaataggatggcatctttgaaatcagccagtccatgccccactgaatgtgactttgaagttggcccatgcctactggccagatgcccaatatagtccaggtcccctcattccttggcctggtgggaccatcagggagcaccttcctggaagacttgcagtcgtccacctcagcttctaccccgtgctcctggttctcgtctttggggctgcaaaagcaaagtggatctctccaccagcccatatttttctttgtccctcctccaagtaatcgccatgtagacatctgaagcaaaccattagggttggttcttcaaaggggagcagtatgcctgtttccctagctcactgctccctaccaggctgcctgtggcacatctcacatccctcacactgtctctcatcctttctcctctctattccagtctcagttgcttaattataatcaagaaattaccctccacaccactgatattcagccagctcctacaaagctctcagaccatcatccaaaggttaaggggcctcttcctattttccaatctgtttctcctagtccttccttgctttgcacctcacacacatctcttcacttccaggaactatttaaaattcttgaccacaaaggaaacttctagtggcatttcctaaaacacttgagatcacaaatgtcaaagccaggtccctattgaattcttgtcacaatgccattttgcacgggataactgaagttctctgtcactgagttttcacagagtgtgacatcaaataatttttctcctttcctttttgtttagaggatttatcattcatcttcttgtatttagcatgtttgggagctgcaaattcaggaactacaggctaaagaggcatggatttgagtgaaggtttcactgtgaataaattattaggaatgtcttatttcagttatttaattttaccttttgtgtatttatgttctgggtctggaaacctaatctctccttattttcactttaatcacttctagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgaccccactgacgaattcttcctgaaggacttctctaccaagaggcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcgccacagcgttccgcgtgggcaacgtccaggagctgtccgaactgagcgagcaagttttggaaactttgcatgatgcgatgcatgaaaccctttgccctggtgtaactgatgctgccaaaggtaactcccattatgtgcatattttccatcctttcctgttgacatttgtgcctctttagctgtctggtccctggtgctgacctctggagtccttaggcatttggttgcttcatacatttacttatacccactgggactggtcctgacacccacctcaccactacctagggcgttcttccaagacaagagtagaagtctatcatattttgcttttataagatttacttttctcccctattccttaatccctcaaacaattcagatttattgattcctgtgtctaattatagatttattagatcaagtatttgagatcagaatatttgattttcaagtgcttttaatttaaagcacaaacttggggtgcatctaaacaccagtggtgtatcatcacaccaaagttaattaacaccaccaacaaagctgactttttaaaatagcttactatttggcacctaacagctaccctcatttctctctgtgagaggggtggatagaattgcttctcaaagctcacacacacaggatctcattttgcacttgagtgcgatgccctggtcctctgcctgggttgtccctactgctggtataagtagagttcgtctcctcagccccagctgagaactcatcacctgcatttctcctttccagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtctgtggggccagttggttcaggtgctccctgggaaatttccaaatttttactggaaaggaggaagcccttcccccaagttaaatcctcttcatgtttcactggattgttagtgtctatatggaaaatcccttagttattaactgatctaatgtcatgtactgtcttcctcattttggtagtcttacgtaagctctaaaagaatcctggaaatcagtagtttaacttgaatgagttgaatttgtgattgatttatgtttaattatagtccagtcaggtacgttctccactttcatttctctgtgtgtatgtgtgcatgcatgcatgtgtgtatatacatgcatatatattgtgtagacacacacaccatgtgagtttgctagggatcatcatgaagtactacagcctggcgggcttttggaacagacatttattttctcacagtcttggaggcttgacatcctcgaggtgtcggcagggctgtttctcctgagtcttctctgcttggcttgtaggcaggggtcttctccctgtgtctccacatggctttctctctgtgcatgtctgtgtccaaatctcctcttctaaaaggacatcagtcatactagattaaggttcactctaaagatctcattaaccttaattacctctttaaagaccctatctccaaatacagtcccattcttacggtactggggtttaggacttaacatacaaattttgaggggacacaatttagcccataacacatgcacacatgcacacacgcacacacacccacagacatgcacccacacacatgcacgcacatgcacccatacacatgcacacacatacgcacccacacacatgtacacccacacacccacacatgcacacacacgtgcacacacatgcacacacaatgcacccatacacacacatatgtacccacacacatgcacacacatgcacgcacacatgcatgcacacatatgcatatgattcgcagaaactacatcttagaaatatgagaatgagataaaaattgtttttattgtcattgctgcttgtcttttttaaaataaattaagcactcaaatatactcctccattttaagtgcaatatcaaagtcttgtgaacatgggtaatcattcctcaacttgggccctcagtttccttaagtgtaaaatgaagggcttgagacagcgagtctctcagttttctatcagcagtctgcaacactcctttttagttttcctgggatttgacagctctcttatctgcaggtggtcattcattttactgatggagcagacggagatctggctgatttacacagagcatctgagaacctccgccaagaaggtaggtgccaaggctttctaaatatgagaagtaaaccctggtgaggcggggtgtactgctctgctggagagaaacctctctgctaatgcagcgccccaagggagcagcgttgtcttgggagactcttcctcccagcgttgtggcccttcatcacctgcttggagctgtgggatggagctaacaaaaattccttctgtacttagacagctttactgttgtgttgtggctgttcaggtggtagaatgttcagaaagcatgatgcttttgcaaaagatcatgacgtattgattcatttaacttcatcacataaactaggaattagttactaataaaaatacattgctctatttttggtttgcagttatcacagttcaacatttaataacactacacccaaataatacaaagaaaataatgtaagcaatgacgtaccaaacataaggtgacagccatgcctattatcagatgtgatctttgactattcacttgctttggcgtttggtagcactgactatcagaaagtggatgccattacagaagtgtaatttatcctaagaactttctatttattagcttacttttcccaagcaatggagatgaggctgctattatctgattttggaggtgttagtatttcaatacttcccacagcatactcgtgttacagagggcctgagtttgagaactcatgcatgaatacacttcatggatgccacttcctatatttttagtaataggtttagttattgacataccggaaacaattattcagcagagtccaaagtttgagtatttcaacaattcagagtagccagtaaacttgattaaatatatttaagttaaaagctaaattttacactgaagttttctttaaaaatgtagtcaggaaaaaaggacattgcattttccacatgcctaggtgagctgtattaaatgtgtctttctttgcaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgtgagttttttttatgtctttatacacagaccagtgtagataccacaccttttggcatttcaagagaatgaagttaattatcagcaggtgaatggaggtggggggggggccttggtagatagttaaatttatttaattcacttgggaactgccttgttgccataacacatgtgaatctggaaatggagatagcaaatcgctggaaatccagcgagctggaaggggatcctgggcgcgctgaggttgtggccttagcattttctctgctcccttagcaacggcctcttttaacaccattgcagggatgcaaaccatcgagattgtccatcctccaattggaaactgtgtcaagagcatctgaaatcttgcatgataaaaacaacatgcaggaaaagaaaggctgtttctgggtggagaagtgctttaattgccctccctagtttccctctgtgtcaatgaagctccctctgaggcttcctcattctccccagggccagcctctctcagctggaggtgtgacctcctgggtttagactggggatggagcttttggaagatgtggggctgagctgcgaactcagagattctttgatggtagcaacagtggactgtggctatgagaatgggaggaatggaccttcctttcttccatacttctttgcagggttagaatcaggatttttttcctagtggaagtaggttgagttagctcacaaatctgggatatgggagaaagggaaagctcttggaagctcgttggaagaaagtgcatgtgcccaccattagtttagcagatggaaatgtatttgggcatgccctttcccacataaggtcaggggccagatgggatgagaatgtagagggtgtctgtgtgacctggagttgagaagcttttggctccgaggccaggaccacttgtgcctgctcccaccatggctgctctggaagcctctttctgggctggtaccatatcccatgactctcaccctggttccaaggaagggtggtcatggatatctgttctggaaccaccttcagtcttggccatctgccatttgcttggctttgcactttggaactggaacatatgtaagttatagttaagatctgatgatggaaacttctagaaataaggtccagcctgcagtgatattgtggataagatctattttactttggttgttctttactttcctattggtgacctcccatctgcaccccgaccgccaggagctgggccctcctgacttcgctggcaatttctatcatatcgtcagtcgtccagcaaatgtcacctggagggacttcatctcacaccgtgaaacccccacacatccgattttgacccttaaagcgcatttatgattttctgctgggcatttcttgagatctgaacatttggtttctcttcctttcggtaggacaacattgccgagaaagcttgctgtggggttccctgcaagtgctctgggcagaggggagaccgcgggcccatcggcagcatcgggccaaaggtacggtggctttacccttgcccacgcctgagatgaggtgtcagaagcccgacattactttggtggggtaatttctctaacagaagagtgtggagatgaaggaggagacgagagaccatttcttatgttagaaggaggagctctgaggggcagacctgcgtgctgttctgctggggcctgttccagtgaagatggttcaggcgggaccctccttttgcacaggataaggggatctgtgctttaacagcttggtccttcatttcataaaataatgttaaaggcagctggcgtccctgacagcagcctggctgcgaatggcagctggaactcatagcatttgctctgagtcagtaggaactaacaggctttcttggcagagcaggagccttagagatcctgatagagagaatcgtgacatggtgtactgaggggaaaagcagtaacagggaaagccatgctgagttttagtgctgctctgccaaatgaagggggaccacagggattcttactgtagagcaaagaagaccacgggattaaacagaggacccgattactttgtttcagggtattcctggagaagacggctaccgaggctatcctggtgatgagggtggacccgtaagtaaaaattgttttagtccctaaaatttcaccccctccttgatccttacccattgggattgcattgtggatttcatcatttgttcagttgctgatggctttccctttgggagaaaaattaatttatacttttcttaacaactttgcctggatgtctaagtacgataattgaagtatgacaaatgtgggcatgaagggtgggatttgttcttactctgtttcagaaggagggattaattggtttctgagccagagggacaccgaatttgcacacccagtatctactagattaagacatgcaagtagagatgggagtgagctgaggggcagggacacagcaggagacctcaccagggctttaggggttaccccgttaagggtagtccctggaggggatgttgctggatcagatcatcagtatccgagggtcttggggatggacagaccccagtagcagggtccatgggagcaatgcccaagacagacacctgtctggggagctttgggaccctagatcaaggtccagccctgggataggggacagaggggctcacgaggaacagtgtggtcaccagggcccagccggcagggctcggctagagaactgggaatcaagcatcacttggaggagctgtcagcccggtgggtcttcccgggattcagcacccacagagacacagtgctgggggccacccacccttgccccacagggcagtgctgtctgcgctgctaccctcccagatctcattcccttcagggaaactgcaggttccaggccaggcctcatgcaggggcccaagaggctccctggctcacgtagcctcgatcggcgttccccatggtgaaatctgctttctgctgcatgctgttcacagtaccctttacgctgctgcaagcccggcagagaaagggtgatgaagggctccagcttgcaaaatgcctttgtctctcacaacagggtgagcgtggtccgcctggtgtgaacggcactcaaggtttccagggctgcccgggccagagaggagtaaaggtgaggcgtgggtgatggggttgctagcgtggggaggggtcaggtgactcgcagtttctccagatgctgccagggagggaggcgctggtccaggcttcttgacctcagcattcagcagcccgtgacctctcattggaaggcagttctgagcagggtgggttcaggagcaggggctgcagctggtggggagcctgagaatggagaaatagtttcctgtggaaacatgaagaagccaggaaaccctcacaaggagagaacatgggccagggcggagggtaggctggtgcccacggccccggccctggaccgtgggagcagtcagggaagggagtggagtgagaggacagcaggtgggttgaaggctggtgaacttgcttctctgtttgctgaagtttgaaggcaggtgctgaagggaagggctgcaaagttacaaagtcagctccttgccctgggttttggggtccacccccgccggcccagggagccaagaccacccaagcattcagttctagttttagttttaaaacatcgcacgtggtggtgagagaggaatccaaaggggtaggactctaatattacattttcagacactgcaacattcaaatggggtggagtgggggaacagcccttggcctcttctgcccgagggaccagccctgcaggaaaagctaatgcttcccctatcgccttgccttctagggctctcggggattcccaggagagaaggtatgcaagcttggttttgttttacaaatggaaaactctcccagtatttctcatttcttcctttgccagaatagctttctatacttacctgtccgccttattccctcttagggcgaagtaggagaaattggactggatggtctggatggtgaagatgtaagtgattttactctaagtccaaactgcttttggttctgaagattccagaaactaacaactcagtctgtgatagaaattgcagcaggtgtgacctttaatccttgtctttggcagggagacaaaggattgcctggttcttctggagagaaagggaatcctggaagaagggtaggtgtatttccacggtggtgctattatggaaagaatatcaacatttcatttagggaatagttattttctttcctcatatacatcaagcccgcttcctccaggcagccttccctgacctcccctgtgagtgcacccattacatcccctctcagctctgacacattacagtacattttcttgtttcgagatcacatcccatagggcagggactgagtttgttttgttataaataaatctccagtgcctggcacaaagtgggtccccaataaatattcatggatttactaaacgaatgaaaaatatgtggaagtgaatttgccttcatggtgaatgagtaaattgtaaacattgttctagttaagatttatgagttgaagaatgtgatttttagggtgagataaaaatggaaacatctagtttttagcatccacttgtgctttttctttagggtgataaaggacctcgaggagagaaaggagaaagaggagatgttgggattcgaggggacccggtaaagatttctttattgacgatttcagacctgagcctggggaagagggttgttgggaaagggggatgaaaggaagaattctacttttgaaattgctttaaaacacgttgataaaatatgtgctttgtctttttcttgcagtttgggggtttggggagatgtgttggttctcttgctaaccagataatcatttgcaagtcctgttatacaaatatctgagaagtttccaaaaatgtggtatcagggcacttcaaatttgcttttggaaaagagaagagtttgcagcttttctcattttgtgtctctgtaaaacgtttaagcaaatgagcagtacaagctagcctcttcttccagtccatcctgcctctgtggccaaggataagcaggagtgagcctggggcatcctcctccctggggaagaacgattgcacctgtttggggctaagagtgctttgctgatcccgtgattgggtttcgtaagacctgcatggatgttacctggatgggttgtggccgaagggcttgtccctcgaagccttgcatgcaggtccttgctaatatttccctgaccatccagtccagtggcagctgctttccttccatatgtggctcatttccctttcccatgttgctttcagggtaacccaggacaagacagccaggagagaggacccaaaggagaaaccggtgacctcggccccatggtaaggtgctgcacattcctagactctccctgtactgagggcaagagaaaggacacacttctcggctcatcagcagccacagaggccaaagacgtggcctttaacactgcaacgtagcctaagattagcagcagagtccccgtgaaggaagtctccgtggggaaccagagtgacccttgccaagtggggcttctcagcagaatctgtgcctcttagatatttacggaaggtgcttgttaagccaaaggcttgtagaggtgggagtgtactgaagtccggtgcatcctgcaaagtgtgcaactgtcctgcagacgggctcttcctctgtgaatcgacccctttccctgcaatgtcttgtgcagcatttcagagctagacattcttctctgcagatgagaatctcatgctaattttccccacaccagggtgtcccagggagagatggagtacctggaggacctggagaaactgggaagaatgtgagtgccattagggctttggggggctctgtgacaattcttagtgccataagatctgcccaacatgacctggtgcatggttagtccacagctctgcagtgagtgaatgtaaaaggatttctgaaacggttgttactccaatctattttcattcttataatttccctggtgcttcatctcttctctctccccaattcttgctctccccaaaaacatactgaacagatacttttaaaaataatatctttgctactttcaaatatcgggccaggtttgatccaactaaatatttaagagacccaaatggaaatcctaatactgggggagggagggaataaggggcaagagggctgagggagttgtggatttgttgtttttgtaattatctgtgggtttttggggggatgctgtaagtgaaataaaaaaactagatttcttctttttctggcgtattgcatcttgcaatttcaagacatttcagaaatgtctgtagcagaatagctccttgtatgcctaatcctcagtcttgttgaataaatgctaaagtcaaagtgatgtgaatgatctttctgaagccaaccaaaagcttccaaggtcctcgggcacagacagcatctgccttgtagctgggagaagaccagtggtgtagaagtttgtaacctctcagaggaaattcaggatgctggtgggtgcctaggggaggtctctgctcagaaatgaacagagcacaaaggctgcaagctggggctgggtgctgggaactgggccctcagccacgccctgaggggcagtggctcgttcggcccggcacttgggccagtagagttcgctggggtgaggggctttcaaaaggagcgactcaccaaaatcaaattgatggactatgggcatcattttgctttgaaaattcagaagaaaatagaaattttgaaaatatcattttaaaatgtttgagcactatttatttatttatttttaataaattgtaaagacctggatcaactgcttggaagtgagcattatttttgaataatgctatataatgaaaaagaagctatataatgaaaaagaagaaatactcatcaaatgttacaatgggctattacaactcagcgtgtgagcagagccaaaacttggtttcatgaaatgacttaaaattgagtagttcatacaattaatttcaattctacacacaaggtagaaactggatttgaattcggtttcagtcacgggctcttgaggactcagttcttccttttgtggtctaatggcctgctatcccttcccttaggaccacagtgccaggctcaggccaagctgaaatgtgtccctcccactgggcttcagcatgcctacatcccctttctagagtctccgcaggcggcctctggcctgagcaatgtatcactgagtgctgctggactctcatggaactctagcatgtctcttttgggaggggccaggccagattgttggtttgtagaggagaacagtgtccccttgtctcaaattttccatggaaggtggccaagatcttccgctgaagcaggtggcattacagcgaataatggcaaactggtcaccgcagatcactgggctggtccattggaagtggagagtgaggttcctaggttgatgtagcagatgactgagccccacaacagagctagtcggtcacagcctctgcaacaccaaccctaactttgcaaagaccgcctgggacattcataaagtcccaccccaaacctttctactgctgaggaaacaattttgaggtggaaattaatggattacttgtgaagtaagcccacatgtttgaactaaaggtcacctctggagcatccaggaagatgttgccaagtcgtgagccctacctaagtacacgagacgtttaggtgcacatgtgtgtgcttcagatattttacttaaccgagtgtgtgttgtgtttggccgggatcacttggagaacctgggactcccttccattataattaatgtatttcatgacttctcagtacagttgggaaggtggaagaaaaatagacaggttgacattcccttttcacattcctcatttgaaactggctgggatcgtgcagccaaaaggagtcattattttgcttggcaggtctgcagtaattctcaaaacttccattgggtgattaacaggagcagcaaggaagcaaaacttcacccggatgagggtggaggaagggtgtctgtgtgtgcgagtttccccagggctgatgaggtgtggtttctggttcttggcacgatgtgggtgcttgggaagattcccctgagtaaccgcagaataagagggtgaagtctgaaagagctctaggccccatgcccagcgtcccatgctccccctcacagtttgtgggactttttcttccacagggtggctttggccgaaggggaccccccggagctaaggtgagcctcatgcagtgccccctggagactctcttcaaacagcccagatgccgcccagcccaggagtgaaaaacactctctcctgtgaacccaaagcttcggagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattggatatgcctttgtctcccatgagcagagggatgactttcagttctgtctgtcctttgtccacaaggaatttccctgtgggcagaatgtgagggaggtattcagcttaaaaaaaaaaaaatctggccaggacggtggctgatgcctgtaatcccagcactctgggaggctgagacaggcggatcacctgaggttgggagttcgagactagcctgaccaatatggagaaaccccgtctctactaaaaatacaaaatagccaggcgtggtggtgcatgcttgtaagcttgtaattccagctactcaggagcctgaggcaagagaatcacttgaacccgggaggcagaggttgcagtgagccaagatcatgccattgcactccagcctgggcaactagagtgaaactccatctcaaaaaaaaaaaaaaaaattctttgtagctatcttatttaagaatagaatgggaggcagctctgtctgatgcagttcccagcttgacttttccctttggcttagcgattttggggttctgagatttatttttctttcatcctccttgggctgttctggctcccgaggctctgtcagccgtctccttaaacagcctcttctgcagagtctagagaaaatggtgcccagtggggacttggggtccaagtgcaggaaacatgactgaggcagtagtgtcccgggcgggcgcctcttccagaacgtgctcacctatctggccatcagcaacccgcaacttcccggtgtctcggtcctctgctttaggtctaaatgatccctgtttcacaaagctgtccgaggagaggtgaggcaagagtgaggaacaattgtagaagtgcagggagacagctggctcctgtgctcagtgtctcacctggggttaccgctttgatcatctgttacctctggaagagctgagttttccctggttgctttccaagtccctggcccagaaatgactgtagagcaaagagctgacattgacaggaaccatcctgactcctccctgcatcttctcttatttcaaagggcaacaagggcggtcctggccagccgggctttgagggagagcaggggaccagaggtgcacaggtgagtgcttccgtgtgtgactgtgtgccctctgatatttcacaaatcatttaaaaaatgattgggtggcatttatatccggaaagttaaccattttaaagtgaacaatccagtggcatttggtacttccacaatgctgtgcaatcatcacctctatctaggttcaaaacacagtctcgaaggagacctgtacccattagcagtcactccccatcaccctccaccccgagtccctggaaaccactaatctctctctctttatggatttgcccactatggatattttgtataaatggaatcatttactaggcagctttgtgtgtgtggcttgacggagcatcatgttcttgagcttcatccacattgcagcatgtagaagcacttcattcctttacatgatggaaggatactctgttgtgtggctacagcacactttgtttatccactcattggttgatggagatttaggttgttgccatcttctggcaattgtgaatgatgcttctgtgaagattctcctacacgtttttgtctgaatgcttgttgcttgtatacattttaagctcacttgcctattcacgatctggattgaggcagctgctactgcagctaagacaggataattgtgggttttggtggccgtttttggccagcagaagtgaggttccaggccctgtgggatgggcagatgccatgcagaggcttctcatggaaagtcacctcattagcactcacgatggtcttttccttcctcagggcccagctggtcctgctggtcctccagggctgataggagaacaaggcatttctggacctcgggtaagcctgtcctaataccagccccctctctagctgaacagagggcacattgccaagcaggctgagagagtttctcggatgatgctattgtagacagacctccctttagctctcctctttggcaacaaaaaccccagatttaacctcaggccttgcagtgactggctacttcaccccaagaaagtaagagtttccttttttggtgctccatgggcctctaagtctcaattctgctccttccaagtgtccctgggtggaaatcaggggatatgcctcaggatggaatcctggaaaatctaaatctaccaaaatgcttagattctgcaaggtgtttcccctttggtccctggagatagccccttgtgcttatgtattttgtatagtgagtgcctcaagttcacccatgagttcagcacagaagatggcccttaaacttgctgtgactgcagatgttatcttgcaaagcagctatcagcaatgatgagcagagacacactgtcattgctgggctaggatcaggtgtcacggaattacgtattcgggtttccctcatggctgagatgatattgagggaggcatcctatcatttattaccaaaaaatgactaataaactggtaacgagctcaatatgttgctacataaatgtacaaaaatattttatggtggaagcaggcaagaacttgcttagaaagtccttctctagcttgaaagctgataaatacatatctttagacgtttttaaaaaacatttacttaacttgtaattaatcaacaatttaagatggtatagatgcaaagctattcaaatagttatccagtagctccagaaacatttattaatttgcactttttcaccatctcttttatgttatttgtgggttgcgtagactgtaccacattttaagagttaatttcatccatcagtttattcattcacctaacaggctttaacatgcccatatgtaccaggtgctcactgtgagggtgtgaaaagggaggcagaataaagtcacataaaatctgggagcttgccgtcctgtcaggaacctaggatatgtacattaataactgcaacatgcattaatttgtgaaaactggcactgagaggtaatactcatgttttaaatttgtgcatgccatttctgtgcatgtttatatttgagtccgtagccccgtgctcagagctgagtgcttgggatttgcaggtgggacaggttccatgcccctggcgggctctgacttccatgcaggggagagtcaggtttcagagaccaatttgcctggacggttggccacttcactgacacattcctcccctcctgctccagggaagcggaggtgccgctggtgctcctggagaacgaggcagaaccggtccactgggaagaaaggtttgtctttagaaaggtagagctttcctgaggacagggaccagccaggcacacatgcccctctccctctttggtcagtctgtctgtccctcctcttcagtactactggttcccactccagcctcccctgttgatcgcggcttggccagtggaatcattgtcccccaacaatccccaccataattcccaccaccatccctgccaccaaccatctctgctcagagggctggctttctcctggccacagccctccatcagctgccaggttttctgctcctctcttgcttggcttgtgccaatagtgcagcaccctctgagccatcagagcagccgggcagtgcttggtacagtttcagtataatatggaacgagcagtctttaaacatgggcagtgcacgcacagtggctcagctaatcacatttagatcatccaagagccccgaccctgactgtcctggataacagcaagtctgctgtatgaaggctgcctgagaacctcctttctatcagctttgagataaattacaatttgtcataaccagtccgaaaagactgcatgttctctgtaaaagaaatgagttcctgtgaatccacgatggtctctgcctggagagtgttttggggttttatgctgggctcaatgcccaccgccttccgtgccttcttctcccagttgttactctctcttctcatcagcccgtcccccatgccacgctggtgaaaaggacaaacaaaaccctcctggattcttttccaggagtttgcacatgaatgttgcaatttagaaaatcattccaccgaaatctcaaaggtgaagtcagcatgttgcagcacccttacctagagcaaaagcatggcttggcatcacactgtaagccagccccaggccacagggtctcagccatgtttctcatgtctagggtgagcccggagagccaggaccaaaaggaggaatcgggaaccggggccctcgtggggagacggtaaggtcacagcgcgcttggggtcaggctgtcgctgactctttgctggaaggtgcaggaagccaggagagggttccaaataaagatgagccttgcttcttgtattattggggatacggctggaaatactgaaacttgctcatctgcggcaaattaatttaacaagttttattttattggcaggggtagagaggtggggcgggccgtggggagagacattttttcccctgtgtttttcctgatacaagagaatgtagaggctaatgaagcttaaactaccttcatcttaggtcccgcaaatgctttgcaagcataactagatgaagcttttctgcaaagaagtaaatgtcatttgggttaaaatggaattggatttgattaggtctcagtccagatggaaacaatttcttttgaatgagacatcttaggaatagaaattattacctcagtaactcgttttttaaatgctatttaaaaatgccccaaaaactcaccaacaataattttgtgatgtacatttctacgttacaaaagaataaagaaatctacggtccattgtgactttttccaaaaggagtcatggcacctaacactgtataaaaggaccaggttgatctgactgttttaattccaagcatcaaaatatttttctgtctttcatttttgtcttttcaactaactgaagtttaaaaacgaatctgtttgtattacttttaatctcagaagcacagggaaaaaatcagacttcaaaccattgaaggaaatctcttcctgattctgtttctagtaatttgggtcaacagatctctagttgttgatatctgttgaaaactgtaaattaactaagtggcaattcctacatatgttagagatagtaatgtacaattcacacacgttcttctgattcttctgattcataattaatgacgtccagttctgaatgctcctcatgagagagcaacaggaacagatctgagcatgctggggggaggtgttggaaaggagggggtctaggggtgatgacttggaaggaagggaagggatatggggagggggaatatgacctgggcctgagagatggagttcagtgttttggttttgaagtagaatcaaagacttacggatgcatagaatcaaagtaaccatcaagattcctgtcaattctaagattcttggggttgacgagtctttgattctacatccaaacagaatctttaccaaaagcaaccagcagttctttctatgttagtccgccagtgccattttgctacgggagtcctttgagcccaccgcctacagaaatggtcttgttcacacttggaagataggacaggagcaggaagtgtgcctactcctgtaccttagtctgcaaacatttcaggagctcaaggatccacttctcaggggcagcggcagggcagagacggtggttatggtgtgccaggcatggcgacctacagtcacatctctttcccactcttagggagatgacgggagagacggagttggcagtgaaggacgcagaggcaaaaaagtacgtatctgctgaggattatccaagcgtccttgctgccaggaggctccaaggacaacttctgatgtgttgtgttttaaaagaattatttctttaaaaattgtctttgtatttgagtgagtgttttcgtttgatgactcagcagacatttctttctttcaaggtcaatttattttagatgaatttaaattagaaccaagtattaaataatctatttttcctttatagggagaaagaggattccctggatacccaggaccaaaggtaaataatccctggtcggtgaagcatcatcatgattttgggatggctctggtatgtccatggactgagaatcagaatatcttggcattagtcttgggtcagccactcagttaactgggctaccctgagaaagacccttccttccctaaaatactctctcatctgtcaagtggaggtcataatacgtacttgtcctggtgtttatgagatttaaataaaatatgctgcaatcaaagtactctgtaagctgtgaaatgctataacctacatgatagtatcattactgattaattaaattaagaccatctgcaaataccacaaatatagtagtaacccactggaaaagtgaatcaaaactaaccacttggctgcccgggaaaagtgtgacccacacgtctcctggatgtcttaccccacggaccctcagtgagatcttctgttccaaagcttactgtgccacttctcggctttcttcccagggtaacccaggtgaacctgggctaaatggaacaacaggacccaaaggcatcagaggccgaagggtaagtttgcgtgggccttggctgcaggtgaggaatgagaacgtatgtctcaatgtgattaactgctgaggctttgacaattatccttcacttgcaccctggccagggatagcacagggtggaaggaagggaatcctgagccccagaccaatgtcctcagggtgccaccatggctgtggtccatggctctcctcctgtaggtgtattcctcttcctccaactcacctccagggtcgccagcccagctcactccaggcacagcacccacctgcagtctcgaatctcattatgggtgactgggaagtctgtgcagtcactttgggccatgcccacccagacggccaggcaatgggagtgaatgaggcatggcaactgcttctgaagcctctaggcttgcaagcgagccaggccaaggccatgggctcctcagactactggtgctgagattcctcttccttaagctacttttagccctgatagctcttttctttttattctttgtgtgtgtgtgtgtgtgacaaggtctcactctgttgccaaggtctcagtctgtcatctgggcggagtgcagtggtgccatcttggctcactgcaacctccatctcctgggatcaagcgatcctcccacctcagcctcccaaagtgctgggattacatgcatgagacaccacacctggccagattattcttcaatggatgtttactcaccctcttaaaatggcagagtcttcaattagcaaattgtggcctagatctgtgtaaaggttgctaacagttattttcagcctgaaatgtagtttaaaaagaaacataattatcttattaatttgatcagtgaagacagtcaaactagatcatttaatatcccaaagagctttaaaacattggatgattatctacactgaacgcattagctaattcactgtctgttacctattctcctgggagtccttagtaatcatattagtggttcttgggaaagcacctgtcttaccttagcctggcagagaacacaatatacaacacctctatagttggtgggggactcccattggctttgttgaggttgcttgtccctaaacttgaatttaagagacattttagctcccttaaagtgagagatttttcgtggtgatggagtcccttgggttagatcacttttaccgtaccttccaactataggagccttaaattctccactttctgacacagttgaacaatgtttgttctgctccctctagggaaattcgggacctccagggatagttggacagaagggagaccctggctacccaggaccagctgtaagtatttatccagttctgacccggccacctggggctgggtgctttacacgtggtccctgaaaacttcccaccatctgctttgctcacaagaaaatgtgctctctttgtatttgcttggttgtcaaaccgcctctctgacatcatgatgcagcaaagagattttgaattttagagtaacaagaaactttaaaaaaataggtttcatgggatatcctgtcatctagggagtattgtaatttgcctttatagtttcctggcataggtgcatttgaggtttgtgtagaggagaaaccaaagaggggaaatctaaataccttttgcttgcatcttgtagaagcagtgtaattatgccaggccttggtttgacaatgcttcctgtggtctatgaaatccccaagggagctcctgatttgtggttaaatcccactagtcatgctgccaccaggagccaggagggcatcctcccacagcccttccaaacctctttattgctaatacctttgttttcttatttgaatttctccatatattgtccctcaatattgaaattggtgagtttcaaaaaataatggaaaagataattcaggagttggaaaatcattcctagaaggaaaggttcagggcttagtttggttgaattagggaaaagaaagctggtcaggtgggtctgattgctgtctttaagtaggtgaagtgttggggggagcacattaagccagttcctgcagaagaccaagcaggcagaaatagcctcctggaaagacaactaatggcccatgagatgcctgctgggctgtcagggtggtgaggtttaggcatgggacactgagggaagccacgagtcagtccctagagctcctcggggtggaattcagctgggatgctttagacacggagggagccagggcagctcaatgatctctcactgccccttcggcaggggacagcgtatcaagcgtgtgaaagggagctcttttctcaagagaagcagaatctagacccaggttcactcgtgggctttacatggattggtggtgagcttcctggtttcagaacatgagactatttcaaaggccaaatgacctcccagggaaacacatttgctccagaatcttctcttttttgctttgcaagggataagatcaggtttagagggagaggctgtaaacaatcaaggttatccaggggcccctttgtcttgctctgtgtatttctgggggccaaagcctgtttattcgaattccccatctgctgtgcctctcacctttcgttccttggttttacagggtcccaagggcaacaggggcgactccatcgatgtaagttgcatgtgtccagaatgactcattaacctcatgagcctttgatttgctctctttacatattcttttattttcttttaaagcaatgtgccctcatccaaagcatcaaagataaatgccgtaagtacatgattttctgttgtctcacaatgcatatttttacattcgaaattctcacatggtagagtagtctctcaccctttcttctctttgcttcttttctagcttgctgttacggtaagttgattttggtgactttctcctaaggaaaggaagcctcccttttgtagtaagtacagtttgtctttaaccctccaccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgaggaacggattcctaatgaggaaagtggctgttttcttcagcaacacacccacaagagcatccccacagctcagagaggctgtgctcaagctctcagatgcggggatcacccccttgttccttacaaggcaggaagaccggcagctcatcaacgctttgcaggtctgtgctctgtgcgtgctgttggcatctccctttcttctggggctctgagaaggttctcagacacgtccatgctcctttgtggcttcatgtcccatagctcctaaaacgtccccaatgaggccatctgcctgagaacttctcttgtgaggtctccaggacaacctcgtggctccagcactacagggacgcctacatgcttgtagcactgcccccaggtccctcctcacatgttgacagctcttgccggttagtgatgctagtgttggtgacactctctatctactaacaaggtggtgtgacttgtttgctttattcatgaggacctggacgtttgcatccttcctgtctcctcccaagatggccccctgtgcacactctgagctgtgtcttactgtgtactgggcatttgcttcccataactggctggtgaggtttgtatcatcagtctcacctcatggataggaagatcctgctgttagtgaggtgctcgtgagaggctaggaccctagtccattagactctgaaacccatgtgctgatgatacccattccagtctccactctgtcccaatcggccctgaaggtgaatatccagggtggccctggaggcctgtagtctctcagtgaggtccccaaaactatgccgactcagcacccccaatctacaccacaccactgtgcaaagctttcttcagtgaggccccaagggtcagcccacggagaggccaagtgtcgcttgtaattctattaaataactggtttaattgtgtgttttttttttttttttttttttttttttttttttttttttttttttttttttttttttttttgagacagagtcttgctctgtcacccaggctggagtgcaatggcgtgatctcggctcactgcaacctccaccttccagttttaagtgattctcctgcttcagcctcctgagtagctgggattacaggcactcgccaccatgcctggctaatttttgtatttttctttcttttttttttttttagtagagacgggggtttcaccatattggtcagactggtctcgaactcctgaccacgtgatctgcctgcctcggcctcccaaagtgctggggttacaggcgtaagccaccgcacccagacaactagtttaattcttacatcaattaatatttattcagtgcagttctggcgatactgttcaagacagatgggtgatgggtaggaaggagtccacccgggagtcaggaggccttggcctggttccacactccccccacccatttaaagtaatgtgcacgccacttagcgtccctgcgtctcagatttttcacctgtaaattgagactggggcaggatgattgctaatgtctttccttccacattggatattctatgcttttaccacagcctgtgtcggcgaaagacattgggtcatcactgccattcctcagggcttgttctgccgaacacaggatgatttgtgcatagagcgctgggcttgggaattcagtgttgaagttgggctaccggccatgtgctcttgatggggggattcattcacataagtctgtccttgtgtgggctgagggacccagaaccacgtgagtttcttagcatggtttcaacgagatcaaaaaattgttcattcattaattatttgctcattcattcattcaaactagctatttgttaaatgaataattactaatcgtgtgccaggtacggcgatagacaggactctttgcacccactgggagtgattttgttacttgctttaaccacacctgagagggtggggaagggatggagctcccatattgttgctaaaaataacgataagattaagttcctactatttgccagaggatacaccagttactaacatttattatctaatttaaccctccaaatgacaccattaggaaggtattaccccccattttacagctgaaaaaaactgaaacccatttgaacgggatatgaactccagctcaccctagtagaataaaacctatgtctttctattatactcagagcctaaccccacccccaaatgagaagatattcccaatactgccctattgggaagttaatctattttattgatgtagctttgatttactcctctgccatattttcagatattactgatcatgtacgcccctaccaaaattgttcttttgtttaaaccagatcaataacacagcagtggggcatgcgcttgtcctgcctgcagggagagacctcacagacttcctggagaatgtcctcacgtgtcatgtttgcttgggtaagctgtttctctaacaggaagatctgctcagctgcaattgcaaaacataatatccatgggagagtgagagaataatgatgatctgtaaaaagagcttgagttcaattgattcacaaagcctcgtatttaccagagtaaatactactgcagcagtttctatattaaaaatggacctcccaaaacagagcttctctttgatggcggataattcattttataggtaacaaaggaggaggcagtttctgcttaagttttgacattagaatctagaatgaaaacattggcactagtgactttctagaacatatttcttcaaagagtggcagagaagtaatataatttttcatttcttttaaaaatgccagcacatggtatgctacaaagattttaggttagtgatttgtttcatctactaagtattaggtgatagaaactgaaatctggccataatcaaatcaaggcaagatataaattggttttggttgtgatgttttttttttttttttttttttttttttagacagagtcttgctcttgttgcccaggctggagtgcagtggcacaatcttggctcactgcaacctctgcttcctgggttcaagcgattctcctgcctcagcctccagagtagcctagattacaggcatgcgccatcaggcccagctaatttttgtatttttagtagagacagggtttcaccatgttggccaggatgatctcgatctcttgacctcgtgatccacctgcctcggcctcccaaagtgctgggattacaggcgtgagccaccgcttccggcccgcttttgatcttatgtgatcattttaatcgcccaagtctcccagcagattgatgagctgtgtatcctgctgtgggtgtcacagaacaaataggctgccatgcttctttctagacatctgcaacatcgacccatcctgtggatttggcagttggaggccttccttcagggacaggagagcggcagggagcgatgtggacatcgacatggctttcatcttagacagcgctgagaccaccaccctgttccagttcaatgagatgaagaagtacatagcgtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttaggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggaggtatacaccttcgccagtgagccaaacgacgtcttcttcaaattagtggacaagtccaccgagctcaacgaggagcctttgatgcgcttcgggaggctgttgccatccttcgtcagcagtaagtcctgcgtggcacagcatgtgccctggcctggctttatgctcgggccaggagaagtgtaggaacagtcatggaaaagacaaccgatgtgttgacaggaactgtttcattcattgaacagacatatattgacacctgccatatgccacaaatgcttttaggagccagagtaagcagggaacatgcagacagtatccttgttctcattgattcctttattccaccacatttgaccaagcgccacctagtcataaggcactcttggtgtccttaacagtttacaaatgggtgggcaaatggatcaaatgcacatttattacgcatgacataataggctggcatgtcgcgagagaagtgatttctgttaggggcaccggggaaagcttctagaaagagttgctttgatcggggcttagccaccagccccgtgcttggataccactgggtctttgctcatggggctccccctccctggaatgctctccaccgcacttcagcagcaaacccatattcatcttcaaagttcaattccaatggcttctgctcgccgtggaagctgctgctcccaaggcctgctcatggttaatccggacaccctatttagggcatctattacctggcctgttgatcatttatttgtgggtctgtggtcccctagactgctctttgaggaggtgcagcctattatagtttccagagcctgtgtacagtgtgcagcccagggtcagtacaggcaaggcttggaacagatgagggggatttataaagtataaataaacatgtatatgctaaatgtttattatttaaggcaatgttgaggtctatgaaaacagtattcacatttgtgaaggtctggcccccaaaagattcaaagaaaaatgtgaagcaaaggtaatcccccaggttcacccacaggtcactgttcctgtcttccaaagattaaaaacaaaagctttgttcaacaaagcattgagaaaatctgaaaagcagttgcattataatctgatgtccaagagtctagaacttgttgaactctccacttgatttttcttctatccctgtcttctctctcatgttggataaatatatctttaacttaatcacccaaatattgccaaatagaacatattggcttaccatgttttatggatccaatgccatcatactttatgtttaaaatcactggacatagtttgtctgatatagttaattcaacaataattatgggctaaataaatgttatgtgattcatttaacttgttgacagattaattttaattttcatgttattagcatgcggttcaattgttttctttgttttttttctttaggtgaaaatgctttttacttgtccccagatatcaggaaacagtgtgattggttccaaggggaccaacccacaaagaaccttgtgaagtttggtcacaaacaagtgtaagtgattataattattgtcttaaaaattgtagcgctgcagggaatgcacaggtcctccaaccacctcctgactttatgggatgaggaccttgaaatccagaaaatgtgacttcccaaaggtaatgtgggtcatgcttctcaaataatctgttttatcagttagcttttgccatgtaacaagctacccaaaacttagtggcttaaaacaacaaccacctatttattttcttacttaatttatttagagacagagtcttgctgtgttgcccaggctggactgcagttgtgcaatcttggctcactgtaacctctgcctcctggattcaagcaattctcatgcttcagcctcccgagtagctgggactacaggtgcatgcagccatgcctggctaatttttgtatttttttttcagtagagatggggtttcgccatgttgtccagccttgtctagaactcctgaactcaaatgatctgcctgcctcagcctcccaaagtgctgggattataagcatgagccactgggcctggccaacaaccacttatttaatttgcaattctgtgggttagcaatttttgtttgggctcaactgggtggttcttctgttttctccttggatcccttatgtttgtggtcagctgcttgtcagctatagagctgctggtctagagtggtctcagatgggctggctcatctctgctccatgtggtctctcattctcagcaggctagcttgggtttgttcaccaggtgacctggcagggttccctgagagaagacaagtgtgcaaggcctcttgtgacctaggttagaactggcacactgttacttctgccacgttctattgaccaaagcatgtccaaaggctaacctagatttaagaatggaaaactaggcttgatggaaggacttgccacattacattgaaagggcatgggcagagagaaggtagataattgagaccatagttccaaacaatttaccgtatctggtgtgaaatgattacgtaaaagaaggattggatacatcaaaaaatagactccatgtcttcttaaaattattaatgctgtgataacatgtaatgatggtaataataggaagtcatgtgcatgttctatgaagactgacgggaggggtgggagtgggcaggactgtggcacccatgccgatgctgctgcctggcccatgtgccgtgtttcatgccctgctccatctcgggtgccaaccctaggagcaaagagggcagtgggggcatgtaacagagggctagctggggtgatgtggctgcaagaactgagcccctgcagcgtgtcagcaatgtgtgctccttaagagaatgtcacagtgtgtcatgctttggagggaagtgcagattctgcagattctgaacttcgtacacagatgagatgtgaacgcaaatgatccttgaaaaatgactatctggcttacgactagctgactctcaagatggggaaagagagcccatctcttcctactgcagacccttctgtctatcaccacttaagtccttcagctctttcttttgacctcagaaggagtggctttaaatctcagcatagcaagaatgaatatcattgctaaggccactaggacccttatcgtggcactggatgcttcatttagctttgtagcctccatttttctaggctctaatgattcgtattttttctctgaaaccttccctgaaattggctcaacctttttatctttaggaaaacagaatgaatgaagtaacctagtatttgaagtcttatgatattaacttgaaaatatattaatacttcctaggacaagtagcaagatatgactataaaataatatattttcttctaagatcaagaaagctatgaagtgtgggtccttgttgttatgtctgtttgattaggctgctattctctctagatattggtaatagatcaagaaattgtaaaaaaaaatacacatacacaaaaattaagagaaataaaaaatatatatactcccagtaataagccctgggagcaaaatagtacatgctaactttataattttccagctcaacatagcatttgattgagtggatattttcttataatgtaagtagctaactactgatttcatttaatttttggtgtatgttttggttggttaattgctataatgagaacattgttggatattattcattattgtctcttattttctctctgcctttattttagaaattgaaagatgtttttgtagaacaatataagcttcatttttaatggttctatttttcaatatgctgttccatatctttttttagggaggcacagatccttaaaagaaggaatttaatatatgcactgctatacataatctataaaaactattgcatgcattttgctaaaacaaatttaatgtagctcatggggttatgtctttatttattttagatagcaggtaaaagtagaggtaatatttaatttgtcttaacagaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagatggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagcccttgctagggctgccatcttgtgacatcctcatttcctgctccagggtgtgttcctcaaagcctgcatgtaacacactcagaatacagtccttgatctgggcttgtacacctggatgatgtattttaagaggtgttggttagggattccagcctcccactccccatcctgtgccctcaatcctgtcttgcgatagggatgggaagctctcattctctctggaatgtcagtgggggcacagttcacctcacctgaaaattgagttgtcttaaactaaagggaaaagtttccgtgttgaaataaggttttagctcctatttagggagtgagagagacagaaagaaaaacgctgcagttggttcttaggcagcaaggcagatgtttctgggctggtgtatggagccggactcgcctaccttagaacatgccttgaaaaggtctgggggagccctttgcaactgcaaactttgtctctgcctcatacccacagaaaaggggccctaagctgtgtgctgtggcaatactgggtgttcagtccagcagcttgaaaagtcagagcctggaccatcagtcattccccaaggctcaaatctatgctcatgctgaccatgagaaaaatattgaaagcaatggcaaaaaccacaatgactctgcaccaacttaatatatttcagactgaattagatacaaaaggtagatggctttaatgagaccaagagtatgttattttatcattttcctaaagaagatactggaagacactaccgaatgtcacaagctgtaaaggaaggctcatgataaaatggaaattatcttcatttgatgaacagtatgagagagaaagcagaattcctttaaaagaatttcatgtcataccctaaaattttatgacttaatatattttaaattatggggctcattttgtagcaaacacaacttaggattagtatgctgcatttccaaagtatcttcttaacaggcgagatttttaatagaaaaaaaagttgatgaataatgagatttttcattactgtgaatttcacatttcatgtatgctgatagattataagagcaatgttttttaggggcttgaacaagaaattagttccccgcctcagctaaatttcaagtcaatttgtctgttaacacatccctttcagatttcctctctcgctcatgcactacagtcatggaggattttattttttatcttcacgctctgatctatctttcagttaagatgtcccgtgaagtccaggtgtttgagataacagagaacagcgccaaactccactgggagagggctgagccccccggtccttatttttatgacctcaccgtcacctcagcccatgatcagtccctggttctgaagcagaacctcacggtcacggaccgcgtcattggaggcctgctcgctgggcagacataccatgtggctgtggtctgctacctgaggtctcaggtcagagccacctaccacggaagtttcagtacaagtaagtacatgatcagtacaagtcggtacctgatttctatgtagagtatcaaataggacacaaaggagacacttacttattgaatctattctgaaataaccacaaattcaaaaaacaacaacagcaacaacaacaaaacaactcagcctgggtgctttggtggcagcctaagcttataaaacacagaatggaaatgggattccatgtgggatgcagtcctgccctctgggtcctgggctactttttggaggaagccagatccacgtcgcctgagcacagccctttccaacattgcacccgggaaagatggccacgtctcccggtgagggctcctggttgcccaccaccccgtccaggtttccatgttcaggaaaacaccagccagtcactggctccttagggagtaatggaggtgtccctgaagtctcaccgccccgggggtggaggatgtcgatagctgagtctccctgccctgatctcaccatagttgggctctgcccttggctggctgttgtccccaggggcccccccatttcactgaggcctgcacttgagtgctgtcacagcttttcttaattattcatggtcccctctctcatctttctaaattcttctgggttcccccctcccattcttcttgacccccactgctccaggaatgtgaagggaaggctcctcttttcttcaggccaatgctattcagatcaaggaaccagcttgaggaaagggaattcccaccagtgccatggattaggcccatagagatatgagtccaaagacccagtcaaccctagggctctattttcctggacagcagcagaagaggctgtctgggaagtgagaggatttgttcagaagttcagggatcccctcccgtcgcttattagctcatggatccaacttgtagcccacagcataagtcgtggatgtagaggtgtcttggatctgtgtctttcaatcaccactccccaacataagacattaatcacagcaggcaaccttatatcagtcactaaggattcccaagccctcctgtttctgatttacctacgagttgcatatatttttcttttatagagaaatctcagcccccacctccacagccagcaaggtcagcttctagttcaaccatcaatctaatggtgagcacagaaccattggctctcactgaaacaggtgagttgtgaaactattaggtccattaatggcactaagaaaatacccatcttgattccaatttaacttcctgggttctaagtcttagcccaggcatgacttctatgggggaaaaggtccacgtcagctctgtgcagcccaacatcatcttattctgcataatcccaggtgtaaatggagtcttactttacctgtgatcagactcagtgaaaatttgatgggaggtgcttttggggctatcactagaattcacgtatccattagacatttctcctgtgcctcatactgggactcgagttgatttgtggtctgtgatgctgtgaagattggcgtttcatttactcagtgatttaatctaataaaaaaactgcttagaagaacacaagacaaatttggctggaatccatgaaatgcatgggtttggatctgacccatggggtgttctggtccggacatcctaagcacacaccccagcttagtgtgtgagtctgtgatactgtctctcatgtgcttgaaccccagagtgtgtgcatagtctatgctaagttagtgactggttaggtgtaattcaggaactgacagctgttacttgcttttgttcttgggcagtgaaactctgagagacctggaatctctcattcagcagaatgtggacttggcttgttcatcggtgagaaactgattattaaaatagttgataggctttgcttaagagtgttcagcaaagaatgatggtactaacataaaaaatggaaatgccatgggaatttagatataatactgttttatacacctgaagcaaaagctttctgctaactaggggacaattcattattttttggtgtatcgtctactgtcaggaggaggaaagcatttctcttcacaatgctcatttctgtaattgattttaaaggtgtttgttgagtgagcctgttaggcgaccccaccatggtgcttgagctcaaagagaagccacaaagaacacagtagattttccccaaaggtgtgggtcaggacagattcaactctaacttcaaagttgctgaaatctgtgtatgtcatttctcactcattggttaacttctccctgaatacagtgtgggaaatagaaaaattttagccaatttagtgcttcattgagagaaaaagacttggagtaaactagagatcagagatcaataatgagtaaactagacagcaagatttggggatgtttttgattctcttatgtgtggtccaaaagggacaagattgtataaacagtgcctaattcatataaacaacaatgtctttcagcaagggtctggctgggctgttttgtttttcttttcatatatatatatatatatatatatatatatatatatatatatatatatgtagagagagagagagagatggggggagagagttgtgaggttcagaattaagaaggtgcttttgatccagacctttaacactgagatcgcctgtctacctgtgataaagagaaaagagcttttgaaattggggcttgtgtttctttcaaggctgcaagtagttgatacagatgaatctaaataaaacctttctccttcatactaattggggcataaccctcagacccaggatgtgaatgtcctctcaccatttcatgtgtgtgtgtctgtgtatgtatgtgtgtacacatgcatatgtgtgttttccttcccagggtgaagacataaattacctttttttttttttaaaaaaagaacaaggccctgcataattgatctctgatctcttaaacttaatgacttcatagtaacaaacaagcacttaacctgccttggcctgatgaatatatgttggtgtacacacagttatggcatttttgagagctctttttgaattactaggttggtgcgaaagcaattgcagttttgccactgacagtaatggcaacaactggaattactttcgcaccgacctaataaatgggacatttacttaaaaatgtctaaaattcaaaatggataaccagaattaggagaggaatccttatcctccccacccctaccaacctctctccctcccctcctcaccttctcctataattgtcattttaactatttcccctggggtggggggaaaattttttaatggtttttatatatttggatataggaaaaggagtgacaatgaaccactctttattaaataactaaaaaaagataataactgcatgcttactcagtagttgcatgtatattttgcatccaaattccaatgaccacgatatgcattatttctccaaatatacattttctagaccattcaggcaaaatgaagttttaaaaatatattttttatatttacatgtgtccattttcattcctcttactttctgcagcatccattaattagaaacatgtttacagagatgggtccctttcttagtattaaatagtagatgctactgtttgcttttttacttctgtgaataaaagatgctgtcttaagaatctgtatttttcatagtttatcatgttagattctgggaacctggtgacctgtgtttgaatctgtgaaggaatttgtaggtagaaacactctgaaatgaaaaggttcctagtcctgggcacctaaggcaggggaagaggagaggaccagtgttaccattggttttcgtttgcatatgttaatgtttgcccattttgacagtcacattgaatagatgcttgtttatcaggaatgtgagtcaggcatgtaatgcgagggcagtctggttggggcattttttgtcctccataagatctggccctgtttggtatgtggcagggagactctcgcctttgagatgaaggttgattctgttaacaggccttgattccattaatatacctagggcatcgttagcaaccactcaggattccagctttacaatattacatgatttgattttcagtggttaatatttgtatttttttaaataaaaccaaatgaacccccacaaaaacatctcactccactttttgctttgctcggcatctaaaagaattatgctccagccacttttctgtcacacatctgctgcctgtaaatggcagtgagcagcagtggatctttcattcgttaccgtggcctcctgaaagcatgggtgtgctgggcctttctgccacctgctttgtcgctgctgattttgacagtgctacgtagttgctaattttggtttcaggcttttgttaccacctccctcttctcccttctcatttttagctaaggaagctttggatagatattttctatgcatattactattaaagctaagactgtctagaatttctaaacaacaacaacaacaacaaaaatctaacttaaaatttactttttgcagtattgcaaaatgaatcctaaattattggcttaatcacctgtgttaaagaagtttcaatgcagaaactagacaaaacaactaacaaaatcaccatgtcctttattatttattcttgaaattagcaatctgtagaactgatcacattttgtccgagtagacatgactgggccaattgtatagccctgaaggaaccatcattttgtgtttactaacgttttacttattgattctaagatgcacaattttcttctcattgggacacttctgaaactgaaatgtgacttagaattgacaatatatcatggtttattggtagcattttgtgttacttagtggaacataaaataatggtgcatcataaaattaagagctcttatattggatacaatacagtatttggttggccatgttccatgtgaatatatatcatcaattagcataaaatggtatatttgggggaaatacctgactttatgttaataataatttaaagaacaaactaatcccacagctgaagtaagttaaatagctacagggatttaggaaatggtcctctccaggctgtctgttgttcatcgctgtgtgaggatgttttctggttagttgtcatgtgtgggttatgatgagcccaaaggagtgttttttatcttgaagtcttaaaaaatagaagtctgttggtcaagatctgaaagagtaaaatttaaccacagctacattttaaaataaagttaaaaattggccgggtgtgatggctcatgcctataatccctgcactttgggaggctgaggcaggaggatcacttgaggtcaggagttcgagaccagcctggccaacatggtgaaaccctgtctctactaaaaatgcaaaaattagccaagcatgatggctcatgcctgtaatccagctactgaggaggctgaggcaggagagtcacttgaacctgggaggcagaggttgcagtgagctgagatcatacctcttcattccagcctgggcaacagagtgagactcagtatctaaataagtaaataaattaagtaagttaaaaatttggtaagtttccttggtaccctttgaactgaccaatgctcaaaatgtagacggcggaaagtgttttcattcaggcaaatcatacctgcatccaaggtatggaagtactttatactgtaacaacaatgccgagtgagaaggtgattgaattttcttgttttggggaccattaaactgatgaggaacatgttgatgattgcagcataaacacctctcagtctgtcttccttcagtttgctcaaggaagtacttacatcgtgatttggaaatcaatatgtttgggaaatgtcaaagctgatgcctttaaaaatgcattgaaacactatgggaatatcaaactatgaaaaagacaagattttccaatcaatatgttttccactttgaagaatacatatattttttgctgattataaagttaacagatatgcattgtcaagcattcaggaggtacagagaaatatattacacgattctcattgtgacagcattgctggcttttgatgaaaaccaatagtgacccgatgcatagccttcctatttttttctatgaatattattgcttgtgggaaggtgcatgcatcgcacatgcacatccactcctgcacatcattattacaaaaatggactgtggggcttagggtgccttgcgccccagtgtttttgaatggttgtttttaggatgttctaggtaggcacctgtggcttctgggaacaggtgggattcccagaacagggttttaacctaacattgtgcttgcctccatttcctctcttctatttggttactttcctgaagcccagtgaccaatagtaaggaagtttcagcagacagtggtctgagtcaggcagcctttcccctctctgttttccaagcaaacttagttacattggtattctaggttaggaagccggggaaggttgtggataattttcagtccccattgtcttttaggctcccactaggttctcaataataaagaagagcaaattaaggaagactcagccatgcgctcctctcacataaagagaaggctctagcttcctacaggttatacctggggggcagactgatttcagagggaaaagatgaacaactattgcatccaaagacgtgtcgttctagggaaaagtccaggttaagttcaacgagggccagccatctcccttggtactccaggacatttaaatacttttttttttttttgctttaaaacagttgctttaacatatgcactcatagctgagtagagtccagccaaaacgacatgtctcagaagtcaagattatgtggagtttgcattagaagccttcttaagaacataaaatcctccgttttcatgcttcagaagtagagaagtacaggtttttgtctttgaatagtgccgggttctcacctcactaatatatttctcttggttttccaaatatcttcttgtccacagtaacagtgtccttattttccactagtaaatcttacagggtctcagtagtgactctcactgaaataagggcagaaaacaccagtgccgtggtgtggaactggagggctagggtggagggccaaggaagctggagaagccaatcagacggggagtggagtgtgctgctgtgaggccactcatgggctgggtgtccgtggctctgggcagacctctcgtgactggttcagcagagcccaggggactgggaattgaacagctaaacacagatggtcaggactgaagtgcacttgaaacaaataaaatagagcaaatagggtccattggccaacgctctgggaaggaaggaagaatagggagatcatttgacgccggcctcacgctaacagggaagccaccagtaaatgaggaataaattttgatggttaaattaccttgccttgtcagttctctccaggaccttccttgacagccaggcattttccttcagttattggcatatttgagagaaagaaggttgtttttgtaaattgtcttcattttattctgacttcctggagtcttcaaaggctctcgtggggaccactggctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttttggtatctatctgaagcacagatgctcaccacctccgcagctgtgagcagcctgcctcgctggggacaaaggagatggagaagcatctctttgtaggggagagctggataattccagcctgttagctactcacaggaacatgcagaattattggctccagggagttttggagaaagaaggtttacgttttcaaacttacagataacagttgacatcaatgcttctctttcccagaacaatctggagtttgccagaaaactctgtaaacaggagtcgtgctgtgtgtgaactgtaaactcttctctccaggcgtcgaggggacctttgctttactttgcagctgggctacatcagacgtgtgcattggaaacataaacttccttaactgggaaaagaatgcttctctgtcttcaaaatagttctgctatgtgacatttttgccatcatgaattttacatcagtgctagctctttgttttacgtgtttcatttggcaggtcacaaaggctcttggctaccacacatacgtgcatacacacacacacacacacacacacacactcataaaggattttcttttctgctttacctttaattttcagtctacttggcttgtaatgaaaggtagagccttatttttgaactatatcccaacagaatcgaatttccattttgccaagaattataaaaccctgaggttttaaaattcagtttcttttctggggatttaacatggaaggacttggagggcaaatggcccagtgattggaaaggggaaaaacaattcatttcatttaaaattattcaataaccattgccagcatttgggattctgagtgctgtttatgaagccctttcattgatataatttcatctatctctcacaaggctgtaagcaattcctatgtccatatggcagtgaggaaatggagatttgagcaggttaagggagttttcacctggaagctcttcttttttttccttctgccacagtagggtcatcagactgtcagccccagcactgggagccgagtaacacgcatgttctcattaatatccttttctcatgtttttattaaagatatatgcaagttgccgaaagacgaaggaacttgcagggatttcatattaaaatggtactatgatccaaacaccaaaagctgtgcaagattctggtatggaggttgtggtggaaacgaaaacaaatttggatcacagaaagaatgtgaaaaggtttgcgctcctggtaagtgattcttccttgtgtttatggcttctgcaaataagagattcaggtcaataagtcaccttgaaaaatattagaagtgcaatgattatgatacatgtgaaaaagaagataaagtgtatcctcagataaggaagacgttcaaatacaacccatgaaatgtctttttgaattcctattttgggtttctaaaaacatattgtcccttgtcattcttcagaaatgttactaagttgctgttatttgtaaaatattgcaccaaaaatgattcctgggaagataatataatgaacaactacagataacgccaaagataaacaacccccacaaatttatcttttaaatagttttgcttcctataaataacaatgttgtcactggggccatccagtatctccattatattgtgcagttcaactggtaataaaataaacactttgaacagagcctggggtcagtgccagaatggggagagttcagttcgtataaaggcctggtagatggtgcagggcaaaagaatgggatcagatttcccagacatccctgggccccggggccccaggccaagaacgtcacagagggcctttgatggtactgagtagaaaagtgggacaggtgatggaaaccagaggctgcgggactgtgtcatgataatgacagtgcccttttgggtcagtaatgtggcttttcctctcttctctcggctcctcacctcaccccacccaccccctctctcgacgctcagtgctcgccaaacccggagtcatcagtgtgatgggaacctaagcgtgggtggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggatt

SEQ ID NO: 24 - DNA, 11378 bp, Homo sapiens
cttgctacaacccagcaaggtaagtgttattaactctgaatttgttgtgagcattaagtggaagtggatgatgctagtgcataagcagtgatcagcaaatgctggagtccctgcctttccttttgttccagtggtggaggtgggcaggacctgtagcctagaaaagtctacactgcttagggatagaactggaaccagagccggctgtcccttgtcattcatgctcccttatccactagcctgatgacctgtctatagggggagctgagaagcgcgagttctcgctctctggagggacatgtgggttgctgaaggagttaagatgtctcttaccaaaccctggccctccccatccctgcatctgcctttgtggctttaatgagaaatccaggcgcttcataagagactgtacaaataacttctagggcgccactaactcattcagcagaaagggacccagggctgccaatgtttcagggaagataagtgagtggaaaaaaggtggtttttatagcgtcaggcggaccgaaggatttgcgtggttgagcgtgaactccgcccctgcagcagagctgaaaaaaaccaggatccgggttcctcagccccttttcacaatatttgattaggaatttggggcgggaccctggtctggcacaggcacgcacactctcagtagactctttcactcctctctctcttcctctctcacacgttctccaacccaaggaggccagacagagggacgtggtcactctctgaaaagttcaacttgaggtaagtatagtcgttttacttcgggtttgtccctagcagttccttaaaagaaataaaggaaaagtggtaggggataggggagatggggaggcagggagggttcattcctccttctccacatctgggccatgaccccagggatgctggagagtggcagagagggtgtataagggaggggttccagccctgtacctttctcttacagttcctttatgggtgctgaggggacctccaattctcaggcatgaaaaagtgaaggaccctctgtctagggaagcttcttccctgctactcataaatcccatcatgctgggagtgtgggcattttgaagggtattccaagacctggatgtccctgcaatctctcttatagaggggtttggtacataaatgctattatgggagagggggaaacttttgtgtagaatgtgtgtgtgtgtgtgtgtgtgtgtgtgtttggagtggaaaggagagaataaaaagaagcattgagaactggccatgtccagggagctgtggattggggtggggatgcaatccaggtgaggggatggcctctggcttgaccttctccactgataggagggagagatctttctctagagtggagaaatgaaagaacagcagtagctcctgagtaaacttcccccagctgatagtgtggcagtcctggaaactttcgaccttacagaaactctgagcacaggagggcctctagcattatgggaaacagtgtaagactatgcaaccctgaagcaacattgctaagagatgggatggggtaaggagaggcataagctccccatcaaaccctttcagcacccatggctctaagaagaggctgaagtgggcagggtgcacagcccctagaaagctgagtctgaaggggaaggtggctcttgtctgccaaggtgcccagtctgaaagaaggagaaacggagacagaggctcactgtgccagccctccagacagccaccttggtcctgcaacagcccagggctgtgcatggaaaaatgctctgttggcagtgggccgctccattcgtcttctctcctggccagagccaggaaccagccagcttgcccaggcagtgggcagttgggtcagcttctccaaaacactgtggctctttgtctgaggcctgaggctgcctgtggatgagccagggtgcctgctcctctgcaacctaggaactgatgggatgaagtgggcccaaggaaactgttttgaggggacagagaggtctgggatggatggtggtcaggaggtaactctgttgagtgtcatagttggggtctttcccatcagttcactggatctgatgatgttggcttttatactcctttctttcttctgtttacagttgccaaccccagtaggcccaacagcaatgtgagggctgtatgtgactcttccaggccaagaaagattctaaggtttctctgtccaagggtgacactcaggaagatgcccactgctcacaggagtatgtcatgcattggctataggtaaccagggtagggtacccaggccacccctagtctcttaccttccatacctttagtttccctctcagatgacatcagacccacatttcctcttcagtctgccctgttcctatctcattagcacaacaggttcaaaagcaacaggtttccagcaatgtggggacctagacacagagcctggtcatctaggtgtcatcgctgggagcaggtagcttgggaaaggagaggagaatgtcagggtcctacctcaagctgctttcccttgagcatacacaagagtttccaatctctagctattcttttggtgtccctcattcatttctcttggccccacatggctcttgcatgatgcccatggtggagcatgaggagtgctaacaccttactaggcaccatggaagagagaagcagattaactcagacttcacacactgagtacctgctttagaaggcaagtgccacacccagtgccagggtcctcagtctggaaaggatttgtaactgctgcatgaagaccctgtcccagccaagttgcatgtgtagccacaaactgctaaccagtgagtttcctcactcagcagactgttacagatgatggcactttggagggcaacctgagccttgtggtggctgcagagggaccacactcctccccaaacactcaagaccaaaaactcccagcctgcccaagagaccaaaagattttccagatgtagttcagctcttccccttcgatgcgtcaagcggcttctggaggtctcccatcctagggctttctccttggactcttagaaaaatactatttccccggaacatccaaactggatttgggttcagatctgaagagcatcccactaccatccttaccaccacaccacaaacacagggattgctgtgggcttttcagctttcccacaggactttcagagtgctagaggctcctaagaatctgcccctccaaaaaaaaaatgcagctgttcccattcaaagacattctgtctgtgactctatgaccaggggaaaatgcacttagctcaccccaaatagccatggtccggctggaccaagtgcagaaccagactgggaggaggcaccgaagaaatgagagcaaggctcctgctctcagatgtttgacatggaagtcagctctgcatagctcaaagcctaaggcttgcctactctgcctcactgcctctgtggagtctcactcatgctggcttgctctgttctctcccgcttcttgcagagacaaaatgcagtggacctccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggagtgcgactgcccacccaacttccccacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacaatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatggtgagaccttggcaaagggaggcggggactggctgtctatttcacttgaaagacactattctgagtgctagtggcaaaacaaaagaaatagaaataggggaaccagacagcacaaatgaagcaacctgacaaccaagccatacccctgtacaaaagagaatacacttatactaaatagcagtgctaagacaattcagtggggagtgggttggtacagaagaagactttccaggagaggtaagtttcattccaggtcttgagagataagtgggcatgggttgggggtatgcaggatggagacattctgggacagaggcttgccacaaaggagccagtcattttcacaggtcacctgtcgatgtaggggacagctgggaaatgtcacgtgtctgagatgaaggggtcatgtgtcagggagcagtaagagatgagttcggagaagtttaggagggaatacttcaaagggagggagatttaagtttagcttctaaagtctgtttcaggagaatggtgggttgaagccctgcacttactcactgtcccagaagaggatgagctctctttttccacttgaactactcttgcgtctacagcctggtcttgtgttttggtgtttattctcagagctgaatgcggcacttgttctggtcagttcttcctggagtacaaggaccccctggtggcagggcagatatccttcctagggtaacatgagcctgactaccaccaagcctaggacactgggcttcctgtttcataagcacttccttgcaatgcccaaaggaaaaaaaaaaaggctgcctccctgactctaagaaatattcatttcagatggaattatctagctgattttcagctccctttagtcttaggatctagtattcagaacatgcttacattaccccagggcttctgatgtcttaatcccagctggaaggtactgagccagcacttgacctcccttcctgtcagcaaagtcctcttccatctggagaagggaggactcattaacgaccactggcaaagggctttgaagtggagcctgctgagatagaaccgcaccatcaaagcgctgagaagaacagagtcgtcaccctctccctctcattcctttctcccctgtgctcagggaacagatcagtcattgagcaagatgttaacaagctgggcagccctctgagtgagagaggcaccagccccagagggcaatttgggagttgacagtcgggtgggcaaggcaaagaggcatctgtctggcacctttagtttgaagtgcctgacaccatcatgtacagcctaaactcttttttattaaaatctctctttctttggggtctttttattcccaaggtggggattgaggggtcctctaagacgtctttttttttttttttgagacagagtctcgctctgtcacccaggccggagtgcagtggcatgatctcagctcactgcaaactccgcctcctgggttcacgccattctcctgcctcagcctcttgagtagctgcgactacaggcgcctgccaccacgctcggccaactttttatatttttagtagagacggggtttcaccgtgttagccaggacggtcttgatctcctgacctcgtgatctgcctgcctcggcctcccaaagtgctgggattacaggcatgagccaccgcgcccagccaagacatcttgaagatgttgcaagctgcagacgtttgacatttccttgtggctgtctatcatcacaccagcagttaccactacttacctgccacacactctgaatccaggagcagtcacatcagaaatgtcacacgtatgctgtgcttcatccaagtttgaccctgaaactgtgacagcaaagaacagctgtcatgggaaagaatctattagcacctacccatacaatcagagaaagttgggatggaaaaggcttcatcacaaccttttatcatcgttctgccttcatgcagaaccacatctgccactcaaatgggaggtggaccacctcttccagacgcttgtcagaaaataaaattagtgcagtttcctaaggtcccgcaaacaaattctctgttcaaacaacccccaaattttcggtgtctactcccaaatcaattcttgtgcaatttaagtccaagccccgtgactaggtatcacttagtctctctcagccttctttttagacaaaataatgctttattttccttaaagtagtgaattaatatatgtaaagtgctttgtctagggcctggcatagaatttaaaaaccaatgatagctattattattagcctttcttctcattgccactttaaagttgacaggcagtttttgttgttgttttggggaaaaagagacacagagaaggtaaagccatctctcaaagtcctccagatgatgtagattagaatcctgacctaaaggacctagagccaggcatctccgactgagaatggtgaggaatatctctctgatgcagaccactagcaggaaaacagctccccaagctcagccccctctcctacagcaaacgtgagggacatctccctgcaaaccagtcagggacttggggatggggggtgttggaggtgggattgaaacaagcttctgagagaggagcttaaagaagaacaggagctcaggggcgcacaggggaatcagatgtggtcctctcctcgccacttccctcttccatcagtatctccctcagtttttccagcctggcaagaacacagctcagaatgttattcagaagctttgggattcagtggagcagggcgggtacaccagtaggaatttggaaagacttatgtcagtatttaatttgggctagaaaaatgtcctccagtgcctccacgcagaagcctgtcctattcatgggcttggggaagacgggggggtgctcacagtacccagtatgtggctagagtccatatacactgtgtgtctagctccccacaggtatgtcccacatttacctatccacagctgggatctggaattttagcaggcagtctgagggctccaggctgggaaagaatctatcacggagcctgcagctccatcctaagtagggctggaaatgatacttaagctgagccactttgcttcttctcctcaccccactgctctgcttgtacacagataacatagacccagccccggtctaggctctgcccccaacctgctcactcagaggccacttaatctagtccttgggaccagaaaggaaacatccaaaagtattccagaaattctaccccaccaggagtgttttccaaagacgagtatttcccagtttccgctacttttctcagtgtctaattttctttaggcctagattttctgtgttatgcctgcaatacaagttaatttgctgcaacctcacctcatcttatcttggtcagtgcttaacagagactgaaaaccattgaaaatgctaatttaaaaacacttttttcatcagcctctttaagctctccatgctgtctttcttggaactgtcttcttcatacctataacctctcccaaggggagccctcatggtcacacctaagaatagagttagaaaagcaccccctgcccccactcctcgtgcctggccccagactgacgcacctcctgaccactgctgcaagccgatggatgcctctggtacaacagcaagccccagctctgggtctacccaagtattacagctgctagggatgtgtccatggacaatcctaccctcaagacccaatgggtaacttcattcaaaccccctttgcagagaatgacaacaggagcaagtttcctgaaagcctcattcaccatggtaaagacagccctacgaggcttcctcagctttcaatggtgacttttgccatctctcctgaagttttagctgagttcttggcttttcctttcaagttactgacccagtagactggagacagagtggttgatttgtcaaagaggacaaccagagggacaacagggttaatagcaacagaaagatttatgctaataccatccaagcagaactattgtctctactagaattctgcggtttaggggaaaatcttaggagacttcttttcaggtttaaaaaagggagtagattgtaatcatattaaatgcaggaggcagggaaattatttatttgacttttgaggtccctagcagccccagtgctctatgagtccccagcttcctttaaactcagagccttgctcactgctctggcagtatttagaatggagacgtgcaacccactcaaagccctggcacacaaagacacttgtctctcggcccaggctttctctctttaatttcctgccactttttctatctgtaaagtattaagtccctccatttccccagtcttctttctcacagcaattcagcaaagccctccctctccaaaaacaatcaagtatttcaaggtgtctacggttggtctttggctaccctctgcttcctactgctgcccacagctgcccacctgcccccctatcctgctaaaaaaaaaaaaatgtcccagagggaaggacgcttaagaacattcctgggcctgcagagtaaagttcaggttggtggttaggaggtgagctgcagacgcaggcacagtcctcactctgtccctagttctgcccctagtggcgccagtaagtatgactccaatcctggaaaacatctgccctccatccccaacttccacccctttatctaagctgcttcacaaaggctaatctcactgtggcttcaggttcgtaatctgggcttctctccctgacccgtgctcctcttgtccccacagagttctccatcagcagcttctgcaccgtggtggacgtcgtgaacttctccaagctgcaggtgctgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttttgctggaaggtccaggatggaccatgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcatctacaagagtggagtcatttaaagcagactgcaggagggttactttaggaggacctggtgaggtcgcaggtcacacaggccttggactgatgagccctctttctcatctattctgttcgggcagatgaagctaagaggaaaaaaaaatgaaaaaaaaaagtcacttgtataaaagctgtagttagcaaactgtgttct

SEQ ID NO: 25 - DNA, 14552 bp, Homo sapiens
caacggccaggaagggctcaaaccatcctcagggctaacccaaggccgtcctctgggcctgtatacccctgtgctgagtgcggatcgggagaggctgctgaagacaggaggggacaaatgggggacgaaggggcccgagggaggggactgaaggatttgggccaagtcgggagttcccgagggcggagtcaaaacgcatctggattttgctagccccaaactctgccctcattgctgcaagcctcctagaccgaggacccccgggctgagggtggggtaaggataggtagtgtccctccccgtcccacccccgcctgtcccttcctcggtggccccttcccggcgccccgattccaggcggcccctccgctgctgccagccgatccccctctacccccacccactactccggccgccagacgttgcctacagtctcggctctgtctcccacggctgtgggtccggaccccacgggacccctatgggacccccacaggacccccacggcctgagtccaaggcccgccccctcggggaggcggatgtgggaggcccggcccgggtgcgggccagcgacccgggagctgcgggcggctgggaggggaggccgccctgaggggctgggagcggcgcgggggtgggtcccggtcctgcagccccagcgaggggcgagcggcggccagtcggcgagctgggcaataaggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagaggtgagtcgaggtccgcggacgggaccgggtggcgggcggcctgacccccgcttcagtgggcccttccttcgggcggaccccagagtcaccgcagagtggtcgcgggaggctcagtcccagctcattagaaaggcaagctgctcctggctgaccacgcacagctcccatgaccctacctgagacttggaggggaatggacgagactggactggaaatcagaaacttggttctagtcgggtgacctggggtcagtgacttcacttctctgttctcctaccctcttcataaaatgggcagtgggattcctgtcttgctctactcacatagaagggatcacacgtcctccaggccgctgggtggacctggagtgaatgcctacttccacagctgttgagcctcccagcagagctcacctttcccagatcagtccttccagctgttgcttgaggaatctgacactatcactccaacctaggagtctcaccctaggcgcgcatggtcagtcacctccttgccacgaccttccttcaggatccaggccaaaggggatcccagtctccccccaggctgggaccccagatttttccatggaggccagtgctgtgaaacccatggctgggctggctgccccagctcctctttccttctccaaggacaggggcataatggacagttgctctcactctctctatgtatggccagcttctggctgagtcagggtctgtcctaatacctgtcctctcacctgtccccccatttcattggtttgttagaaatagctaccattgattgagtactaactatgtagacacttagatatatatattttttctcatgtaatcctggccgcaacctagtggaagaggggttactatccccttcctacagaaaaggaaacagacatgaatatgggacttgtccaaaactccttggatggtggggtgaatggcatggttggggtcttgataacatttcagtgcttactgtgtactacttatactctgctaaataattgtactacattttacctatgagataacactattattattcccactttacatatgatgggaagcctaagcctcagaaagtttaagtaacgtctcaaatttcatacctctaagtggcaaaggcaggatttgaacccaggtctccatgctccagagcccacaccctaacctctgtgctacactgtgctgcctccatggtctgcctgagacctgaaaatccaggcatcacctggatgttccactgcatcaccccgctgtgaagggctaataaatcacatggatgaatcgtaagggcaacccaatatgaacagctgggtctgctcctctgctgttggggtaaggcctactgaagtgcagagtgagtccagaaggttgtgcttgatatggcgcttctccagccctgtgaagatcactgctgtgctgagccactgccgttgatgggagtaggttttatcaatccttcaggtgtgctagggagaaaaacattgataagcacctttcgggcataccactactctggctctccccacctgaggctcagactttgactaagcctatggcaaacagatgatttctgggcagcaacaccacctttgttgcctgggtcaacatagtgagaccctatctctactaaaaataaaactgggcatggtgctgcacccctgtagtcccttgggacttgggaggctgaggtgggaggatcacttgagcccaggagttcaaggctacagtgagctatgattgcaccactgcactccagcctgggcgactgagcaagaccctgtctcaaaaaaaattaaaaacaaacaaaaacgctgtcttcatttaaacaaatctgagtagggcacccgttaataacaacagtagtgggcaatttgtacacgtccaccgagacccatgtctttttcttcctttgagggactcatctaaccccaaacaactggaggaataacaatgaccaaggaatgatttattatcagcaatttaagtttattaagacacgctcagtgactatggacaagaaactgaacatctctgagcctcactttcccccgttggactgttgtgatgattaaatcagataaaccattcaagttcagtacttagcacataattagtactcagagaaggttaactgttattattaagtatttcatagtgtttagctaacgtttgaaattagtttaacgtctgtaatttctggccaacaatagtgatgcttctgtcagcaggagatctttcacaaagttttgcttagaagtgaaaggatcctgccaggccccaggagtctgtctgtgctacagtcagatttcagggtaaatcgtacagagtcagctctgagtttggactggtcgggactcagcatcctcctgtacttgatctcacactgggtccagttaaaaattggacagtcccaattttactccatcacattcccaggattagaccatagatgggttctgcagatgcagacagcctcgctccacagtgtcaccacgtcccagctttggtgtttacccttggctgtcccttctgtagtagatggggagtatcctgggtgggagtgagtgtcccctccctctgcatcccactcccactcacccagcagggccctgtacagcaaaatgaaagcagaggaaccagacttagcgttgtgcccacacaaactgatcagaactccctggggaacttttaaaaaatgcatgtttcttgctgattccaggactgaatcagagtctggagtgagggtgaaaccagtgaatatgcttttctcagtgagcacttcaggtgattctgatgcgtgataaagtagaaggagggtggactggggcacggccagagaagtagaggtacggacagaggatcctagaggaatgccggattttagccttattgttagccactttttcctttccacctcaaaccctctcctttgcagctttctgggctagcaaaggctgccaaggatggcttcctgctagtaccccagtgggcagattcagctcctctagggtgctctctccatcccatcccaccgtcagtcctgccgcacagtgctagccagagtcctcactggctgcgggaggggcaagaggcaggaggtcaggcagaggctggggacacagctgcagcagcccagggctctgtttcctcccccagcctgggcctctggggcagaggaagcccaggcaggaaggccaggcctgccaccagccagagaggcctatgaagcccccctaccccacccctagccatactgccctcagagcctcagcatcttgggtcttcatttggcaccattcttagactatgggctttctgaagcctctgtggccatgtgcccagccctgtcaggctcaccatgtcatgccaaaggacagtctccctgccttgtgccctgcctgaggatccagtccccagacacacacctgcacatgctccaccattcagaaagtcctgttgctgtctgaccagggtccttcttgctgcagctttagccaatatcttctggttctaaacctgtgagaaatgaagactgggtggcttcagaagcactagttggtgtgggacctggattggggactatcatagaccagaattactccccctaacactctccaacaaacttctggaaaagttcaaccctagtcagccatggaaggtcaaacattcagtgtctaagtgtgtttcacttcccctgccacatcactggccctccacccaccctttcctagatggcaaggggaaagaagggggccagggaacagctccgagagggcagcttatactctggtgagcttgcagagaggtttctctacacctggcatgaccctgccccgtccgagctttgcatggttgttatagccctgagggctcagacatgggctgccaccactggatagggacagagcgaagagagcacttgattaggagtctggaaacctgggatgtacgcctgctggtgccagtgagtcctgtctgacccgggacaagtcttcttccctgtatgagccttactcctctcttctgtaaaacaaggagctggattttgtgattcacaggatgtccacctagaattctgtcatgtgggtgtcccaggcacaaggaactaagggtagcaaggaactaagggcatatttaaaaagcccctccagaccttgtggctgctgcagcccaccctgaaaatatgccctcagttccctgctgtgcgtgactcctgcctgttctatccagaccccaatctaaacaatcttgattcctgttcctggcttggcaggaccctgaatggcaggaagcgaagacaggagcctgtttatgtttgaggcagccagggctgggggggcattgagaaagggtaggcaggggtggaagctgtgagggagtgggaaagagacacagaacagaaggggagctgctggagagatgctccttctaccccaattgggtgctccctgcggctctcccaacctgcctgcagtctgagctcagcagcaggagtgcagagctagggtttccccaagctctcagtcacttaaacattgctctccacccttcacctctaacaggatggtttccatggggaagtgaaccaggacttcccctgcaggccccgccccaaagccaggcggcagggagtagggaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggtgagtactgggggagcagttaggaaacaggaacctggatacagaaagggctatctgggcccagatcagctctgcctggggctgaacttgagaagctggggagaatgtaggagcttgactggagagtggaggacagtgaggctccattagactcagtccccagctaccccagccctcctttgctctcctcttgatccagacctgcaggctggagctctgtcagactagggtggaagcctatatgtggggtggagggagagcaggtgttggcaggccaagcctgggagagcactcagggctggggctgggggcccagcccagcctagaactgggaggggaggacctaggagccaggaggggacaaaagcctgcttttcagagtgtcagctgctctgaggggagggttctgagggaaggatgactgaggatgaaagtaagagaccaaagcttcaaggtgtttgtctgaggggtcagacgagagggacagtaggacagaaatgggtgtcgggctcagcctgggggagctgggaccacagtggctgagcttccggtgtgtcttccaggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggagggtacgtccagctgccctagcactccctccccatcttcttggcccctgccctcccttccctcctttcctctcatgctctggccaataaaggggctgggggcgggggagcgggtgggcaggactctgggatctaactggcagagtggtctggcccgaggtggggggagctgacctagtggaagctgagcctcagtgtccccctccctcagccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggtatgggcctggggacctgggacacagggtgtaggaggggcagataggaactgcagaatcagaggggtcacccagagattagagccggtggggagctgggcgagtgaggagcttgcagtgacccagcaggtcccaggtcgaggatagagaagggggctgtggctggttgtggcagcctctcagtggcctctccgtacccccaggacctcctggacagtgactgcaccacagggagtggctcagggctccccttcctggtgcagaggacagtggcacggcaggttgccttggtggagtgtgtgggtgagcagtgggtgagcccggtggatgaggaccaagggctctcatgagcctggaggggtgagggagtttttggctactggaatcacaggcggtgccaggcctgggtcagaattggaattctgctgggcagggagtgggctggagacgggccagggctaggttcttctttctgcaggaccggggtggaacgagaggcagctgggggtggcctgccactgggtttgggtctggattaagttaaacctaagggtctggggttctgtgggtggggtgggcgagggaggcagcgcagcatcaagatggggggctcttccagggctctgtgtgcccagtgtgtaaccctcaccttcccctctggccatcaggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcaaggggagaggccagctgtgccaggcctggggctttgcccccctgcactcagggctcaagtttgcagacctccagacattaacagaaccctgaaggactctcagcccacctgcagcatcaacctctttttttaatttaatttaatttaatttaatttaatttaatttaatttaatttttgagacagggcctcgctctgtcacccaggctgggatgcagtggtgcaatctcactggagcctcaatctcttgagctcaagtgatcctcccacttcagcctcttgagtagctgggaccacaggcatgtgccaccatgcccagctaacttttttattttttgtagagacgaggtctccctatgtttcccagactggtctcaaattcctaggctcaagcagtgctcttgccttggcctcccaaagtgttgggattacaggtgcaagccactaagccaggcccagacccaacctctgactccagctctgtctctgacctaagccacatcaacccccacccccagacctagcttagcagtgacccagtccattccctctcccccaaccccaccctgaccctgacgactccagcctcccttagccccagccccttggctgagtcacccaacctttctgcacacaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggtgagccgggcggggcaggggcgcgcccttcacaggtgggcggagcttgtgcgctctcctctcctttgcctgtgggcggtgaccatgattagcacttgaaaatttagaggtgcatgttgtttcagttctcctccgcaagaccccacgagttgtctgaacacccttttcaaacccagattccttccaccataccatcctggctccaggagttgggagaaaggaggcaggagccaggaacctgggttctcatcctggtttcgccagcctccaggtctgctctgtgaagtgggctcataatgcctgccttgcccactcacatctcgctgggttcttgggaacctagagagcactacacaagcaaagagtacctggggccatggttctctctgtggccactgccttccagcccatctccgtgcacgtctccatctgccttcccctctctgtcccactgtttctctcagtccccaccttgcctgccccctggatcccaggtttgggagaggggcaggagtgacaggcctcacccccacaggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggtgagggcccaccctacacagggtagggaaaggggaatcagcctgtggagccaggggcttccagccatggccagtgcccatggcctgggaggtttgcagtcagacctcctggcaccccttccatgctgcccaccagctggttcagctgagtgaccttttaaggtataaaccttaaaaacagataacagggtctgtgagtctggctgtgaaatcttgggtacatgataataacagaaatattaatagcagctaatattgattgagcttaaatatgtgccagatgccatgctatgcactttacatgtattatttaattctttggtatggacaaggcagtggtattgcttagtggctaagagcataggcttggaatcagacttcctgggttctattcctgatcttgccatgaccgtgcgtaggttatttgacctctctgtgcctcagcttcctcatttgtaaaatgggtgcgatggctcatgcctgtaatcccagcactttgggaggccgaggcaggcagatcacctgaggtcaggaattcaagaccagcctggccaacatggcgaaaccctgtctgtactaaaaatacaaaaattagctggctgtggtggcacacacctgtaatcccagctactcgggaggctgaggcaggagaatcacttgaatctaggaggcagaggttgcggtgagccaagatcatgccactgcactccagtctgggcgacagagtgagaccctgtctcaaaaaaagaaaatttattaaaataaataaataaaatgagaataaaaatagcttccagttgttgagataatctaagtatttagaacagtatctagagctaaatattagtggctgttattgttgtagatagaatgagtgcctgacatcatattgtccccattttacagttgaggagacgggggcacagaatgacagtgggcttgaggcagcatcagggtccgaaaccgggcagtctgccccggggccagtgctcatcatcactgtgtgcacttaaacctctctggcccttgatttcctcatgcacgcaatgcatgtgagtgcctgcactgcctgcttattgctgcctggttgttactgtgggttgccacaggggactctgatttagagggactgcgacaggtagagagacctgccctgggcaggcagccctgaggtcgatgttctctcagccctggagtggacggaggataggtgggtcgtctagactggtgggagcattgtcaacctttgaggaggctgtccatggtgagggacttccaggagtcgtgacaggttggggacaatcctcaggatatggctggagccctgcttcttggggacaaggatgtcctcatttcctgagcatctaccaggagccagccccatgccagacttcatttgtcctcggtggtcatcaactgaaaacagaggctgtggtgtcaccggtcccttggggagactcacgaggtgcttagattcctcaagactccgggcatgaattgccagagtgggctctaaggagaccgggatcgggggaaagaggaacctggaagaagccaaggctccttggaccaggctgcagggcagaaaggaaaggctgggaggaggctgcctggggtggagggggaagctccatcagccccacacggactcgcggcgcattataaacactgtaatctggtgtcagccccggcactgattaaaggcccattagacacattcaggcctctgtgcagcactgattagggcgtgagcggcacaggggccggcctggaagctggccatggggagaacagctggcgaaggctctatcgaggttgcggcctgtgtggccatggcccccagcctcaggctgggaaacaggatggggcacggggctgtctgcggctccaccggcattgttttcagaaagctcctactaaaaactgtgaacttgggataccaagaggagggggtcagtgctggctgcaggagtcagcagaggcctgtgccatccctgacactgggtgatgttatgtggacctgggtaaaaagataagtgcagctcagaggtcaagagcacatgctttggtgttagactgtgggcttaaatcctagccctgtcacttactatctgttgatcttagacaagtttcttaaactctctggccttcatttcttggcttataaagtggagctcatagtattacctacctcatagggctgctgtgaggatttcatgcagagctcttaggacagcacctggcatacagtgctcagtaaacatttggtgttattattatcaggcatgtgtgatagttggggcctgggagcagtcccgggcactgggtggaaggcagctgagggaagactggaacaaggctggcctaggaatccgagatgggtttgagtcttgcctctgccattactagctgtggaaccttgggccccccttctctgagcatcagtttcttcatctgtaaaatggaggtaatactagtacccaccccacagggctgttgtgaggacaaacaggataaagcatgtaaagtgtttacagcagaatatctggcacatgccatgtgcaaaacaaatggcagtcattaacattagttagaaacacatttattgcattatactgtccctctcaggggtagcgtgtccaggccactggtttctggcccttggatagagggtagaaaaggctctcctctgggtggtattgggcctccttagagtcccaagtgattgtcctgtccattctccatttccaggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcatggctgggatttctgggcccaggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtgtgtgtgtgtgtgtgtgtgtgtgtgtgtgtgtgtgtgtttgagagtcagggttttgtttgctcttgtcacccaggctggggtgcagtggcacagtcatagctcactgtaacctcaaactcctcggctcaactgatcctactgcctcagcctccccagtagctaggtgtagtgcacaccaccacacctggctaatttttaaaattttttgtagagacaaggtcttttatgttgctcaggcttatctcaaactcttgggctcaagtgatcctcctgcctcagcctcccaaagtgttgggattataggtgtgagcctccacacctgaccactgtggtatttttgttgctatttgtctttgtttgttgctgttttgttgttgtttgtccttgttttttctcaaaacacttcacttgtacaaagacacacacacgtatatcaacacatacaagcgtgaatatccttctgaacatacactcacagaaatatacacatgcgcatatatgccagactgttggccccgtgaggacaaagaacgtgtcttttgctcacccttatgtccctattacctatcatagtatctggctcacaataggtgctaataaatatttactgaaagaatgaatatattctatacatgtatacatctatgtgtacatagacatacatttctgtacaacatatccgcaaaaagccacatgtatgcattcctgtacacacacacatacactcactttcaggagccagaagtggggccagctcatttcaggccctgggatgggttgatgagcttcctgggatgggttgatgagctttttgggatgggttgctccctggacacttgcatttttagggcagttcccacttccacagtcccctgggcccagccatggctgatggaggggctggaagacactgccctctgcactggggtcttaggctgtggatggggatgtgggagcccccaggcttgaagaatcggccccttcctatggatcttggcaaaggtggggatgggggtaaggtgtttcacagacactgcttgcccaagggggcttgagtgctcctgaagatctgagttctctctttctgtccgccctgtctttctccatccctttctcactctactctcttcctcttccattttttatttttttgtcatcctctgttctctctctcaccacttgtctttcctctcgctctcctttccaatgctctcatctccctcctctcatcctttctctcctgcttatgtctccccattaccggccatcctcctcatcttcttcccatcttctctgacccacctccctctgcatctctctcccgaccccctcctcttctctgcatctctctctctgcctcctctcctctgcacctctctcccaacccccaggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctgatcccctgctgtctggcctgctcaaagcggcaggctccctgacgcctggctctctccccacccctatggccagcatggtgcaccccctaccactcccgggacaggatgcaaaagaggctccagagtcagagtgccaagccagggaatcccagtcccagactcagagcccgggcctgcactttgccccctgcccttgatca

SEQ ID NO: 26 - DNA, 41974 bp, Homo sapiens
tataaagtcgtataataaaggggaggggagaggaaagagagaaatattgaaatatttttgttttatgtgttttttatggtggagataattgatttttttagtgttgttgtagaaagcgttgttggtatttattggtttattgagtttattatagttgtgtttgtgtattttttttaagttttattttttattgaattggaaaagatttgaatttttggttgataatttgttatatttttgttttgttttatttttttaggtattttttttgttaaaggagatttagattaattagtgttttagttggtgtaggtatttagatttgtgttaaagttttaaatgtaatttaaaaagtaaaatgatatgtttatgtgttttggttaatattagtgaagttagggaagtatgggaagaaatgtgtggttagataataatgaggatagtagtttttggatggtataataggatttagaagtgtatgtattttatttagtttagattttgtattaagaaatgttttgatttcgtattaggaaatgttttgataggaggtagaaaaataggatttgggatatagaatgtaaaggattttagtgtaaaatttttatattcgaggtagtgaagaatcgtaaattagaatatttggagaatgaattttttaggttttttttgaagattttaaaatataataatttttttatatgtaaaatattagttaatgttttttaagtgagtgtattaattatgaattttttttatgagtataaggtttttatttgaatagttaagtaaattaagaattttagaataatagtaattttatttataatgtttaaaataaagtataataagtattattttaaaaataatatttttaattttttatagtggaaaataaatttaatgaagaaatttaataaattttagtttttatagattatttaaaataatgagagaaatttaatatagatatatgaattttacgtagatataaagatattatgagaaaaattatgtttttgaattggtttgaatataggaaatattttttgtgtataggataaagatgtttgaaagatagaaagatgtatataatagtttttttttagtatttttattgtgatttagtagaaaagtttatatttatgattatttttaatagttattttttttttacgtttttaagtagtgattttttaatttaaaataaagatatataagaggttggtttcgttttagttttttttttttgttattaaatgatgttatttatattgagatgttttggtttgtgtttttgtgattgaagatataagaaagtttgggaggtcgaggcgggcggattacgaggttaggatattaagattattttgattaatacggtgaaatttcgtttttattaaaaatataaaaaattaattaggcgtagtggcgggcgtttgtagttttagttattcgggaggttgaggtaggagaatggcgtgaattcgggaggcggagtttgtcgtgagtcgagattgcgttattgtagtttagtttgggcgagagagggcgatttcgtcgtaaaaaaaaaaaaaaaaaagatgtaagaaataagaaagtaagtttgttattgtttatgtttataggatttatgtatatttgggaatatatatatgatatgagttgagtgaaaatttagtaatataaattagaagaaagagaaagatgaaaattagtttaaaggaggtaatttatttaaggaggaaagttttgtattgaggtataaggaagtgatttttattaattggtgtgaaatggggagaattttatgtgtataggtatagagacggatatgtttaggtgaaggtgaagaaaattagtttaagtgattttgattagaattgaaatgtttatcgtagattatagagatagatgaattaattatgaattgatgattagggtgtaaagagatatttttattgttagatatagttttatattgtggataagtatattttttttgtagagatttattaaagatttataaatggtatttgttttttttttaaatatgatataaaaattattgtttagatagatttagaaatatattggaaagttttgtggatgaggatttggaaagtatatatataaaagtttaaattagaaatatttatattaatttttagagtaatgtagaaaaaatgattattttttttggtatttttttgttattttatgtgataaatttttttttttttagttttttaaaaagttatgttatgaaaaggttgaatttttttttagaaaaatttgttttgttttttttaggtagtataaaaattggaaattttataagaaagtattttggtttgttaaagaaatttgtgagaaatggaaatagttatagataagtatttaatttttaggaagttatttaaatattgttgaaatattttgttttttgatatttgtttgaaatttaatttttaggatttagggtgggtggatgagtcgaaggggtatacggtggtattttttttcgtgagttttttatagttttttatttaaattgagttaggattatttttggtaaaattttaatataaaaattttttaggaagattagttttgtaaattagatatattagataaatgggtattaagtagttttttaaaattatgtagttgttaattttataaggggaaataaaaatgtatgtatttatattgtatgtattaaaataaggtagagtatttttatacgtttttaagttatataaatatatatgtaagagtgaaatatgtaaaaaaatttttatataagtagatgtatataaattttagatgtgtttttttttttattgtgggttgtgttttttataagggaaaaagaaatatttattattttttttattgttgaggggatgggtgcggtttttatattttagaaaggggttggaaagtgagggaagttaaatttttttttatttaaggttaaagtaaaggaattttagtggttgagttttatgacgggttcggtgttgaagggtagggaataatttgatggtgttattttgaattgtttttttttttttttttttgtataaagagttttatgtttgatatttagatatgatgagttttgtgtaaaaggggagttggttatttttcgttttgttttattttattattattttggtataataggaaggtgagtaggtattgattttaagaaattttatgggatttttgttttttttttttttataaagaggggtgtaaaggggaaaattagttgtttgatttaagataattttttttataagttttagattgtgaaacgttgaattgattatggttgtgttttttatattatttgaaaaataatcgcgttatgtgtgtttttaagagttttgtggttaagataagatgtttttgtattaatttgtttttatgttaaaggtattggaaatttttaaaaatggttttaaaattttttttttttggattgttaatattttggaatatttttttaggtagtttggaagttattggttttttgtaataattttatgtttttttttgtttgttggattttttgtaaggttagaatattgagtattgttttttgaataagaatgttttttaaatattatggattaagaatagtttaaaggaagattttacgtattattagaattattgaatatatttttgtaaaatggttataagatatttataaatattttttaaagggattaaattgttaaaatattttattatttttgtttttattttgttttaagaatgattgattaatttattttttttagtagtttgatattaagggattaatattttttatatattttacgttttaattatattcgtattaatgaagaaaatattttttaaaatgttttaataggaggtttgattttgttgtaaataaggtaaagatattagtattgtttgattttagaaagttgttttgttatattttttaataattgtatgtaatgttttttatattttaattttttttaaaaatatatttgttttattatttatgtgaaaatatttttttatttattatagttatgaaaatgttgaataaattggaatataaatttttatagaaataaatatttaagtgttaaatgtaaagatagttaggagaaattattagataatttttattgtatataattaaatatggttatatttaaatatatagattttgtaaaggatattgtatgaaaatttggtttttgtttgtaatattaaatgtatttgttgtttttatagttaatatatgtaaatgtgtgtatgaggggaggggtagatatataatgaaatgtttttagttatatttagtttatggatataaaagaaaagaaatatttattttttttgtttttttaatttttttttttttttattttttttttttttcgttttgtttttttttttatttttttttattttttttggtttttttagatttttttttatttattattttatttttttttaggtaagtttatatttatttttttttttttttttgttttttttgtttgttattttttttttattttttatgtggtttttttatgtttttattttttttttttagttttttttttttttgtttttttatttttttttttttttgaatttttaattttttttttttttttattttttttttttttttttttttattttgttttttttaggagatgttataatttatagtttttttttaggatattaaatgattattattttttattaattatttattgaaaagattataaatttaggggttttagtttaaaaaattgtaatatatttgtagttgtttcgtggttgtaagttttttataagtattgtggttatttttttttttaatttaattttagtgggggggtgtttgttatttatagtattttgatattatattaagttttgtttatttttttttttttttttagatgtaaaaaataattaataagtataaaattttgttgatatgtgtttgtgtgtttttaagtttaaaaagagttgaaagagaattgtttagtttattttttttgttatgagtaaaagtaaagttgaagtgatttaagatagtatattttatgttttttgtgggttttataaggaaattttgttattagataagttttggaaaagttataggaggtatttgaatatatagtatattgagagttgttataaagttttggggtggggttttttatatatgtttttataattttagagacggtatagttttaatgaatatttatttttagtttatttataggtattttttggatataaataagtttttaaaaagaattttggtcgttttataaatttgtgaatattgtatttaatttatgtgttttaatttattaatggagaaatatagtttgttttatattttttgtagattataaatatgttaagttttaagtataaagatgcgttatttagtggttgataagttaggttattatttatataacgaatgttaatattaatgttatgtagttggttttggtagtttataatgagttttaaaaaatttatatgcgtgaattttaaatgttaatattgtttttttaaggaaattagtatgttacggataaatattgtaaatatatatattgatacgaaaatataatggtaataatatttagagtttttttggaaattagtttaaatgttacggttatttaaaaattttatatatgattattgtttaaatatattttttatgtttttgatgtagtttttatttgatataagtattttatttattgtttaattgttagatagattatagatagttgttattaagtaatattgttttattagggtagaaatagaaattttattttaattaaatgtgtattaatgtttgagtttttatattttgttatagtgataattttagtaaaataaattgtaggtttttagttgttttagaattttaaaattgtaaatggatttagagaattagttttttattagacgttatgagagtatattttttttattatgttttaagagggaatttgtaatttgtttaggtaatatttaagttttttggtttgtgtttgtttttataattaaatatattgaattaataggaaaaggttatatatatttaggaataattgtatttttaaagggagagaatgtatagttgtttatatattttagtgttagttatttaatatggattagtgttttatttgagattataaaattagaaaatgacggagttaaggttaggattaatattttgtttagttttagataattatagaatatatattaaaattagatatttgaatttttttaattttgtaattatttgttattgaaaggagatattaaaaaaattatatatcgttttagaaagtatatgaattaataatgtatttttaaaggtgaaaaaagaataggtatttttttgtttaatatttaattttatagagagtagtacgttaatttttttaaattttagaagtttaggattttattattttaaaagaaattattattagttttgtgtgagtaaataaagtattataatattttgtgttttttatttatgatattttgtatttatttatttgagttttttttttagggaaagaaaaatgtttaggtaataatagagttttgaaaaatttggatttttaaaattatttatttatgtataggtttttagattatttgatgttgaatattttttaagtgatttaaaggtttatatataaaaaggtatttttattaaattttggaattaaatattttagtattataagaaaagaaagtaaatttattggaataattttgggaaagaaggaaagattgtgattaaatgttttttaattattttagatttttggattgatgttttatttataggtttttttttaaaaattaagaatgattggttgtgagtttattaggattatagttgaggttaaaggatagttttttaggaaagtttttgttttatatttacggttatatgttggattttgagttgttatttagagaaaagagtgttatttatcgaaattttatagtttttattgtgaatggtttttttggtgtagagttttaaaaattatgtagtttagttttttaattttgtaatatttaatgatattatcgttttgaagtgattaaagtagattgtttaaagaattaaagttttaaagatgaaagatgttattgtttttgttggatatgaggaatagttgtaaagtttttaggtttataataattttttggaatttttttagtgaattgttttttgtaaaagttttttttaagataaaagtttaattttattgtttttatatttaaaaaaaaaaaaaaaaaaaagattatatagtgtaaaaaaaaattttttagattttttaaaggggaaattttgtttgttttatgttaagatgataacggaaaaaatgagatagttatttttatataaattatttgtgaattgtagttgggggagttatattaattattagagttttagtttgtgtttaatgaaaatatagtagaagtggattttttttagattaattaataaaatttttgtttttttttatgattgaggttaagtattgttgtttaaaatgtagttttaatgaataaaatgaaacgttgaaagaggacgagttaaaatgtttaaaagatgtaaatattaaagagaaaagatttagaaattattaaaagttaaattttttttgaattttagtattaagaaagtattgttttagtaaaatggtatatatttttttgaaattgtttttttatagtattttgtgtggaggatgatagagattgtattttttaagtaaattaaaattatagaaatattttttggagttgtatagtatgtttataacgttttagttttatttagtgaaaatttttgatgaatttagatgtatattaatatgaattatttagtaattatattttttgaaaaatagtgtgttaatgagatattttaaatatatttttgtattggatgtagaagttttttttgtttggtattattgttgttagaattttatttttttgtatatagtaaaatgtatgtagggtttttgagttatatatttattttgttggtggtttggatgttattagggtagttttagagatataatttttttttataaggttaagagaaaataaataggagaatttaattttagatggtatttttttgttttgaggttagatagaaaaatattttgtaaagaattgttgttttttaaaatatatttatttagatttagattttaattttgtagggataaaaaattatatgggatagagttttggagttggtttttttaatcgtatttagttttgaaatagtagaaagaaaatagaatgtagtaattaagagtattaaatttagagaaagtttttttatatttagatttttttttttattttgattgtgtaattttgggaaaattatttaatgtttttgtagttaagattttttatttgtaaaattaggattatgatagttgtaagtttataaggtttttgggagtatgaagtaaaatagatatttaaattatttagagtagtttttataagataggaggtattatagtattagttttattaacgttggtaaataaaattattttaaggaagaaattaaagtatttagtaatttagtgataaggatggtgaaatgtaaaattttatttataagattatataatttaaagttgtttgttaaatgtaataagataagtagaatatattttttttaatgtttttataatttgatattaagaagattttattatatatgtaattgttggtggttagatatatgatatttaaaattttttaattatttaattatttttatttttaataggataaaatattaattaatttaaaggatatttttaaggagattgaattttaaaagattaattttttagataattttaaaagattaattttttagataattttaaaagattaattttttagataattttaaaagattaattttttagataattttaaaagattaattgaattttaaaagattaattaatttaaaggatatttttaaggagattgaaaaagtatatatttataaaatatgaaataagaaaatatttataaatgataatttattaatttttttttttggaggtagtaagaataaataaaattttattttttatgtaaaatagtgtttttaaattaaaattatttatttagaatgtttatagatattttttttagagttttttttgttaagtaatttaatatattttaagatattttgataaatatataagtagtagaaaaaatattttattaaaatttatgttttttaaataatattatttaaaaggtaaattaaatattattttaattggaaattatatgaatgttaaatatttatatgtataaaatatttagttttttaaagtaatgaaaataattatgataatttatatattatatttgtgatttttagatttttagattatataatatttttttttagataaggatttagtaagaagagaaaaggaaaaaatatttattttttatttaagttaaattaattaatttaattaggtgttttagggaataatattattgttttaaaaatagtattaagataaatataatatttattttttgtttaaataatatgatttttttaagttagtatgatttaatatgaagaatggaaataaaaaaattataaaatagtaagttttatgtatatttaaaaatataaaattatgttatttggttttatttttttttaaaattttaaaatagaaaattaggaaagaagtagttaagagtggtttaagatatgtgttagttttaatatgttttatattatagattttagtaaggagatgattgagtttaatatattgtttgtgtgattataagtaaattttttttagaattgtatttcgtagtaaggaatagaaatattaaatgatatgggagatggaatttaaaattaattataaattggaatagagagatttagtttaaataattaaaataatggaaataattggaaagtttattattttttaatagtagaatgaaattatttgttttttatttaatatttttggaaaaaattaatttatttttttaatcgaagttattttgaatgtagatatttaagaaatgaagagaataatatgagatgatttatttttaaattttattttttattttatttttaaatgttgtaaatggttaattagagtatttttatttttttagaaataaaatatttttttttttgattttgttatgattttcgtatatattattaggtattaaatgaaggtttatgaaatattaatttaagagttttaatttttagtagaatatattgttaattatattttgttatgtatggaataataaaggaagttatataaaattattttttttagtaaaggtaattaaggtagaaaaatagagaaagggttaatttttagttataagtttttataggaattgattttttaggagagttaaatttattttaagtggatgtgaaataagttatggtaataaataaagttgtattaatttttattttttaaatattttaatttttttttttttatttaaaataatatgattttttaaagtaaaataaaatatatatgtattatgttgattgttatgtgtaggtgagaagagaaaaatattttaagaatatgataatttttaaaattgtattaaaataatttttatattgaggttttcgtgttttaaaaagtattataatatgtttttaataaaatttagaaataataagttaaataataacgttaatatttataatattgtatttgatttaattttaataaatttatttataattttaataagttaatattgtgtttatttatttaataattagtagaataaatggaaagtattgtatttttaatgatgtgaggatatttttaatgagatataaatataggaggatgaatatataggagggaaaagtatttatgttaatttttaggtagattaagaatatatagaagatatttaaaataggaaatgtttgagtttagttttaattattatttttatttgtttttaatatgtttttagtatttaatggttgttttttataatttacgtgttgtattaagtgtgaaaagatatgtttgatttagaggtaatgagttaaaagaattatttgtataatttaataatgtttttgaggatggatttggagggtttaaaatatatattattaatgggaaaattttgggttgaaattaatttgtaggaatattttatataaagttgatttggagaaaatttttaagtggtttattttgagaaaaggaattaatgtaattatagtgttttatgtaattttattgtataattttttaaatttaaattttcggattttttttgtagattggtgaatttagtatttaaatatgaaacgttagttttgtttagagaataaaatgagtttaatgtatagatttatttgttattattttttatattaatgtgtaaatgattgtttgtttttttattaaatatatttttcgtaatattatttaaataggtttattttatttttattgagataagtattttggtatttagtttttatatttattaagaattaagaaatgttgttttaaaagtttaggaaatgtatatagaaaatatattttatgtttttatatatgtgttttagatataggggaggaattagaataaattttttaaataaataaattatttgtttatttaaaattgtaattaaaaaatgaagttttttttcgttagttgtaaattatattgagaaattgtaatataaaaaagaatggatttttaaaattttttgagtagattaagtgttttgtataatattattaaatttgtattagaatatataaatggaaatgaggtggggaagtaattgtagtattttttagagtttaggttttgaaattttttttggtgaatatttattaaattagttaaatattttaatttatttaaatataaatttaaattattattattttagatagagagatgatatagtaacgggatttcgaaaaggtgattttttgtggttgtatgtagtgtttagatggaaaaattttaggattattaaaaggttttttgattattaggcggtaaaaattaattttgaattatttgtttattcggtagtaggttttttttaatagatattttaaatattttggttttgagaaaataaaaattttattattttataaaaatataaattattgaatagtatattatttgttgtttgtaaaaatttttgtagatgtttagaaatttattatttatttatttaattattggtaaattattatattaattgttaagaattaaagttgtatttaattataatatatagttaatgttttaagaattgagattaggttttgttttggtaatttttaagttgatttatagttaatagttgttgaaattttagtattttgtatataattatgaagtaagtttaaaattttggttgaagtaattttttttattattttaagttataaatatagatggttatgatttatattttttttattatttttatttattttttgttaatgtttattttaaaaatattttttttttttttttttggtgatttggaaatgtttttatatttatatgggatatataatatattatgttatattatgttgagttattaatgttaaatagagttaatagtgatatttaatatatataataagttttgttaaaatttttttaggaaaatttggtagagttttatgttgttaagattagtttagtttttttttgaattttttaattaggttgataaaatttagaaagtttttagagttagtgataaaattatttttttagtttaatgtttttatttgttgttaaggtaaagaatagtaattgggtagaagagtttatttttaatgtttttttaataaataaatgtttaaatgtttgtgtgatatatattgatgttaatttttattataaatgaaattaaaatatttgttggttttaaggaaaattgattatggtgtgttaattttatgttaataagtagatatgatattttaattaattttttgttatttagtaaattatatagggtaagtataattttttaatgaaaggaagaaattatttgttttaaatttttttaattttggttattgttaatagttttaatagagtaataaaaattattttttagtaaaatttaaggaaattttacgttatttaatttgttttttagttgttgaaggaggatgtttttattttggttagttttatgcggatagagatgtttggaagttagaattatgttaaatatgtgtttgtgatttaggattcgttttttgcgatgatataatatgtgacgattaagaattagattgttttaatttagaaattttatttggagaatgttgtgtagtttgtttatagtttttaattgttgtgagtttaaagataaattgtatatttttaatatttatatttagatatatgaatagtttttatattataggagtttaaaagggaatgaaagttatgtttattaaatagttatgtttgtattacgagtaaaaagtgatcgttttaatttaaagataaggattggttagaatttgggttattaaataatatgtaaattttgtgttttgtttaatttgttttttttttatttattagtttattcgtttttttaatggttaaggattttaaggttttaagggagatttagtaagtaaatattttttagtagaataaaattaatattaatgataattttagtaagagtttgttttttttagatttgagtttttattatatattttttttattattatatatttgaataatggtattaaataatagattgagaatttataattgtacgtgtaaagattttaattttttaaattttatattatgtttttatttttatgattagtttaaagaaaatgtgtaggttaatatataaaggaatatattatatttaaattatttataagattttgattaaaaagtatgtgttataaagaaaatatattatttatattgttttttaatattataaagtagagaaataataatttgataatgattgtgaattattaggattttttattatttaatttatttttattttttttttagggtttttttggtatttttgggagaaatggtgattttggtattttaggataattagggttttttggtttttttggtttttttggaatttgtgaattatgttttattggtttttaggtataataattacggtatttaaaaaatttttttataaaattatttagtttattttttttttttattcgatattacgttttattattatgagttttttgtatttgttttttgatttagtgtatttaataaatttttatttagtgtttttatgtattaggtattattttaagtattttataagtatttatttttttttataatgttaatgttattgttattatatttttggaaaatttgttaattttttagtagatatatagtatatatattatgtttaagaagtgaattatgaatttaataaaaaaaattaatttaaataatttagttagtattgtatttatattttatttttttattaatattaatgttaaagtttttaaaagtttagataaaaagaagttgaagaattgttagtatttttattgaataggattatttttgtttatgaaattgtttttgttaatattttagagtatattttgttttttttgaagtatggtagttaaataaatttgtaggtaaaataattaaataaataaatatgataaaatttttgttgtatggaattaggtgaaacgagaaaatatattatataaatttttgtgaggttaaaaagtgtattttaaaaagtaatttaataagaattaaagtatattgtttaagttatttttattttagtaattaaatagaatttaattttagatttggaatttagaatttaaaaaaagttttaaagaaatttaataagtatatgagtttttttattattttttggtttattttttatggagatgtttatttttgagtgaattttttagttatattaattagaatttaggggatatgaattttatttgtattattaagtgtttgaaaaataatttgattttatttttttgtttaaaatgagaaggtgtattatatgatttcgagatttttttggttttaaatagtttatgattttatgtttgtaatgatgtagttattgtttagaaataatagtttaagtaagcgtataataggaaaaattggggggaattaatattgaatatagtggaaagatttgtgtattttataagaaaatgtttttgtaggatatttaacgtttaaatttatagaaagatacgataaataagataattagtgaatatatattatattttttggtatataaaaatttattagtagatagtagatgttgtatgtatttttaaatgttttttaaaagaattatgaattgtttgttaaaatgattatatttatttgtttttttgttatagaattattttttttagtatgatttatatgatgttaagtttggagtagtagtaggaggattcgtaggttattttggattagttgtacgtataaatgttttttagtattttggagttttattatttttttggtttgtaaaattttgaatggttgtttttttaggaatttagtatttttatggaattgtataaaatagtttatttttattaaggttggaaaagaaaatggtagtattattatgttttttttattttatttatattattaaatttatttttaattatatataaatttttattaaaaaaaaaaattaaagttaatatttattaatattttagaaaagtgtttataagagaaaatggaaatatataaattattgttttataaatttattattagtatttagaaatagtatgttataaaattgaagtatattgtttttagtttgttgaaggttttttagtttaatttgtatttttgaataatgataaattaattgttttatgtatgatgatttttgtatgattatataaatttttatgttaattaattttgtgatagatatattaatataattatgggatttttgggttgatttatattattattttagatatttgattataggatttttagtgtgttaataaatgtttttttgtattgagtttggttgttaagcgagaaattgtttttttattagtgtaatataattttaatattgtagggatttttatagtattatgtattagtttttttagatttttaatttttttttttaagagtttaggataatattttataatatttattaataatttatatagaatttgtgagaattttattatagtaatgtttgtttgttaagatttttattatagattttatgaatagttattaaaaagttattaaaagatgagatatagttgtttatagttttaataatgcgagtgttattgttttgaagtatggataaagtgtattttgtatttatttattttgttttttatttaaatttatattttagggttttttaggttttttcggtttttttggtatatttggttattttggtttttttgtaagtatagttattggtggtgtttttttttttatttttagaaaaattaaattaatatatattttgttataatttagttattttagtatgtataattttagttaattagagaaattataattaagaaattgattaaggttttaaagatggaattttatatttaatttttttttattaatagttattagtaattgaaattttggtaaaattaaattatattaatttgtatgtaatatgatttttagtttaaaattatttagttttgatggattgtaatgaatggaatgaaatatattaattttattttgatttaaaaataatttggttttaatatttataaattggagtaaaatttgttgattatatttataattttgattttttattgttaagatgtaaatgaattatatgaagattttgttattttaaaattatttatatattttatttattagggatttttaggatattaaggattttttggtgaatttgggtaagttggttttttagtaagtaataattaaatttatatttagtaagtcgataattttatatggaatttatttttgttttttaaaataagtataggtttttatagaatgaagattaaatttatttttaagtttgtaaataacgaatagtattttattgagttttttggatttttttaattgttagttattttagagatattagttaataaaggaatttttttattattagttattaaaatagtttattttttagagttgataaaaattttgtatatattaaatatagattttatttttttgtaaatatttagtttatttatatttaatttattgataaatatagttatatatttatatatgtaaatatatatatatatatattttagatagtagaaataaatataattttagagagttttttagaaggatatgttttgtaaataagtaagtaaaatagtttaaatataatattttatgatatttagaaatatttttatatttagatatatttaatatttttaaacgtgtagaaatgtatttggatttataaatatatatacgtaatatatgatgtttttaatttttattaatagtaagttgatataatagaggtataatattaatttagtaagtattatttttattattagaaatattaaaagtattttttaaaaggaggttttttttaggaatatatatattgtgtaataataaattgtaatagaaaaatttataaatttatttattttttatttttttatttttagggttttttaggattttttggtgttataggtttatttggttttgttggaaaagatgtaagtttttaaaatttaaataagaatatagtaaaatttaatttggtgtattttaaatagtatatgttttatgttagaattttagaagaaaaaaaaatgttatttaaaatattgttgttttaataatattttagttaatattaatttttgagtagttatatagtatttgcgtttttatatatattatttgttgaattttaaaataaaatttttaaagtgttttttgattgcggagaagatttatttattgaatatattatttaattggaggagaaataggtgtttttgtttgttttttttaatgatgaaattgatattattatttaatgaatttgagaagttatagatatttttaatttaatggtatttttttttttttttttaatttttaatggtaaattttttttattggtttatgttattttagtgattagaagtatttgtattatttttttataagtttatattaaagtgggaaaggttttttttatgttttttattaagaaagttgattttaattatatattttgtggaattattttaatgagttttttgtgagaaaaatgtaaagtaattattttgtttattggttataatgtatttttttatatatgagtatttacgtattttttatttttttatttagggagaattaggtagattcggacgatttggagagcgaggattgtttggatttttagtgagtttttagtatttaataaattaattggaataattttagtttgaaaattattatgtaatttaatggaattaaatttaaaaatagaaagtgttttattattagattgtgattttatttgaaggtttattaatatttttttatttattatttttagggtattaaaggtttagttgggatatttggattttttggtatgaaaggatatagagtaagtagagtttttaagttgtttataaggtattttattgggttatgtttatttgtttaattaattttattggataattatgtgttaaaaaatatgattttgataattaattaatttgatatttttaagtttattaagtttgtttgttgattaaattagttattttttgtaaaataaaggagttgatttttagtgtataaagtatttttgaaaaatatcgtttttttattattattattagaaaaataaaaatattttgtgaattatgttttttattgatttaatatgatttatagattgagttgaataattttattttatgtaaaatatttcgtatatttaattaattgtgtttataatttattaattgaattataataaaatttatgaaatttatgtttgttattttatagttaaggtaatttttttattagattaaattgtattttttagtttttatgtttttttgttgtaaaattagtatgaaatatttttaatttttttaaataagttttaaattatttaagttaattttgtaagtagtgttatgaagattaattagaaaaatattatgtaaattttattaattattttagattattaatagattttaataattttgttggttttatatattttttagggtttcgatggacgaaatggagaaaagggtgaaataggtgtttttggattaaaggtaaattataataaaaattatatttttataagtaaatttattaaatattaaagttatatataagatttatattgtgagttttaatttgttttttgaaatttatttgaattttatttattaggtgtgaataatggtaattaatttagatattttattaacgtttttatgaaaaatgataatttgaagagtttagattagaaatagttgagtattttagtataatttattaattattttattttagtttttaagtttttaaatatagaaattgagatttttggtaaataaaatattaatagaaaattaatattgttaaaatgtatatttttttttaggttttataaatttttttataatattttgtatttaaaaatatataatatttttttttttttttgtaaaatagtaatatattttatatgtatttagggtgaaaatggttttttaggcgaaaatggagtttttggatttatggtaattatgttttttatgtataatttttagttttattattaattttattgttatttaaaattggttttgtttttattttaattgtttttatatatgttaagattagagtaaaattatattttaattttattttgtagggtttaagaggggtttttggtgagcgaggacggttaggattttttggggttgtagtgagtatagttgttaatattatataattataatttaaagtgatagatttttatagttttagtaaagttttaggttgtaaaaatatgttaggaaaaagatttttttataaaattatatttaatgatattgtgataaagttttggttatagttaaaaggaaatgaataattgttttataattattatttttattgagaatttttgtgttaattttttatatgttatttgagttattatatttgtatttagttttgaaaatatagattttaatttttttatatttgattgttgttgtatatattagaattgtaataattgattttaaaatatataattattaagtagattttaatgtatttgaagaaaatttaatttatttgagttagaattttggttaaaatattatttatgattagttatttagaattaaaaggatatttgatgtaaatttttttttttagggtgttcggggtaatgacggtgttcgaggtagtgatggttaattagtaagtaattttttattttttatgtgttgtagggtaatgagaagttatggattgtggattatttaatattttatatatgtatatatttttaggtatatatatatgtatatgtatatttttaatatatatattagtatttttgttgattatttttataatttaaaaagtgaaaaaatattgtagttttaatatttaatattgtatatatatttttgtgattaaaattgatattgagtttataaataaaatttaggttttgatatttattttgtttgattaattgttaatatttgaatggtgtttttaatgttagttaatattttatgtaagatatggtattttaaagagttttataaaatggataaaatagatgttatttttattttgtagattggagtataaaagtttagggaaaagtagtttgtattaagttatagaatttatggtaaagtagggagaaattaagaatttttaattttagattttattttttttttattttattatattgtttttttatataatatttataaaatatgaatattatttttatttgtataaatattttttttattttatatgtgtttatttatttattagtatgttagtttttatttagttgaaaaagagtttttgaaattgtatttaatttttttagggtttttttggtttttttggaattgtcggattttttggattttttggtgttaaggtaaatatgtgtttttatagaagggtataaaaatattttggaggtaagagaaaagtattagattgttttttgtaattgatttttttaattagttaaatggatagtttttatttatatatgtttttaaagttttatttttgattttaaaagaggtgttgtttttagtatttaattattttgatattttttttgttattttttttttttttttagattttttttaggaaattgataatgtaattatatatatatagttatatttttttttgtttttacgattaatgattttttgttttatttgtagtatagagttttattattttaatttttgggagatgtgtttaaataggattgaagggtgaagtggttaagtgagtagaagtggtaagagaaattgattatataaggttttattattagggtgaagttggatttgtagggttttttggtttaaatggtgtttttggataaagaggagaatttggattttagggatacgttggtgtttaaggtttttttgtaagtattatagttgagagggagtaagtatagttttatgtttattttatgaaagtatagttttatgtttattttatgaaagtatgtgttttaatatggttattagtgaaaattattttgaaaaaattgttgtttagtgttttaaaatgatttttttgtgatatatattgatttgattagtagtaaaaatgatagtttttgattgttgtattattttagaatttatgattttttatgtttatataaaagaatagaggatagattagttttttgatgtttttaagaatgtgttttaagttaattattaattataaaaatttagagaagaattaaatttaaaattttttttatttatgtattatttaataatttatacgaagtatatattatttttaatttatttagataatgatgatttttttgattatattttatatgttgtgttatagttggaggatttatttaatttttataaagtataatatttatcgatatatttatttttatataaataattttaaatatatacgaattatttgtattattattaatatattatttgttttttgtatatttagggtttttttgggattaatggtagttttggtggtaaaggcgaaatggtaagttgtttttattttttagttttattttatttatatattattggttttttttgtattttgtatgataatagatttgtgatatttaagtgagatatttataaaagaatatttaagttcggttaatatagtgtttttggtttgtttttagggtttcgttggtatttttggagtttttggattgatgggagttcggggttttttaggattagtcggtgttaatggtgtttttggattgcgaggtggtgtagtaagttgttttgttttttttttgttgattgaaaggtatagtttaattttattaataaaaaattaatagtaaaattttgtttttgtttagttgaatttatattgattttatttttgttttataatttataattgaattatgtgttattggtgatgatttgttagtcgaattttttttgtgttttaattaagattttgttatattttagggtgagtttggtaagaatggtgttaaaggagagttcggattacgtggtgaacgcgtaagttttattgtaatagatttggttattttttgaaaaaatgtaatataattagaaagtaaataggtaaaaattttgaattaaatttagttataatttttttattttattatttttttttttttttagggtgaggttggtattttaggtgttttaggagttaaaggcgaagatggtaaggatggattatttggagaatttggtgtaaatgggtttttaggagttgtaggagaaagggtacgttttttatggggtatttaaaagaaaagtagtattattgttatttaaataaaattatttttagggtgagatagttaattttttttaagttgagtgtttagtgaaaatattgtttaaagtattttatgatataaaaatatttgttatttaagaattatgaaaaagaattgaaattttttggattgaaatatttgttttttattatttttagggtgtttttgggtttcgaggatttgttggattaaatggtattttaggagaaaaggtagataattttagtttttatgtttttaaatgttagtattataaatgggtagtttttgtatataattttttatttatgaaaatttaaatatttgaagaatatatattagagttaagaaaaatttttaatataatgtattttttgtttaataatttttttggttttgtaattaaagttatttatttattttttatgagaattttttatttatttgttaattggaaagtatttatttgagtatcgttgtaagagtatagtaaattaaaatgtttgaaaagtttttgaaaattttaaggttatattaaatatgattttatagtattaagatatttgattttagttgtatataattatatttttaagtatagtgaatattgttttattaagtatgtgatgtttataaagttgttttaaaatttttttaatatggtaatttaagttaagataattgattttatgtataaatgttttagtaatatacgaattttttttaaaagtttaaatgacgttttttttttgtaattaaaatattgttgttatttaggttagtgaaggttattttaatttttttaaaattttttttattatttagggttttgttggagagcgtggtgttttaggttttgtagggtttagaggagttgttggagaatttggtagagatggcgtttttggaggtttaggaatgagggtatagagaaatatttgtttgaatgatattttaatttagatagaagaaaggtaagataaatgaagatagattaaaagtaatttaaattaattagattatatattttgtaaggtattaaataaaataaaatttttttaagtaaatttaagtcgagatagtttaaggagaagagaagatagaatatttgttttagatattttatagataggaaaaaagatgtgtaaatttgaggttttatatgtaagtgaaaatattaaaattatataaatagtgtatgtagtaattttttattattttattttaaattatttaataattgatttttttattttagggtatgttcggaagtttaggaggattaggaagtgatgggaaattagggtttttcgtatgtatatttttaaaattttattttaaaaggttagttaaaatggaatgtatatgttggtttatttttgagtgtgtgtgtgtgtgtgtgtgtatatatatatatgtatatgtatatttatatatatatatatatatatatatatatatatattatatatatagtatgttttaattttttttttattaaatttttattaatgtaatttttttttattagggaagttaaggagaaagtggtcgattaggtttttttgggttatttggttttcgaggttagtttggtgttatgggttttttcggttttaaaggaaatgatgtgagtttttttattaatttttttaataaatatttgattggaaggtttttattttttatatggagtaaagaaatggttaaaatttagttttttttttaaagtatggaggagtatatgaaaattaaattgtatgtaggaagggagttaaatatataattggttatggttgtatgtgtgtgtatggagtaggtagataaaaaatatgaaataggttgggtgcgttggtttacgtttgtaattttagtattttgggaggttaaggtaggtagattatttgaggttaggagttttaggttagttttgttaatatggtgaaattttgtttttattaaaaatataaaaattagttaggtatggtggtatgtgtttgtaattttagttatttaggaggttgaggtaagagaattattagaattcggggggtagaggttatagtgagttaagattgcgttattgtattttagtttgggcgatagagtaagatttagttttaaaaatatgtatgtgtgtgtgtgtatatatatatatgagatatatatatatgagatatatatatatgagatatatatatatgagatatatatatatgagatatatatatatgagataataatatgattagttattgttttttgaggattagtaaatatcgattattttttttttagggtgtttttggtaagaatggagaacgaggtggttttggaggatttggtttttaggtacgtagttttttttaatttatttttagttttttaatagatgcgtttatttttaattttttgatttttttttgtaatttgtattatttttatttttttaattgtttttgtttttagggtttttttggaaagaatggtgaaattggattttagggatttttagggtttattgtaagtttatttatataaaattggagatgaaaatagggtggaggtggggtaggaagaatgttttaaaaattatataatttttgatattatgttgttatagtttattaaagtaatgatgaaatttgttgatttagttatttagttaaatgttagtattgagtttagagtgtatatgtgtgttttgggtttaggtttttttttttttttatattattatttttataattaagtaataggtttgttgaaatggatattgtagattaaatataaaaggatgtttataatagagtgtattattatatttttttaggggtttggtggtgataaaggagatataggattttttggtttataaggattataagtaagaatttgttatttaaatgttacggtatatttgattgttaaatttttttgtgtttttaatagattataatttatttgaagtttaatttgtgattttgttttttatttggaaataaaattttaggtaatgttaataggtaggtatattttttatgttcgttttagagtatattaataagttatttaaaagaattaatgaaatttaaataattttatttggttatatttatttttattataatataaatttatatagttaagtttattttgttatgttggttaatatatttttacgtgtagtaattgaaagaatagagagagatgaaaatgggtttgtaaaatatgattattacgtatgtgttattggattttgagtggtataacgtttttatttttataagattattggaatttttttttaatattttgtagaaatatgtgtatatatgagaagtttttttataagttatgtttgaggtaattatttaatataaatatgattttttttagggtttgtttggtataggtggttttttaggagaaaatggaaaatttggggaattagtaagttacgttttattatttaaaatttagaaataaaaagaatatatattgtttgtttgttaattattaattttttaatttttttatgttatgatatttgagatttaatatttagttttgaaatattattaaaataaagataaattatttaaaagataattattatatagagtttgaattttattataaaatagagagtttatagttttaagatttgaaaaattatatagtatgttaatatgataaatgtgtattttgtttatatttatatatttgtttatatttatatatttgtttatatttatataaaatgtattttgatatgggtttaattatataatgttaattttttagggtttaaagggtgatgtcggtgtatttggagttttaggaggtaaggtagtattttaatttattttttattttttttagtaggttatagagtaattgattagtagtatatttttagtatattaagttaaaatattttttttttaaaagagtattattgtaaatgtttggtaagtatatttagagaaatttaagatatttttaatatattaaatttgttttaatttggaaggtttaattttttgatatttataattattatagaattaaatacgggtttaaaattttaaacggaaaaatattgttaatatgttgattttatgtaggaaaattgttttggtaaaaagaattttaaaatgttgtttttgtgaataaaataataagtattttaatgatagtttatatttaattagattaagtatttaagttttattttagatatttttttaagtttttagtttttatttagttgtttaattatttttaagtatataaatttttagattgtttataatataataatttagtggtttgatttaaaatgatgtaagttaaggtgttttgtttttagttttgggttgtttaatatggttatttatatatttttgttatagggtgatgttggtgtttttggtgaacgtggattttttggattggtaggggttttaggatttagaggtggagttggtttttttggtttcgaaggaggaaaggtaattttatagtattttatttatttaggtttaaaaaatgtatttgatttttttttgattatttattattttttatttatttttagggtgttgttggtttttttgggttatttggtgttgttggtatttttggtttgtaaggaatgtttggagaaagaggaggttttggaagttttggtttaaagggtgataaggtgttgatttgtttttttttaattgtttaataaattagttattgtaggttttaaaaaaagtaatatttttggaaagtaatcgattgtatttttaaaattaatgttattattttatagtaagtgaaatttaagatggatttttaaagtaataatgaattagaatatttaatatatatttttataaattttgagagttatttttttttttggttgatttttattgaagatattttgaatttgatgatattggtttttatttgatagggtgaattaggcggtttaggtgttgatggtgttttagggaaagatggtttaagggtgagtatttttagtgaggagaagtaggttttatttatatgttatatgggatagttttgtattttaattttaattttttttaaaaattatttaagagaaattagatattttattatttaaagattcgaatgatttgatttataatgaaatttgtggtttatatttatggttatttgatagatttatagtgattaaagaatgaaaaagttttaagagtacgataaaggttataaattagtatttgtgagttattaaaatttgagataattattgaaatttaggataattaatgttgtttattaagaaattaaaagttattaaaatttaatatagtaagtattttttattaatagatttaatatttaaaaattgtatagtatttagtaataaaaaggaatgaataattgatgttgtatatatagtaaattatataaattttaaggataatatatttagtgaagaaaatttagttattaagggatatatattgtatgattttatttttataatatttgtaaaataatttttttgtagagatgtagaatagattagtggttgttagtagttaagaatgagaaagagagagatggatgtggttatggagatatgatataagggagttttatggtgattgtatatttgagtattttgattgaggtggtagttaggtatatttatatatgggataaaattttatagagttatatatatatatatataaatgagtgtgtgtattattggtgaaatttgaatatgttttatggatggtattaatgttaattttttagttttgatattatattatagttgtgtaagatgttaatattaggggacgttgggagaaaagtgtatagaatttttttgtatatttttttgtagtattttatgaatttataatttaaattaaaagttaaaaataaaataaaaaatattttttaaatatgattataattaagttttttaataaatttatataatagttgttttaaagaaatttataaatgtttcgtttttgatagattaagtagataagtcgttatttaggtaaaaagagtgtttaatattttagttttgtaatataagtaaaattattatttgaaaattttaagttgaaaaatttaatatgtataatgagattttgagaaaatatttaaattattaagtaattgaataaagaaatgtattttaatttaaaaagatattattgtaagattttatatgatattttatttattttttataatggagataaagataaatgaattaataaattattgttgaattttatttttttttagagttatttttaaagaggtttgtgtttattgagttttgtagtatttatatattgagagaaaagtatagtatttaagttataaaaatttttaaaaagtatgttatttagtttattaggtatttatgtttatatattttttgtttgattaatgtaaaaaacgatatttgtatttttaaaattaaaaaatatttttattttttttagggttttattggttttattggtttttttggtttagttggttagtttggagataaggtaatttttaatattatttggatataaaaagaaaatgttttttttttttggatgtaagatagtgatatggtttttttttttttagggtgaaggtggtgttttcggatttttaggtatagttggatttcgtggtagttttgtaagtgttaaagatatttttaatatattttttaattttatatagatagtagttatttatgtttttttttttggtagttttgtttttagttttttgagttttaatttggagatattatttttaaaaattatataaggaattatatagtatgtaagggaatgttaaattttttaaatttaatatttataggagattattttaaattaggattttttttttaaataattttggaaaaaatatatgaattgtataagtagtatatgtttgtaattaggtattttttaagtttatagaatttttgtttgagattttttttagatttaaaagttttgatttttaggatttaagattttggaaagatatttagtaaatggtttttaaaaataaattagttaattttttagttaagtttttattatatattgaaatatataaatatttatatatataaatgtgttaaatattttaaaatttttaaattattttttttgtaaataatattatagtaggaggtagaaggaattaatggttttggtattttttatttttaattttattgagaagtggtaaagtttttagaagtttattggttattttgtatattttttgtttaaaggaaagaaaagataagatgataagatgatattttttgtttaaaggagatgacgtatattttattgtgattaaggaggatatttttttttttagggtgagagaggtgaaattggttttttaggatttgttggtttttttggtgtttttgtaagtgtgaatatttatatatatatgttttatagtttaggatttttattttgttgaaaaattataaaagtatagttaagtttggtttttagttttattttagttgtttattttttataggattattgtatttttattttgttttattttatttttattgtcgttttttgaaagatggaaataaaaatatttgttttgtttttatgattgggtaatgaattaaagtagtattatggatttaaaagtattttgaatttttgtaaatttttttattataagatggtattaattaaaatttttttttaaattcggttttttttaaaaaaatttattggtgttgatttttaaatgtttaatttttagagatattttttttttttttaatggtaaataatgtatagtttatgtttttttggttatgttttttgattatgaaaatattttgattggttttattttgttatgtttttagaaagttttgtttttaaattttattttaattttttttatttgaagaattttatattttgaagagaaataataataagttaattgtattataaagagtgttagttgagagattgttgttgttgttgtatgtagggatagaatggtgaatttggtggtaaaggagaaagaggggtttcgggtgagaaaggtgaaggaggtttttttggagttgtaggattttttggaggttttggatttgttgtaagtttttttttttttttttgtttatttatttattatttatttatttattgattatttgtttattttttttttttttttttttttttttttttttgtaagttttaagtgttttaatggaaaaatatggaggtttattagtaatttaatattttatattgagatagtatgttatagtgttaagaatataatttttatatgaatatagtttaagtatgaattttagtattagtaatttaaaagttattttaatttttttatagagtttttggtttttaaaggtttaatgttttttttaaattttgattttggtgttatttttatataatttttttttattttatatagggtttttttggtttttaaggtgttaaaggtgaacgtggtagttttggtggatttgtaagtattgatttttttaattattattgaaaagtattaattgatattaatttgtataaaagttgtatttgagatattagttttataaagagaatgtaaaaattgtaatcgtttatttatatatgagttatatgtaaattttaaggggaaatataaattataaatgatttttaggtataatgtagattatgttatatattatattttttgtttgttgtatagttatttgttttatttttgaaatttaaaaatatattattattttatagggtgttgttggtttttttggtgttcgtggtttttttggtttttttggtagtaatgtaagtaattgttaaagtttttttttattatatattttagaaagagtatttatgtatgtataggatgagaaatttatatattgttatttatttttttagtaagttttaaataaaattatttgaagtaagtaaaaaaagaaagaaaaaatgtattttttattataaatatttaaattttaaataattatttgtagggtaatttaggatttttaggttttagcggttttttaggtaaggatgggtttttaggttttgcgggtaatattggtgtttttggtagttttggagtgtttggattaaaaggtgatgttggttaattaggagagaagggatcgtttggtgtttagggtttattagtaagtaattttatttttttaaattgattttattattttgatttttattataaatcgattagagaaaaatattgttatataaagatgagttaagtttttattatttgtattagggagttttaggtttatttgggattgttgggattattggagtacggggttttgtaggattattaggtatgttaggttttaggggaagttttggtttttagggtgttaaggtgagtatagttattttttattatattttttttttttttggtagtttttagagattatttaattatattaaggatgaaaagtttttttgttattggagtaaattagttaggagataatttttttttatttttagatttttaaaagtataaattttaataaatggttttagaatataaaatagggtatattatagataaattttgaatataaatataaataaattaatatgatgaaaataatattgttattttaaatattttttttaggaaatttgtgaatattttttaatttgttgattgttagttttgaagggggaaatagtgttagtttatagattttggaaagttttttattaatgttagttatttatttatttaagttattttgtatttttgatttttttttattagtattatatttttataatattttagtgtttagtatttaaaatattcgtttggtaaataggataataaaattgtatttttattagggttcgtattatggtattttaagtattttttttaataaaatgttatgtaatattgttataaaattaatattttatatttaagtgtgtttaattgatatgatatttttggtaagtgtatattttttagatagagataaataatttaattttaaggattattatatatttttagttttatgatggtttattattgtttttttttatattaattatgtttatgtatttattttagattataatgtatagtattttgaattagataattaatgtaattatttagttttttgttatttagagttattgagtaagttagaaaatgtaagaagtttgtttttttatatttttttttatagtaggtatagttttaattttaaaatttaatgaagattaaataaaataagttttttatttgaaaataaagatatttgataatattattttaattgattttttaagttgaaataaaatgttttttatttttttgtatatagggtgaaagtgggaaattaggagttaacggttttagtggagaacgtggtttttttggattttagggtttttttggtttggttggtatagttggtgaatttggaagagatgtgagtagtagtttttatttaattagttaggtagaatttgataatttattttagtaaaggtgaaattgagttttaatgtttaagagtgtaaatatggttatatagtaaagtttttttatttttaataatagaaatttttttattataatttaggatagatttaaaagtttttgtttattagtatttatttaatgaataattatttgtggagaaaatattatttttaattaaattaggaaaaaagttagtggggagaattataattgatatgttttttgagtgaaaatattttacggttatttatggttagttttttattatttttaaagaatttaaaattaatattatttataattaataaattataattgtatatatttataaggtataatgtgatgttttaatatatgtatataatgtggaatgattaaagtaaattaattaaattgtagatttttattaatagtttagattattattttttaaatttttatttattagaggtttgtaaagattttttttggatattatttttttaattattttttttttatgaatatattaattatttgtttggatattgtgattttttgaagggttatattgttttgtaatatttaagattttttatttttaagaattaattttaatttttttgagaattatattgttttgttgagaatgtatggatgaaatggtatttggaaggttttaagaaattttatttttttttttattttttaattagggaaattttggattagatggttttttaggtcgagatggattttttggtggtaaggtataataaatatatgtgtaattgatttgtgttattaaaataagtgattattatgtttattttgtatttatgaatttgtttatagggtgatcgtggtgaaaatggtttttttggtgtttttggcgtttttggttatttaggtttatttggttttgtcggtttagttggaaagagtggtgatagaggagaaagtgtgagtttttaaaagtagtatttgttttgtttgtttattttttttaataaagatatttgtaggtagaaggtagaatgttagatttgttaattaaaatatttattgttatttgttttatagttttaatgttagttgttttttagataaatgtgtgaataagttaatattagaagtatttggtagtagttaataaagaatttattattgaaattcgaaattatattaattagattaattatttatatgttgggtaaatgtaaggttaagttaatagggtttttgtttaatttttttgtttagattttttgagaaagttataaatagggttttagtattttgaaggtaaaaataatattaatttttaataattgtatgtatattataattttattataatgaaattatttatttttgaaaacgaaattgtgttaatatataaaattagtttcgtgtatgtttttttaattgaatgtttttattttagggttttgttggttttgttggtgttttcggttttgttggttttcgaggtgtttttgtaagttttgttattttttggttttattttgttttgttttttttttaatttattttatagtgtaggaaatattttattttttagcgtgtttaggaaaaaagaatgaatatatatatatatatatatatatatatatatatatatatatatttgttttatttatagatagatgatagatagatagatagatagatagatagatagatagatagatagatagaataaatataaatttttttttaatgataatgatatggaaagtagtttaggatttaaaagttttttggagttaaggatagaaatattagttgttagggatttatgtaatgattagtttaaaatgaaaataattatagaaataaattttattttttatttgaagtgtttgttgatgggggattttttagttgatagaaagttataaaatagatttaattattataaattttattttatttttttaatatgtatgtgtgtatatgattttaatttaaaatatgtttttaaagggtttttaaggtttacgtggtgataaaggtgaaataggtgaacgtggagttgttggtattaaaggatatcgaggattttttggtaatttaggtgttttaggttttttagtaagtgtatttattttgttggaaaatttttttaatgtatataaattttagagattaagagaagaaagttttttatttttaaaaatatgtattagaagagatgagaaatggatttgaaggttaatttgaaataataattagtatgatataatgggaagattaaagaaagaaaaaaaattttattatgatttttatgttttttgatttgattttgaatgtatagttttttagtgttttttaaggtttttatttttatgtatattttttttttttttagggttttgttggttagtagggtgtaatcggtagtttaggatttgtaggttttagagtaagtagtatagaaagatattataggtttatatgttttagatgtttgtattttagaaagatattttggtattgtgatgttatgatatttttttagggatttgttggatttagtggattttttggtaaagatggaattagtggatatttaggttttattggattattagggtttcgaggtaatagaggtgaaagaggatttgaggtaagatattatttatacgtatgtgtatttaatttgttataattttttaatttttagaaatatagcgtattatgtttaaattgaaatagagagacgtaatgtatttatttaatttagaaattgaataatgattttaagatattttttattatattaaaaatgtttttattatattataataggagaaaaatatttttttaaaaatttgattaggtatttatcgtattagaataatgatatttgtttaattaattaaataaattttgtttatattgttattttattagagattttagaattataatatttataattatttgcgtttatgtagtgtattttattttttaaatagtttttatggttattattttgttaatgatattattatttttaatattttttattttatgtttttgggtaaatgaaataaaaataattattttaataaattatatttttttttgttatgttaatattggaattgtagtttataggtgtttgtttatattagttatttagaaggaagaatgatagagaaaatttgtgttttgatattattgatttttatatagtggaataatattttttttgataatgaattgtagttattataaatcggtgattacgtgattttaaaggtatttaaataaatttttagtaaaataattttgatgatataatgaatgaattatttttaaggtatttttttggattagtaatgtatttttagagtggcgattgaatgtgtatattttaatgatttatgttttatttattttagggttttttaggttatttagggtaattaggtttttttggattttttggtgtttttggtttttgttgtggtggtgttggagtcgttgttattgttgggattggaggtgaaaaagttggcggttttgtttcgtattatggagatgaattaatggattttaaaattaatatcgatgagattatgattttatttaagtttgttaatggataaatagaaagttttattagttttgatggttttcgtaaaaatttcgttagaaattgtagagatttgaaattttgttattttgaatttaagagtggtatgtttggtagttttttatttttatggtaataggattatagagaaagttgtttagattagaatgggaacgaaaaaatatttatttttaatggaaagttgaaatagtattttaagaaagttaattgaattgaaattgtttgatataaaagagtaaattttgtagatgtaaaatataatataattttagattatgttaaatatagaaaaatataaagatatttttgtagaagttgtagtataaattgtaagttatttgagtataaagtaatatattttttttttttaggattaaatatatataatttgatgtagataattataatttgattattgtaatatttatttattgtaatgaatttaattattaaaatttttaaattaaataagtgaaaaattttagaatattgtataaaattaaatagaatattgtaatagtttaaggttttgtatatattgggttaaatatttttgaaaagtaaaattattttaagtttttaaatattttgatatggaatattgtttttgttaggagttatttttagaaattatttaaaataggagataagtattaattatagggattttagttttagaattattggaataaatttaggttagataattagtttatattattaagtaagattatatataataattatttttttttaaaggagagatttttgtaaatattatatagtaattaaaaggttttagtttagtgtattatttttattagaaattaagatgttgtattttattttagtgttttttgtagttatagttaatttttttattttagtaattttaattaaaaagtttttttattattttatatataaaatgtagatatattagtagttaatattatgaatgtttttataggtaaataaataaaattattttattattggattttataattaatttttatttttttttgtgattatttaggagaatattgggttgattttaattaaggatgtaaattggatgttattaaggtattttgtaatatggaaattggggaaatatgtataagtgttaattttttgaatgttttacggaaatattggtggatagattttagtgttgagaagaaatacgtttggtttggagagtttatggatggtggtttttaggtaggaaaggatatatttttttttaaataagttatttttatattttttgtattttttttatatgtttattataaagtaaagttattaggttggtataaatataattgtagtttttgttattgaaagtgatggtatgtaataaaaatatttttatatataaaatattcgtatataaaatatataaatagtttatattataatatgtatatatatattatatgaatttttcgcgtgtagttataattgaaatgtttgatttgttttatttgttttttattatagtttagttacggtaattttgaattttttgaagatgtttttgatgtgtatttggtattttttcgatttttttttagtcgagttttttagaatattatatattattgtaaaaatagtattgtatatatggattaggttagtggaaatgtaaagaaggttttgaagttgatggggttaaatgaaggtgaatttaaggttgaaggaaatagtaaatttatttatatagttttggaggatggttgtacggtaggaaatattttttttaatataggttataaagtagttagtattttagtttaattatgtaaattattttgaatagaataaataaaattaataggatgaaataaagatagtatttggtatgaattatatatattgtatttattgatttattgtagggaatgttaaatgtaataaaatggattttagtttttagatgaaaattagttgaaataaaagtatttaaaatttaaatttataatgtaaattttattagataattgggatagttattatatgttttgaataatatttgttatattaatttagtttgaaatatttgttttttaaaattttaaaggttaattttaaattttttatttgttattgttatttgtgaataaagggaaaatttatttttaatattagcgaattttattgtgagagatttattttttttttaataaattatttataaatttgttagtaatggtcggaattaggttttttgaggatgtattggtttatagtaattgttttgttgtatttattaagaatttttataaggtatttgtttaagaatattgtttattaattaagaagattatagttttgaagtagagtaggttttatatatatgaataataatatggtacgatgaatgtttttttagagtaaaaaggttttttttaatttgttaagttagagttgtttaagtaattgtaatgttatgattatgtatattttgtttttttttatagaaatatattggggaatggagtaaaatagtttttgaatatcgaatacgtaaggttgtgagattatttattgtagatattgtattttatgatattggtggttttgattaagaatttggtgtggacgttggttttgtttgttttttataaattaaattttatttgaaattttaataaaaaaaatttaattttatatgtgttttttttgttttaattttgttaattagtgtaagtgatcgataaaattttagttatttatttttaaaatgtttggaaatagtataatttgataaagaaaaatgatatttttttttttttgttgttttattaaatataatttaaatgttttttgttttatttttttattaattttaattttaaaatgttttaatggtgttataataaataaattttaatattttttatgataataatattgtgttatattttttgaattttagtttatttgtagagtaatgattgtgtttattagtaaaagataatttttttttttgaaatagttaaatacgaaattagaaaagttttttttattttaattattttaattggttagaaatatagattgtattttatgagttttagaagatgaaaaaaattttatacgttgataaaatttataaattttattgattaattttttggaagattggtttaaaaagaaaagtgtaatgtaagaatttaaagaaatatttttaaagttataattattttaatattggatattaattgtttgtaaaggtgtttttttttttttttgttattgttggttaagattattaatatttgggaaggttttaaagacgtatgttatggtgttaatgtatttttatttttaaattttagattagaattgttgatttgtatttagaatataaatgtataaaatttgtatatgttttttattagaaagatttattggtatgttataggggattttttttttttattttgtaaaggttaataataaaaattaaattatggggttgtttttgttatattagtatagagaatgtgttgaaatttaattttgtaagtttgtatgtggttgttgattttttttttttttatagatatttataataaaatattatattaaaatttttttgttttttgttattttttaaagatttaaaaaatgtacgtttatattaaggaattttagtaattttgaaaaagtatattgaattttaattttatagattaataatgtaataatttttaagaatataaaataatataatatatatttagagtagagataatgtttaatgaggaattttgtagatttttagattatatttgtaggaatttttgtgggatatattggatattgagggtattttgtttgaaagggttaatttttggaaatggtaatatagtaaattaaggtatttttaaattgggaataataagggaggaagatgttgatagtttattagaaagtaattgtaatacgggtttattgaaatatattaatattaagaaaaattgataagtattatatgattttatttttatgtggaatttaaaagagttgaatttattgatgaagaatagaatggtggtttttaagggtagaaggtggggtggggttgggagattttagtttatggatataaaattgtagtaagatagaagttataagtttaagagatttattgtgaaacgtggtgattatagttaataataatgtattatatt

SEQ ID NO: 27 - DNA, 41974 bp, Homo sapiens
tataaagttgtataataaaggggaggggagaggaaagagagaaatattgaaatatttttgttttatgtgttttttatggtggagataattgatttttttagtgttgttgtagaaagtgttgttggtatttattggtttattgagtttattatagttgtgtttgtgtattttttttaagttttattttttattgaattggaaaagatttgaatttttggttgataatttgttatatttttgttttgttttatttttttaggtattttttttgttaaaggagatttagattaattagtgttttagttggtgtaggtatttagatttgtgttaaagttttaaatgtaatttaaaaagtaaaatgatatgtttatgtgttttggttaatattagtgaagttagggaagtatgggaagaaatgtgtggttagataataatgaggatagtagtttttggatggtataataggatttagaagtgtatgtattttatttagtttagattttgtattaagaaatgttttgattttgtattaggaaatgttttgataggaggtagaaaaataggatttgggatatagaatgtaaaggattttagtgtaaaatttttatatttgaggtagtgaagaattgtaaattagaatatttggagaatgaattttttaggttttttttgaagattttaaaatataataatttttttatatgtaaaatattagttaatgttttttaagtgagtgtattaattatgaattttttttatgagtataaggtttttatttgaatagttaagtaaattaagaattttagaataatagtaattttatttataatgtttaaaataaagtataataagtattattttaaaaataatatttttaattttttatagtggaaaataaatttaatgaagaaatttaataaattttagtttttatagattatttaaaataatgagagaaatttaatatagatatatgaattttatgtagatataaagatattatgagaaaaattatgtttttgaattggtttgaatataggaaatattttttgtgtataggataaagatgtttgaaagatagaaagatgtatataatagtttttttttagtatttttattgtgatttagtagaaaagtttatatttatgattatttttaatagttattttttttttatgtttttaagtagtgattttttaatttaaaataaagatatataagaggttggttttgttttagttttttttttttgttattaaatgatgttatttatattgagatgttttggtttgtgtttttgtgattgaagatataagaaagtttgggaggttgaggtgggtggattatgaggttaggatattaagattattttgattaatatggtgaaattttgtttttattaaaaatataaaaaattaattaggtgtagtggtgggtgtttgtagttttagttatttgggaggttgaggtaggagaatggtgtgaatttgggaggtggagtttgttgtgagttgagattgtgttattgtagtttagtttgggtgagagagggtgattttgttgtaaaaaaaaaaaaaaaaaagatgtaagaaataagaaagtaagtttgttattgtttatgtttataggatttatgtatatttgggaatatatatatgatatgagttgagtgaaaatttagtaatataaattagaagaaagagaaagatgaaaattagtttaaaggaggtaatttatttaaggaggaaagttttgtattgaggtataaggaagtgatttttattaattggtgtgaaatggggagaattttatgtgtataggtatagagatggatatgtttaggtgaaggtgaagaaaattagtttaagtgattttgattagaattgaaatgtttattgtagattatagagatagatgaattaattatgaattgatgattagggtgtaaagagatatttttattgttagatatagttttatattgtggataagtatattttttttgtagagatttattaaagatttataaatggtatttgttttttttttaaatatgatataaaaattattgtttagatagatttagaaatatattggaaagttttgtggatgaggatttggaaagtatatatataaaagtttaaattagaaatatttatattaatttttagagtaatgtagaaaaaatgattattttttttggtatttttttgttattttatgtgataaatttttttttttttagttttttaaaaagttatgttatgaaaaggttgaatttttttttagaaaaatttgttttgttttttttaggtagtataaaaattggaaattttataagaaagtattttggtttgttaaagaaatttgtgagaaatggaaatagttatagataagtatttaatttttaggaagttatttaaatattgttgaaatattttgttttttgatatttgtttgaaatttaatttttaggatttagggtgggtggatgagttgaaggggtatatggtggtatttttttttgtgagttttttatagttttttatttaaattgagttaggattatttttggtaaaattttaatataaaaattttttaggaagattagttttgtaaattagatatattagataaatgggtattaagtagttttttaaaattatgtagttgttaattttataaggggaaataaaaatgtatgtatttatattgtatgtattaaaataaggtagagtatttttatatgtttttaagttatataaatatatatgtaagagtgaaatatgtaaaaaaatttttatataagtagatgtatataaattttagatgtgtttttttttttattgtgggttgtgttttttataagggaaaaagaaatatttattattttttttattgttgaggggatgggtgtggtttttatattttagaaaggggttggaaagtgagggaagttaaatttttttttatttaaggttaaagtaaaggaattttagtggttgagttttatgatgggtttggtgttgaagggtagggaataatttgatggtgttattttgaattgtttttttttttttttttttgtataaagagttttatgtttgatatttagatatgatgagttttgtgtaaaaggggagttggttattttttgttttgttttattttattattattttggtataataggaaggtgagtaggtattgattttaagaaattttatgggatttttgttttttttttttttataaagaggggtgtaaaggggaaaattagttgtttgatttaagataattttttttataagttttagattgtgaaatgttgaattgattatggttgtgttttttatattatttgaaaaataattgtgttatgtgtgtttttaagagttttgtggttaagataagatgtttttgtattaatttgtttttatgttaaaggtattggaaatttttaaaaatggttttaaaattttttttttttggattgttaatattttggaatatttttttaggtagtttggaagttattggttttttgtaataattttatgtttttttttgtttgttggattttttgtaaggttagaatattgagtattgttttttgaataagaatgttttttaaatattatggattaagaatagtttaaaggaagattttatgtattattagaattattgaatatatttttgtaaaatggttataagatatttataaatattttttaaagggattaaattgttaaaatattttattatttttgtttttattttgttttaagaatgattgattaatttattttttttagtagtttgatattaagggattaatattttttatatattttatgttttaattatatttgtattaatgaagaaaatattttttaaaatgttttaataggaggtttgattttgttgtaaataaggtaaagatattagtattgtttgattttagaaagttgttttgttatattttttaataattgtatgtaatgttttttatattttaattttttttaaaaatatatttgttttattatttatgtgaaaatatttttttatttattatagttatgaaaatgttgaataaattggaatataaatttttatagaaataaatatttaagtgttaaatgtaaagatagttaggagaaattattagataatttttattgtatataattaaatatggttatatttaaatatatagattttgtaaaggatattgtatgaaaatttggtttttgtttgtaatattaaatgtatttgttgtttttatagttaatatatgtaaatgtgtgtatgaggggaggggtagatatataatgaaatgtttttagttatatttagtttatggatataaaagaaaagaaatatttattttttttgtttttttaatttttttttttttttatttttttttttttttgttttgtttttttttttatttttttttattttttttggtttttttagatttttttttatttattattttatttttttttaggtaagtttatatttatttttttttttttttttgttttttttgtttgttattttttttttattttttatgtggtttttttatgtttttattttttttttttagttttttttttttttgtttttttatttttttttttttttgaatttttaattttttttttttttttattttttttttttttttttttttattttgttttttttaggagatgttataatttatagtttttttttaggatattaaatgattattattttttattaattatttattgaaaagattataaatttaggggttttagtttaaaaaattgtaatatatttgtagttgttttgtggttgtaagttttttataagtattgtggttatttttttttttaatttaattttagtgggggggtgtttgttatttatagtattttgatattatattaagttttgtttatttttttttttttttttagatgtaaaaaataattaataagtataaaattttgttgatatgtgtttgtgtgtttttaagtttaaaaagagttgaaagagaattgtttagtttattttttttgttatgagtaaaagtaaagttgaagtgatttaagatagtatattttatgttttttgtgggttttataaggaaattttgttattagataagttttggaaaagttataggaggtatttgaatatatagtatattgagagttgttataaagttttggggtggggttttttatatatgtttttataattttagagatggtatagttttaatgaatatttatttttagtttatttataggtattttttggatataaataagtttttaaaaagaattttggttgttttataaatttgtgaatattgtatttaatttatgtgttttaatttattaatggagaaatatagtttgttttatattttttgtagattataaatatgttaagttttaagtataaagatgtgttatttagtggttgataagttaggttattatttatataatgaatgttaatattaatgttatgtagttggttttggtagtttataatgagttttaaaaaatttatatgtgtgaattttaaatgttaatattgtttttttaaggaaattagtatgttatggataaatattgtaaatatatatattgatatgaaaatataatggtaataatatttagagtttttttggaaattagtttaaatgttatggttatttaaaaattttatatatgattattgtttaaatatattttttatgtttttgatgtagtttttatttgatataagtattttatttattgtttaattgttagatagattatagatagttgttattaagtaatattgttttattagggtagaaatagaaattttattttaattaaatgtgtattaatgtttgagtttttatattttgttatagtgataattttagtaaaataaattgtaggtttttagttgttttagaattttaaaattgtaaatggatttagagaattagttttttattagatgttatgagagtatattttttttattatgttttaagagggaatttgtaatttgtttaggtaatatttaagttttttggtttgtgtttgtttttataattaaatatattgaattaataggaaaaggttatatatatttaggaataattgtatttttaaagggagagaatgtatagttgtttatatattttagtgttagttatttaatatggattagtgttttatttgagattataaaattagaaaatgatggagttaaggttaggattaatattttgtttagttttagataattatagaatatatattaaaattagatatttgaatttttttaattttgtaattatttgttattgaaaggagatattaaaaaaattatatattgttttagaaagtatatgaattaataatgtatttttaaaggtgaaaaaagaataggtatttttttgtttaatatttaattttatagagagtagtatgttaatttttttaaattttagaagtttaggattttattattttaaaagaaattattattagttttgtgtgagtaaataaagtattataatattttgtgttttttatttatgatattttgtatttatttatttgagttttttttttagggaaagaaaaatgtttaggtaataatagagttttgaaaaatttggatttttaaaattatttatttatgtataggtttttagattatttgatgttgaatattttttaagtgatttaaaggtttatatataaaaaggtatttttattaaattttggaattaaatattttagtattataagaaaagaaagtaaatttattggaataattttgggaaagaaggaaagattgtgattaaatgttttttaattattttagatttttggattgatgttttatttataggtttttttttaaaaattaagaatgattggttgtgagtttattaggattatagttgaggttaaaggatagttttttaggaaagtttttgttttatatttatggttatatgttggattttgagttgttatttagagaaaagagtgttatttattgaaattttatagtttttattgtgaatggtttttttggtgtagagttttaaaaattatgtagtttagttttttaattttgtaatatttaatgatattattgttttgaagtgattaaagtagattgtttaaagaattaaagttttaaagatgaaagatgttattgtttttgttggatatgaggaatagttgtaaagtttttaggtttataataattttttggaatttttttagtgaattgttttttgtaaaagttttttttaagataaaagtttaattttattgtttttatatttaaaaaaaaaaaaaaaaaaaagattatatagtgtaaaaaaaaattttttagattttttaaaggggaaattttgtttgttttatgttaagatgataatggaaaaaatgagatagttatttttatataaattatttgtgaattgtagttgggggagttatattaattattagagttttagtttgtgtttaatgaaaatatagtagaagtggattttttttagattaattaataaaatttttgtttttttttatgattgaggttaagtattgttgtttaaaatgtagttttaatgaataaaatgaaatgttgaaagaggatgagttaaaatgtttaaaagatgtaaatattaaagagaaaagatttagaaattattaaaagttaaattttttttgaattttagtattaagaaagtattgttttagtaaaatggtatatatttttttgaaattgtttttttatagtattttgtgtggaggatgatagagattgtattttttaagtaaattaaaattatagaaatattttttggagttgtatagtatgtttataatgttttagttttatttagtgaaaatttttgatgaatttagatgtatattaatatgaattatttagtaattatattttttgaaaaatagtgtgttaatgagatattttaaatatatttttgtattggatgtagaagttttttttgtttggtattattgttgttagaattttatttttttgtatatagtaaaatgtatgtagggtttttgagttatatatttattttgttggtggtttggatgttattagggtagttttagagatataatttttttttataaggttaagagaaaataaataggagaatttaattttagatggtatttttttgttttgaggttagatagaaaaatattttgtaaagaattgttgttttttaaaatatatttatttagatttagattttaattttgtagggataaaaaattatatgggatagagttttggagttggtttttttaattgtatttagttttgaaatagtagaaagaaaatagaatgtagtaattaagagtattaaatttagagaaagtttttttatatttagatttttttttttattttgattgtgtaattttgggaaaattatttaatgtttttgtagttaagattttttatttgtaaaattaggattatgatagttgtaagtttataaggtttttgggagtatgaagtaaaatagatatttaaattatttagagtagtttttataagataggaggtattatagtattagttttattaatgttggtaaataaaattattttaaggaagaaattaaagtatttagtaatttagtgataaggatggtgaaatgtaaaattttatttataagattatataatttaaagttgtttgttaaatgtaataagataagtagaatatattttttttaatgtttttataatttgatattaagaagattttattatatatgtaattgttggtggttagatatatgatatttaaaattttttaattatttaattatttttatttttaataggataaaatattaattaatttaaaggatatttttaaggagattgaattttaaaagattaattttttagataattttaaaagattaattttttagataattttaaaagattaattttttagataattttaaaagattaattttttagataattttaaaagattaattgaattttaaaagattaattaatttaaaggatatttttaaggagattgaaaaagtatatatttataaaatatgaaataagaaaatatttataaatgataatttattaatttttttttttggaggtagtaagaataaataaaattttattttttatgtaaaatagtgtttttaaattaaaattatttatttagaatgtttatagatattttttttagagttttttttgttaagtaatttaatatattttaagatattttgataaatatataagtagtagaaaaaatattttattaaaatttatgttttttaaataatattatttaaaaggtaaattaaatattattttaattggaaattatatgaatgttaaatatttatatgtataaaatatttagttttttaaagtaatgaaaataattatgataatttatatattatatttgtgatttttagatttttagattatataatatttttttttagataaggatttagtaagaagagaaaaggaaaaaatatttattttttatttaagttaaattaattaatttaattaggtgttttagggaataatattattgttttaaaaatagtattaagataaatataatatttattttttgtttaaataatatgatttttttaagttagtatgatttaatatgaagaatggaaataaaaaaattataaaatagtaagttttatgtatatttaaaaatataaaattatgttatttggttttatttttttttaaaattttaaaatagaaaattaggaaagaagtagttaagagtggtttaagatatgtgttagttttaatatgttttatattatagattttagtaaggagatgattgagtttaatatattgtttgtgtgattataagtaaattttttttagaattgtattttgtagtaaggaatagaaatattaaatgatatgggagatggaatttaaaattaattataaattggaatagagagatttagtttaaataattaaaataatggaaataattggaaagtttattattttttaatagtagaatgaaattatttgttttttatttaatatttttggaaaaaattaatttatttttttaattgaagttattttgaatgtagatatttaagaaatgaagagaataatatgagatgatttatttttaaattttattttttattttatttttaaatgttgtaaatggttaattagagtatttttatttttttagaaataaaatatttttttttttgattttgttatgatttttgtatatattattaggtattaaatgaaggtttatgaaatattaatttaagagttttaatttttagtagaatatattgttaattatattttgttatgtatggaataataaaggaagttatataaaattattttttttagtaaaggtaattaaggtagaaaaatagagaaagggttaatttttagttataagtttttataggaattgattttttaggagagttaaatttattttaagtggatgtgaaataagttatggtaataaataaagttgtattaatttttattttttaaatattttaatttttttttttttatttaaaataatatgattttttaaagtaaaataaaatatatatgtattatgttgattgttatgtgtaggtgagaagagaaaaatattttaagaatatgataatttttaaaattgtattaaaataatttttatattgaggtttttgtgttttaaaaagtattataatatgtttttaataaaatttagaaataataagttaaataataatgttaatatttataatattgtatttgatttaattttaataaatttatttataattttaataagttaatattgtgtttatttatttaataattagtagaataaatggaaagtattgtatttttaatgatgtgaggatatttttaatgagatataaatataggaggatgaatatataggagggaaaagtatttatgttaatttttaggtagattaagaatatatagaagatatttaaaataggaaatgtttgagtttagttttaattattatttttatttgtttttaatatgtttttagtatttaatggttgttttttataatttatgtgttgtattaagtgtgaaaagatatgtttgatttagaggtaatgagttaaaagaattatttgtataatttaataatgtttttgaggatggatttggagggtttaaaatatatattattaatgggaaaattttgggttgaaattaatttgtaggaatattttatataaagttgatttggagaaaatttttaagtggtttattttgagaaaaggaattaatgtaattatagtgttttatgtaattttattgtataattttttaaatttaaatttttggattttttttgtagattggtgaatttagtatttaaatatgaaatgttagttttgtttagagaataaaatgagtttaatgtatagatttatttgttattattttttatattaatgtgtaaatgattgtttgtttttttattaaatatattttttgtaatattatttaaataggtttattttatttttattgagataagtattttggtatttagtttttatatttattaagaattaagaaatgttgttttaaaagtttaggaaatgtatatagaaaatatattttatgtttttatatatgtgttttagatataggggaggaattagaataaattttttaaataaataaattatttgtttatttaaaattgtaattaaaaaatgaagtttttttttgttagttgtaaattatattgagaaattgtaatataaaaaagaatggatttttaaaattttttgagtagattaagtgttttgtataatattattaaatttgtattagaatatataaatggaaatgaggtggggaagtaattgtagtattttttagagtttaggttttgaaattttttttggtgaatatttattaaattagttaaatattttaatttatttaaatataaatttaaattattattattttagatagagagatgatatagtaatgggattttgaaaaggtgattttttgtggttgtatgtagtgtttagatggaaaaattttaggattattaaaaggttttttgattattaggtggtaaaaattaattttgaattatttgtttatttggtagtaggttttttttaatagatattttaaatattttggttttgagaaaataaaaattttattattttataaaaatataaattattgaatagtatattatttgttgtttgtaaaaatttttgtagatgtttagaaatttattatttatttatttaattattggtaaattattatattaattgttaagaattaaagttgtatttaattataatatatagttaatgttttaagaattgagattaggttttgttttggtaatttttaagttgatttatagttaatagttgttgaaattttagtattttgtatataattatgaagtaagtttaaaattttggttgaagtaattttttttattattttaagttataaatatagatggttatgatttatattttttttattatttttatttattttttgttaatgtttattttaaaaatattttttttttttttttttggtgatttggaaatgtttttatatttatatgggatatataatatattatgttatattatgttgagttattaatgttaaatagagttaatagtgatatttaatatatataataagttttgttaaaatttttttaggaaaatttggtagagttttatgttgttaagattagtttagtttttttttgaattttttaattaggttgataaaatttagaaagtttttagagttagtgataaaattatttttttagtttaatgtttttatttgttgttaaggtaaagaatagtaattgggtagaagagtttatttttaatgtttttttaataaataaatgtttaaatgtttgtgtgatatatattgatgttaatttttattataaatgaaattaaaatatttgttggttttaaggaaaattgattatggtgtgttaattttatgttaataagtagatatgatattttaattaattttttgttatttagtaaattatatagggtaagtataattttttaatgaaaggaagaaattatttgttttaaatttttttaattttggttattgttaatagttttaatagagtaataaaaattattttttagtaaaatttaaggaaattttatgttatttaatttgttttttagttgttgaaggaggatgtttttattttggttagttttatgtggatagagatgtttggaagttagaattatgttaaatatgtgtttgtgatttaggatttgttttttgtgatgatataatatgtgatgattaagaattagattgttttaatttagaaattttatttggagaatgttgtgtagtttgtttatagtttttaattgttgtgagtttaaagataaattgtatatttttaatatttatatttagatatatgaatagtttttatattataggagtttaaaagggaatgaaagttatgtttattaaatagttatgtttgtattatgagtaaaaagtgattgttttaatttaaagataaggattggttagaatttgggttattaaataatatgtaaattttgtgttttgtttaatttgttttttttttatttattagtttatttgtttttttaatggttaaggattttaaggttttaagggagatttagtaagtaaatattttttagtagaataaaattaatattaatgataattttagtaagagtttgttttttttagatttgagtttttattatatattttttttattattatatatttgaataatggtattaaataatagattgagaatttataattgtatgtgtaaagattttaattttttaaattttatattatgtttttatttttatgattagtttaaagaaaatgtgtaggttaatatataaaggaatatattatatttaaattatttataagattttgattaaaaagtatgtgttataaagaaaatatattatttatattgttttttaatattataaagtagagaaataataatttgataatgattgtgaattattaggattttttattatttaatttatttttattttttttttagggtttttttggtatttttgggagaaatggtgattttggtattttaggataattagggttttttggtttttttggtttttttggaatttgtgaattatgttttattggtttttaggtataataattatggtatttaaaaaatttttttataaaattatttagtttattttttttttttatttgatattatgttttattattatgagttttttgtatttgttttttgatttagtgtatttaataaatttttatttagtgtttttatgtattaggtattattttaagtattttataagtatttatttttttttataatgttaatgttattgttattatatttttggaaaatttgttaattttttagtagatatatagtatatatattatgtttaagaagtgaattatgaatttaataaaaaaaattaatttaaataatttagttagtattgtatttatattttatttttttattaatattaatgttaaagtttttaaaagtttagataaaaagaagttgaagaattgttagtatttttattgaataggattatttttgtttatgaaattgtttttgttaatattttagagtatattttgttttttttgaagtatggtagttaaataaatttgtaggtaaaataattaaataaataaatatgataaaatttttgttgtatggaattaggtgaaatgagaaaatatattatataaatttttgtgaggttaaaaagtgtattttaaaaagtaatttaataagaattaaagtatattgtttaagttatttttattttagtaattaaatagaatttaattttagatttggaatttagaatttaaaaaaagttttaaagaaatttaataagtatatgagtttttttattattttttggtttattttttatggagatgtttatttttgagtgaattttttagttatattaattagaatttaggggatatgaattttatttgtattattaagtgtttgaaaaataatttgattttatttttttgtttaaaatgagaaggtgtattatatgattttgagatttttttggttttaaatagtttatgattttatgtttgtaatgatgtagttattgtttagaaataatagtttaagtaagtgtataataggaaaaattggggggaattaatattgaatatagtggaaagatttgtgtattttataagaaaatgtttttgtaggatatttaatgtttaaatttatagaaagatatgataaataagataattagtgaatatatattatattttttggtatataaaaatttattagtagatagtagatgttgtatgtatttttaaatgttttttaaaagaattatgaattgtttgttaaaatgattatatttatttgtttttttgttatagaattattttttttagtatgatttatatgatgttaagtttggagtagtagtaggaggatttgtaggttattttggattagttgtatgtataaatgttttttagtattttggagttttattatttttttggtttgtaaaattttgaatggttgtttttttaggaatttagtatttttatggaattgtataaaatagtttatttttattaaggttggaaaagaaaatggtagtattattatgttttttttattttatttatattattaaatttatttttaattatatataaatttttattaaaaaaaaaaattaaagttaatatttattaatattttagaaaagtgtttataagagaaaatggaaatatataaattattgttttataaatttattattagtatttagaaatagtatgttataaaattgaagtatattgtttttagtttgttgaaggttttttagtttaatttgtatttttgaataatgataaattaattgttttatgtatgatgatttttgtatgattatataaatttttatgttaattaattttgtgatagatatattaatataattatgggatttttgggttgatttatattattattttagatatttgattataggatttttagtgtgttaataaatgtttttttgtattgagtttggttgttaagtgagaaattgtttttttattagtgtaatataattttaatattgtagggatttttatagtattatgtattagtttttttagatttttaatttttttttttaagagtttaggataatattttataatatttattaataatttatatagaatttgtgagaattttattatagtaatgtttgtttgttaagatttttattatagattttatgaatagttattaaaaagttattaaaagatgagatatagttgtttatagttttaataatgtgagtgttattgttttgaagtatggataaagtgtattttgtatttatttattttgttttttatttaaatttatattttagggttttttaggtttttttggtttttttggtatatttggttattttggtttttttgtaagtatagttattggtggtgtttttttttttatttttagaaaaattaaattaatatatattttgttataatttagttattttagtatgtataattttagttaattagagaaattataattaagaaattgattaaggttttaaagatggaattttatatttaatttttttttattaatagttattagtaattgaaattttggtaaaattaaattatattaatttgtatgtaatatgatttttagtttaaaattatttagttttgatggattgtaatgaatggaatgaaatatattaattttattttgatttaaaaataatttggttttaatatttataaattggagtaaaatttgttgattatatttataattttgattttttattgttaagatgtaaatgaattatatgaagattttgttattttaaaattatttatatattttatttattagggatttttaggatattaaggattttttggtgaatttgggtaagttggttttttagtaagtaataattaaatttatatttagtaagttgataattttatatggaatttatttttgttttttaaaataagtataggtttttatagaatgaagattaaatttatttttaagtttgtaaataatgaatagtattttattgagttttttggatttttttaattgttagttattttagagatattagttaataaaggaatttttttattattagttattaaaatagtttattttttagagttgataaaaattttgtatatattaaatatagattttatttttttgtaaatatttagtttatttatatttaatttattgataaatatagttatatatttatatatgtaaatatatatatatatatattttagatagtagaaataaatataattttagagagttttttagaaggatatgttttgtaaataagtaagtaaaatagtttaaatataatattttatgatatttagaaatatttttatatttagatatatttaatatttttaaatgtgtagaaatgtatttggatttataaatatatatatgtaatatatgatgtttttaatttttattaatagtaagttgatataatagaggtataatattaatttagtaagtattatttttattattagaaatattaaaagtattttttaaaaggaggttttttttaggaatatatatattgtgtaataataaattgtaatagaaaaatttataaatttatttattttttatttttttatttttagggttttttaggattttttggtgttataggtttatttggttttgttggaaaagatgtaagtttttaaaatttaaataagaatatagtaaaatttaatttggtgtattttaaatagtatatgttttatgttagaattttagaagaaaaaaaaatgttatttaaaatattgttgttttaataatattttagttaatattaatttttgagtagttatatagtatttgtgtttttatatatattatttgttgaattttaaaataaaatttttaaagtgttttttgattgtggagaagatttatttattgaatatattatttaattggaggagaaataggtgtttttgtttgttttttttaatgatgaaattgatattattatttaatgaatttgagaagttatagatatttttaatttaatggtatttttttttttttttttaatttttaatggtaaattttttttattggtttatgttattttagtgattagaagtatttgtattatttttttataagtttatattaaagtgggaaaggttttttttatgttttttattaagaaagttgattttaattatatattttgtggaattattttaatgagttttttgtgagaaaaatgtaaagtaattattttgtttattggttataatgtatttttttatatatgagtatttatgtattttttatttttttatttagggagaattaggtagatttggatgatttggagagtgaggattgtttggatttttagtgagtttttagtatttaataaattaattggaataattttagtttgaaaattattatgtaatttaatggaattaaatttaaaaatagaaagtgttttattattagattgtgattttatttgaaggtttattaatatttttttatttattatttttagggtattaaaggtttagttgggatatttggattttttggtatgaaaggatatagagtaagtagagtttttaagttgtttataaggtattttattgggttatgtttatttgtttaattaattttattggataattatgtgttaaaaaatatgattttgataattaattaatttgatatttttaagtttattaagtttgtttgttgattaaattagttattttttgtaaaataaaggagttgatttttagtgtataaagtatttttgaaaaatattgtttttttattattattattagaaaaataaaaatattttgtgaattatgttttttattgatttaatatgatttatagattgagttgaataattttattttatgtaaaatattttgtatatttaattaattgtgtttataatttattaattgaattataataaaatttatgaaatttatgtttgttattttatagttaaggtaatttttttattagattaaattgtattttttagtttttatgtttttttgttgtaaaattagtatgaaatatttttaatttttttaaataagttttaaattatttaagttaattttgtaagtagtgttatgaagattaattagaaaaatattatgtaaattttattaattattttagattattaatagattttaataattttgttggttttatatattttttagggttttgatggatgaaatggagaaaagggtgaaataggtgtttttggattaaaggtaaattataataaaaattatatttttataagtaaatttattaaatattaaagttatatataagatttatattgtgagttttaatttgttttttgaaatttatttgaattttatttattaggtgtgaataatggtaattaatttagatattttattaatgtttttatgaaaaatgataatttgaagagtttagattagaaatagttgagtattttagtataatttattaattattttattttagtttttaagtttttaaatatagaaattgagatttttggtaaataaaatattaatagaaaattaatattgttaaaatgtatatttttttttaggttttataaatttttttataatattttgtatttaaaaatatataatatttttttttttttttgtaaaatagtaatatattttatatgtatttagggtgaaaatggttttttaggtgaaaatggagtttttggatttatggtaattatgttttttatgtataatttttagttttattattaattttattgttatttaaaattggttttgtttttattttaattgtttttatatatgttaagattagagtaaaattatattttaattttattttgtagggtttaagaggggtttttggtgagtgaggatggttaggattttttggggttgtagtgagtatagttgttaatattatataattataatttaaagtgatagatttttatagttttagtaaagttttaggttgtaaaaatatgttaggaaaaagatttttttataaaattatatttaatgatattgtgataaagttttggttatagttaaaaggaaatgaataattgttttataattattatttttattgagaatttttgtgttaattttttatatgttatttgagttattatatttgtatttagttttgaaaatatagattttaatttttttatatttgattgttgttgtatatattagaattgtaataattgattttaaaatatataattattaagtagattttaatgtatttgaagaaaatttaatttatttgagttagaattttggttaaaatattatttatgattagttatttagaattaaaaggatatttgatgtaaatttttttttttagggtgtttggggtaatgatggtgtttgaggtagtgatggttaattagtaagtaattttttattttttatgtgttgtagggtaatgagaagttatggattgtggattatttaatattttatatatgtatatatttttaggtatatatatatgtatatgtatatttttaatatatatattagtatttttgttgattatttttataatttaaaaagtgaaaaaatattgtagttttaatatttaatattgtatatatatttttgtgattaaaattgatattgagtttataaataaaatttaggttttgatatttattttgtttgattaattgttaatatttgaatggtgtttttaatgttagttaatattttatgtaagatatggtattttaaagagttttataaaatggataaaatagatgttatttttattttgtagattggagtataaaagtttagggaaaagtagtttgtattaagttatagaatttatggtaaagtagggagaaattaagaatttttaattttagattttattttttttttattttattatattgtttttttatataatatttataaaatatgaatattatttttatttgtataaatattttttttattttatatgtgtttatttatttattagtatgttagtttttatttagttgaaaaagagtttttgaaattgtatttaatttttttagggtttttttggtttttttggaattgttggattttttggattttttggtgttaaggtaaatatgtgtttttatagaagggtataaaaatattttggaggtaagagaaaagtattagattgttttttgtaattgatttttttaattagttaaatggatagtttttatttatatatgtttttaaagttttatttttgattttaaaagaggtgttgtttttagtatttaattattttgatattttttttgttattttttttttttttttagattttttttaggaaattgataatgtaattatatatatatagttatatttttttttgtttttatgattaatgattttttgttttatttgtagtatagagttttattattttaatttttgggagatgtgtttaaataggattgaagggtgaagtggttaagtgagtagaagtggtaagagaaattgattatataaggttttattattagggtgaagttggatttgtagggttttttggtttaaatggtgtttttggataaagaggagaatttggattttagggatatgttggtgtttaaggtttttttgtaagtattatagttgagagggagtaagtatagttttatgtttattttatgaaagtatagttttatgtttattttatgaaagtatgtgttttaatatggttattagtgaaaattattttgaaaaaattgttgtttagtgttttaaaatgatttttttgtgatatatattgatttgattagtagtaaaaatgatagtttttgattgttgtattattttagaatttatgattttttatgtttatataaaagaatagaggatagattagttttttgatgtttttaagaatgtgttttaagttaattattaattataaaaatttagagaagaattaaatttaaaattttttttatttatgtattatttaataatttatatgaagtatatattatttttaatttatttagataatgatgatttttttgattatattttatatgttgtgttatagttggaggatttatttaatttttataaagtataatatttattgatatatttatttttatataaataattttaaatatatatgaattatttgtattattattaatatattatttgttttttgtatatttagggtttttttgggattaatggtagttttggtggtaaaggtgaaatggtaagttgtttttattttttagttttattttatttatatattattggttttttttgtattttgtatgataatagatttgtgatatttaagtgagatatttataaaagaatatttaagtttggttaatatagtgtttttggtttgtttttagggttttgttggtatttttggagtttttggattgatgggagtttggggttttttaggattagttggtgttaatggtgtttttggattgtgaggtggtgtagtaagttgttttgttttttttttgttgattgaaaggtatagtttaattttattaataaaaaattaatagtaaaattttgtttttgtttagttgaatttatattgattttatttttgttttataatttataattgaattatgtgttattggtgatgatttgttagttgaattttttttgtgttttaattaagattttgttatattttagggtgagtttggtaagaatggtgttaaaggagagtttggattatgtggtgaatgtgtaagttttattgtaatagatttggttattttttgaaaaaatgtaatataattagaaagtaaataggtaaaaattttgaattaaatttagttataatttttttattttattatttttttttttttttagggtgaggttggtattttaggtgttttaggagttaaaggtgaagatggtaaggatggattatttggagaatttggtgtaaatgggtttttaggagttgtaggagaaagggtatgttttttatggggtatttaaaagaaaagtagtattattgttatttaaataaaattatttttagggtgagatagttaattttttttaagttgagtgtttagtgaaaatattgtttaaagtattttatgatataaaaatatttgttatttaagaattatgaaaaagaattgaaattttttggattgaaatatttgttttttattatttttagggtgtttttgggttttgaggatttgttggattaaatggtattttaggagaaaaggtagataattttagtttttatgtttttaaatgttagtattataaatgggtagtttttgtatataattttttatttatgaaaatttaaatatttgaagaatatatattagagttaagaaaaatttttaatataatgtattttttgtttaataatttttttggttttgtaattaaagttatttatttattttttatgagaattttttatttatttgttaattggaaagtatttatttgagtattgttgtaagagtatagtaaattaaaatgtttgaaaagtttttgaaaattttaaggttatattaaatatgattttatagtattaagatatttgattttagttgtatataattatatttttaagtatagtgaatattgttttattaagtatgtgatgtttataaagttgttttaaaatttttttaatatggtaatttaagttaagataattgattttatgtataaatgttttagtaatatatgaattttttttaaaagtttaaatgatgttttttttttgtaattaaaatattgttgttatttaggttagtgaaggttattttaatttttttaaaattttttttattatttagggttttgttggagagtgtggtgttttaggttttgtagggtttagaggagttgttggagaatttggtagagatggtgtttttggaggtttaggaatgagggtatagagaaatatttgtttgaatgatattttaatttagatagaagaaaggtaagataaatgaagatagattaaaagtaatttaaattaattagattatatattttgtaaggtattaaataaaataaaatttttttaagtaaatttaagttgagatagtttaaggagaagagaagatagaatatttgttttagatattttatagataggaaaaaagatgtgtaaatttgaggttttatatgtaagtgaaaatattaaaattatataaatagtgtatgtagtaattttttattattttattttaaattatttaataattgatttttttattttagggtatgtttggaagtttaggaggattaggaagtgatgggaaattagggttttttgtatgtatatttttaaaattttattttaaaaggttagttaaaatggaatgtatatgttggtttatttttgagtgtgtgtgtgtgtgtgtgtgtatatatatatatgtatatgtatatttatatatatatatatatatatatatatatatatattatatatatagtatgttttaattttttttttattaaatttttattaatgtaatttttttttattagggaagttaaggagaaagtggttgattaggtttttttgggttatttggtttttgaggttagtttggtgttatgggtttttttggttttaaaggaaatgatgtgagtttttttattaatttttttaataaatatttgattggaaggtttttattttttatatggagtaaagaaatggttaaaatttagttttttttttaaagtatggaggagtatatgaaaattaaattgtatgtaggaagggagttaaatatataattggttatggttgtatgtgtgtgtatggagtaggtagataaaaaatatgaaataggttgggtgtgttggtttatgtttgtaattttagtattttgggaggttaaggtaggtagattatttgaggttaggagttttaggttagttttgttaatatggtgaaattttgtttttattaaaaatataaaaattagttaggtatggtggtatgtgtttgtaattttagttatttaggaggttgaggtaagagaattattagaatttggggggtagaggttatagtgagttaagattgtgttattgtattttagtttgggtgatagagtaagatttagttttaaaaatatgtatgtgtgtgtgtgtatatatatatatgagatatatatatatgagatatatatatatgagatatatatatatgagatatatatatatgagatatatatatatgagataataatatgattagttattgttttttgaggattagtaaatattgattattttttttttagggtgtttttggtaagaatggagaatgaggtggttttggaggatttggtttttaggtatgtagttttttttaatttatttttagttttttaatagatgtgtttatttttaattttttgatttttttttgtaatttgtattatttttatttttttaattgtttttgtttttagggtttttttggaaagaatggtgaaattggattttagggatttttagggtttattgtaagtttatttatataaaattggagatgaaaatagggtggaggtggggtaggaagaatgttttaaaaattatataatttttgatattatgttgttatagtttattaaagtaatgatgaaatttgttgatttagttatttagttaaatgttagtattgagtttagagtgtatatgtgtgttttgggtttaggtttttttttttttttatattattatttttataattaagtaataggtttgttgaaatggatattgtagattaaatataaaaggatgtttataatagagtgtattattatatttttttaggggtttggtggtgataaaggagatataggattttttggtttataaggattataagtaagaatttgttatttaaatgttatggtatatttgattgttaaatttttttgtgtttttaatagattataatttatttgaagtttaatttgtgattttgttttttatttggaaataaaattttaggtaatgttaataggtaggtatattttttatgtttgttttagagtatattaataagttatttaaaagaattaatgaaatttaaataattttatttggttatatttatttttattataatataaatttatatagttaagtttattttgttatgttggttaatatatttttatgtgtagtaattgaaagaatagagagagatgaaaatgggtttgtaaaatatgattattatgtatgtgttattggattttgagtggtataatgtttttatttttataagattattggaatttttttttaatattttgtagaaatatgtgtatatatgagaagtttttttataagttatgtttgaggtaattatttaatataaatatgattttttttagggtttgtttggtataggtggttttttaggagaaaatggaaaatttggggaattagtaagttatgttttattatttaaaatttagaaataaaaagaatatatattgtttgtttgttaattattaattttttaatttttttatgttatgatatttgagatttaatatttagttttgaaatattattaaaataaagataaattatttaaaagataattattatatagagtttgaattttattataaaatagagagtttatagttttaagatttgaaaaattatatagtatgttaatatgataaatgtgtattttgtttatatttatatatttgtttatatttatatatttgtttatatttatataaaatgtattttgatatgggtttaattatataatgttaattttttagggtttaaagggtgatgttggtgtatttggagttttaggaggtaaggtagtattttaatttattttttattttttttagtaggttatagagtaattgattagtagtatatttttagtatattaagttaaaatattttttttttaaaagagtattattgtaaatgtttggtaagtatatttagagaaatttaagatatttttaatatattaaatttgttttaatttggaaggtttaattttttgatatttataattattatagaattaaatatgggtttaaaattttaaatggaaaaatattgttaatatgttgattttatgtaggaaaattgttttggtaaaaagaattttaaaatgttgtttttgtgaataaaataataagtattttaatgatagtttatatttaattagattaagtatttaagttttattttagatatttttttaagtttttagtttttatttagttgtttaattatttttaagtatataaatttttagattgtttataatataataatttagtggtttgatttaaaatgatgtaagttaaggtgttttgtttttagttttgggttgtttaatatggttatttatatatttttgttatagggtgatgttggtgtttttggtgaatgtggattttttggattggtaggggttttaggatttagaggtggagttggtttttttggttttgaaggaggaaaggtaattttatagtattttatttatttaggtttaaaaaatgtatttgatttttttttgattatttattattttttatttatttttagggtgttgttggtttttttgggttatttggtgttgttggtatttttggtttgtaaggaatgtttggagaaagaggaggttttggaagttttggtttaaagggtgataaggtgttgatttgtttttttttaattgtttaataaattagttattgtaggttttaaaaaaagtaatatttttggaaagtaattgattgtatttttaaaattaatgttattattttatagtaagtgaaatttaagatggatttttaaagtaataatgaattagaatatttaatatatatttttataaattttgagagttatttttttttttggttgatttttattgaagatattttgaatttgatgatattggtttttatttgatagggtgaattaggtggtttaggtgttgatggtgttttagggaaagatggtttaagggtgagtatttttagtgaggagaagtaggttttatttatatgttatatgggatagttttgtattttaattttaattttttttaaaaattatttaagagaaattagatattttattatttaaagatttgaatgatttgatttataatgaaatttgtggtttatatttatggttatttgatagatttatagtgattaaagaatgaaaaagttttaagagtatgataaaggttataaattagtatttgtgagttattaaaatttgagataattattgaaatttaggataattaatgttgtttattaagaaattaaaagttattaaaatttaatatagtaagtattttttattaatagatttaatatttaaaaattgtatagtatttagtaataaaaaggaatgaataattgatgttgtatatatagtaaattatataaattttaaggataatatatttagtgaagaaaatttagttattaagggatatatattgtatgattttatttttataatatttgtaaaataatttttttgtagagatgtagaatagattagtggttgttagtagttaagaatgagaaagagagagatggatgtggttatggagatatgatataagggagttttatggtgattgtatatttgagtattttgattgaggtggtagttaggtatatttatatatgggataaaattttatagagttatatatatatatatataaatgagtgtgtgtattattggtgaaatttgaatatgttttatggatggtattaatgttaattttttagttttgatattatattatagttgtgtaagatgttaatattaggggatgttgggagaaaagtgtatagaatttttttgtatatttttttgtagtattttatgaatttataatttaaattaaaagttaaaaataaaataaaaaatattttttaaatatgattataattaagttttttaataaatttatataatagttgttttaaagaaatttataaatgttttgtttttgatagattaagtagataagttgttatttaggtaaaaagagtgtttaatattttagttttgtaatataagtaaaattattatttgaaaattttaagttgaaaaatttaatatgtataatgagattttgagaaaatatttaaattattaagtaattgaataaagaaatgtattttaatttaaaaagatattattgtaagattttatatgatattttatttattttttataatggagataaagataaatgaattaataaattattgttgaattttatttttttttagagttatttttaaagaggtttgtgtttattgagttttgtagtatttatatattgagagaaaagtatagtatttaagttataaaaatttttaaaaagtatgttatttagtttattaggtatttatgtttatatattttttgtttgattaatgtaaaaaatgatatttgtatttttaaaattaaaaaatatttttattttttttagggttttattggttttattggtttttttggtttagttggttagtttggagataaggtaatttttaatattatttggatataaaaagaaaatgttttttttttttggatgtaagatagtgatatggtttttttttttttagggtgaaggtggtgtttttggatttttaggtatagttggattttgtggtagttttgtaagtgttaaagatatttttaatatattttttaattttatatagatagtagttatttatgtttttttttttggtagttttgtttttagttttttgagttttaatttggagatattatttttaaaaattatataaggaattatatagtatgtaagggaatgttaaattttttaaatttaatatttataggagattattttaaattaggattttttttttaaataattttggaaaaaatatatgaattgtataagtagtatatgtttgtaattaggtattttttaagtttatagaatttttgtttgagattttttttagatttaaaagttttgatttttaggatttaagattttggaaagatatttagtaaatggtttttaaaaataaattagttaattttttagttaagtttttattatatattgaaatatataaatatttatatatataaatgtgttaaatattttaaaatttttaaattattttttttgtaaataatattatagtaggaggtagaaggaattaatggttttggtattttttatttttaattttattgagaagtggtaaagtttttagaagtttattggttattttgtatattttttgtttaaaggaaagaaaagataagatgataagatgatattttttgtttaaaggagatgatgtatattttattgtgattaaggaggatatttttttttttagggtgagagaggtgaaattggttttttaggatttgttggtttttttggtgtttttgtaagtgtgaatatttatatatatatgttttatagtttaggatttttattttgttgaaaaattataaaagtatagttaagtttggtttttagttttattttagttgtttattttttataggattattgtatttttattttgttttattttatttttattgttgttttttgaaagatggaaataaaaatatttgttttgtttttatgattgggtaatgaattaaagtagtattatggatttaaaagtattttgaatttttgtaaatttttttattataagatggtattaattaaaatttttttttaaatttggttttttttaaaaaaatttattggtgttgatttttaaatgtttaatttttagagatattttttttttttttaatggtaaataatgtatagtttatgtttttttggttatgttttttgattatgaaaatattttgattggttttattttgttatgtttttagaaagttttgtttttaaattttattttaattttttttatttgaagaattttatattttgaagagaaataataataagttaattgtattataaagagtgttagttgagagattgttgttgttgttgtatgtagggatagaatggtgaatttggtggtaaaggagaaagaggggttttgggtgagaaaggtgaaggaggtttttttggagttgtaggattttttggaggttttggatttgttgtaagtttttttttttttttttgtttatttatttattatttatttatttattgattatttgtttattttttttttttttttttttttttttttttttgtaagttttaagtgttttaatggaaaaatatggaggtttattagtaatttaatattttatattgagatagtatgttatagtgttaagaatataatttttatatgaatatagtttaagtatgaattttagtattagtaatttaaaagttattttaatttttttatagagtttttggtttttaaaggtttaatgttttttttaaattttgattttggtgttatttttatataatttttttttattttatatagggtttttttggtttttaaggtgttaaaggtgaatgtggtagttttggtggatttgtaagtattgatttttttaattattattgaaaagtattaattgatattaatttgtataaaagttgtatttgagatattagttttataaagagaatgtaaaaattgtaattgtttatttatatatgagttatatgtaaattttaaggggaaatataaattataaatgatttttaggtataatgtagattatgttatatattatattttttgtttgttgtatagttatttgttttatttttgaaatttaaaaatatattattattttatagggtgttgttggtttttttggtgtttgtggtttttttggtttttttggtagtaatgtaagtaattgttaaagtttttttttattatatattttagaaagagtatttatgtatgtataggatgagaaatttatatattgttatttatttttttagtaagttttaaataaaattatttgaagtaagtaaaaaaagaaagaaaaaatgtattttttattataaatatttaaattttaaataattatttgtagggtaatttaggatttttaggttttagtggttttttaggtaaggatgggtttttaggttttgtgggtaatattggtgtttttggtagttttggagtgtttggattaaaaggtgatgttggttaattaggagagaagggattgtttggtgtttagggtttattagtaagtaattttatttttttaaattgattttattattttgatttttattataaattgattagagaaaaatattgttatataaagatgagttaagtttttattatttgtattagggagttttaggtttatttgggattgttgggattattggagtatggggttttgtaggattattaggtatgttaggttttaggggaagttttggtttttagggtgttaaggtgagtatagttattttttattatattttttttttttttggtagtttttagagattatttaattatattaaggatgaaaagtttttttgttattggagtaaattagttaggagataatttttttttatttttagatttttaaaagtataaattttaataaatggttttagaatataaaatagggtatattatagataaattttgaatataaatataaataaattaatatgatgaaaataatattgttattttaaatattttttttaggaaatttgtgaatattttttaatttgttgattgttagttttgaagggggaaatagtgttagtttatagattttggaaagttttttattaatgttagttatttatttatttaagttattttgtatttttgatttttttttattagtattatatttttataatattttagtgtttagtatttaaaatatttgtttggtaaataggataataaaattgtatttttattagggtttgtattatggtattttaagtattttttttaataaaatgttatgtaatattgttataaaattaatattttatatttaagtgtgtttaattgatatgatatttttggtaagtgtatattttttagatagagataaataatttaattttaaggattattatatatttttagttttatgatggtttattattgtttttttttatattaattatgtttatgtatttattttagattataatgtatagtattttgaattagataattaatgtaattatttagttttttgttatttagagttattgagtaagttagaaaatgtaagaagtttgtttttttatatttttttttatagtaggtatagttttaattttaaaatttaatgaagattaaataaaataagttttttatttgaaaataaagatatttgataatattattttaattgattttttaagttgaaataaaatgttttttatttttttgtatatagggtgaaagtgggaaattaggagttaatggttttagtggagaatgtggtttttttggattttagggtttttttggtttggttggtatagttggtgaatttggaagagatgtgagtagtagtttttatttaattagttaggtagaatttgataatttattttagtaaaggtgaaattgagttttaatgtttaagagtgtaaatatggttatatagtaaagtttttttatttttaataatagaaatttttttattataatttaggatagatttaaaagtttttgtttattagtatttatttaatgaataattatttgtggagaaaatattatttttaattaaattaggaaaaaagttagtggggagaattataattgatatgttttttgagtgaaaatattttatggttatttatggttagttttttattatttttaaagaatttaaaattaatattatttataattaataaattataattgtatatatttataaggtataatgtgatgttttaatatatgtatataatgtggaatgattaaagtaaattaattaaattgtagatttttattaatagtttagattattattttttaaatttttatttattagaggtttgtaaagattttttttggatattatttttttaattattttttttttatgaatatattaattatttgtttggatattgtgattttttgaagggttatattgttttgtaatatttaagattttttatttttaagaattaattttaatttttttgagaattatattgttttgttgagaatgtatggatgaaatggtatttggaaggttttaagaaattttatttttttttttattttttaattagggaaattttggattagatggttttttaggttgagatggattttttggtggtaaggtataataaatatatgtgtaattgatttgtgttattaaaataagtgattattatgtttattttgtatttatgaatttgtttatagggtgattgtggtgaaaatggtttttttggtgtttttggtgtttttggttatttaggtttatttggttttgttggtttagttggaaagagtggtgatagaggagaaagtgtgagtttttaaaagtagtatttgttttgtttgtttattttttttaataaagatatttgtaggtagaaggtagaatgttagatttgttaattaaaatatttattgttatttgttttatagttttaatgttagttgttttttagataaatgtgtgaataagttaatattagaagtatttggtagtagttaataaagaatttattattgaaatttgaaattatattaattagattaattatttatatgttgggtaaatgtaaggttaagttaatagggtttttgtttaatttttttgtttagattttttgagaaagttataaatagggttttagtattttgaaggtaaaaataatattaatttttaataattgtatgtatattataattttattataatgaaattatttatttttgaaaatgaaattgtgttaatatataaaattagttttgtgtatgtttttttaattgaatgtttttattttagggttttgttggttttgttggtgtttttggttttgttggtttttgaggtgtttttgtaagttttgttattttttggttttattttgttttgttttttttttaatttattttatagtgtaggaaatattttattttttagtgtgtttaggaaaaaagaatgaatatatatatatatatatatatatatatatatatatatatatatttgttttatttatagatagatgatagatagatagatagatagatagatagatagatagatagatagatagaataaatataaatttttttttaatgataatgatatggaaagtagtttaggatttaaaagttttttggagttaaggatagaaatattagttgttagggatttatgtaatgattagtttaaaatgaaaataattatagaaataaattttattttttatttgaagtgtttgttgatgggggattttttagttgatagaaagttataaaatagatttaattattataaattttattttatttttttaatatgtatgtgtgtatatgattttaatttaaaatatgtttttaaagggtttttaaggtttatgtggtgataaaggtgaaataggtgaatgtggagttgttggtattaaaggatattgaggattttttggtaatttaggtgttttaggttttttagtaagtgtatttattttgttggaaaatttttttaatgtatataaattttagagattaagagaagaaagttttttatttttaaaaatatgtattagaagagatgagaaatggatttgaaggttaatttgaaataataattagtatgatataatgggaagattaaagaaagaaaaaaaattttattatgatttttatgttttttgatttgattttgaatgtatagttttttagtgttttttaaggtttttatttttatgtatattttttttttttttagggttttgttggttagtagggtgtaattggtagtttaggatttgtaggttttagagtaagtagtatagaaagatattataggtttatatgttttagatgtttgtattttagaaagatattttggtattgtgatgttatgatatttttttagggatttgttggatttagtggattttttggtaaagatggaattagtggatatttaggttttattggattattagggttttgaggtaatagaggtgaaagaggatttgaggtaagatattatttatatgtatgtgtatttaatttgttataattttttaatttttagaaatatagtgtattatgtttaaattgaaatagagagatgtaatgtatttatttaatttagaaattgaataatgattttaagatattttttattatattaaaaatgtttttattatattataataggagaaaaatatttttttaaaaatttgattaggtatttattgtattagaataatgatatttgtttaattaattaaataaattttgtttatattgttattttattagagattttagaattataatatttataattatttgtgtttatgtagtgtattttattttttaaatagtttttatggttattattttgttaatgatattattatttttaatattttttattttatgtttttgggtaaatgaaataaaaataattattttaataaattatatttttttttgttatgttaatattggaattgtagtttataggtgtttgtttatattagttatttagaaggaagaatgatagagaaaatttgtgttttgatattattgatttttatatagtggaataatattttttttgataatgaattgtagttattataaattggtgattatgtgattttaaaggtatttaaataaatttttagtaaaataattttgatgatataatgaatgaattatttttaaggtatttttttggattagtaatgtatttttagagtggtgattgaatgtgtatattttaatgatttatgttttatttattttagggttttttaggttatttagggtaattaggtttttttggattttttggtgtttttggtttttgttgtggtggtgttggagttgttgttattgttgggattggaggtgaaaaagttggtggttttgttttgtattatggagatgaattaatggattttaaaattaatattgatgagattatgattttatttaagtttgttaatggataaatagaaagttttattagttttgatggtttttgtaaaaattttgttagaaattgtagagatttgaaattttgttattttgaatttaagagtggtatgtttggtagttttttatttttatggtaataggattatagagaaagttgtttagattagaatgggaatgaaaaaatatttatttttaatggaaagttgaaatagtattttaagaaagttaattgaattgaaattgtttgatataaaagagtaaattttgtagatgtaaaatataatataattttagattatgttaaatatagaaaaatataaagatatttttgtagaagttgtagtataaattgtaagttatttgagtataaagtaatatattttttttttttaggattaaatatatataatttgatgtagataattataatttgattattgtaatatttatttattgtaatgaatttaattattaaaatttttaaattaaataagtgaaaaattttagaatattgtataaaattaaatagaatattgtaatagtttaaggttttgtatatattgggttaaatatttttgaaaagtaaaattattttaagtttttaaatattttgatatggaatattgtttttgttaggagttatttttagaaattatttaaaataggagataagtattaattatagggattttagttttagaattattggaataaatttaggttagataattagtttatattattaagtaagattatatataataattatttttttttaaaggagagatttttgtaaatattatatagtaattaaaaggttttagtttagtgtattatttttattagaaattaagatgttgtattttattttagtgttttttgtagttatagttaatttttttattttagtaattttaattaaaaagtttttttattattttatatataaaatgtagatatattagtagttaatattatgaatgtttttataggtaaataaataaaattattttattattggattttataattaatttttatttttttttgtgattatttaggagaatattgggttgattttaattaaggatgtaaattggatgttattaaggtattttgtaatatggaaattggggaaatatgtataagtgttaattttttgaatgttttatggaaatattggtggatagattttagtgttgagaagaaatatgtttggtttggagagtttatggatggtggtttttaggtaggaaaggatatatttttttttaaataagttatttttatattttttgtattttttttatatgtttattataaagtaaagttattaggttggtataaatataattgtagtttttgttattgaaagtgatggtatgtaataaaaatatttttatatataaaatatttgtatataaaatatataaatagtttatattataatatgtatatatatattatatgaattttttgtgtgtagttataattgaaatgtttgatttgttttatttgttttttattatagtttagttatggtaattttgaattttttgaagatgtttttgatgtgtatttggtatttttttgatttttttttagttgagttttttagaatattatatattattgtaaaaatagtattgtatatatggattaggttagtggaaatgtaaagaaggttttgaagttgatggggttaaatgaaggtgaatttaaggttgaaggaaatagtaaatttatttatatagttttggaggatggttgtatggtaggaaatattttttttaatataggttataaagtagttagtattttagtttaattatgtaaattattttgaatagaataaataaaattaataggatgaaataaagatagtatttggtatgaattatatatattgtatttattgatttattgtagggaatgttaaatgtaataaaatggattttagtttttagatgaaaattagttgaaataaaagtatttaaaatttaaatttataatgtaaattttattagataattgggatagttattatatgttttgaataatatttgttatattaatttagtttgaaatatttgttttttaaaattttaaaggttaattttaaattttttatttgttattgttatttgtgaataaagggaaaatttatttttaatattagtgaattttattgtgagagatttattttttttttaataaattatttataaatttgttagtaatggttggaattaggttttttgaggatgtattggtttatagtaattgttttgttgtatttattaagaatttttataaggtatttgtttaagaatattgtttattaattaagaagattatagttttgaagtagagtaggttttatatatatgaataataatatggtatgatgaatgtttttttagagtaaaaaggttttttttaatttgttaagttagagttgtttaagtaattgtaatgttatgattatgtatattttgtttttttttatagaaatatattggggaatggagtaaaatagtttttgaatattgaatatgtaaggttgtgagattatttattgtagatattgtattttatgatattggtggttttgattaagaatttggtgtggatgttggttttgtttgttttttataaattaaattttatttgaaattttaataaaaaaaatttaattttatatgtgttttttttgttttaattttgttaattagtgtaagtgattgataaaattttagttatttatttttaaaatgtttggaaatagtataatttgataaagaaaaatgatatttttttttttttgttgttttattaaatataatttaaatgttttttgttttatttttttattaattttaattttaaaatgttttaatggtgttataataaataaattttaatattttttatgataataatattgtgttatattttttgaattttagtttatttgtagagtaatgattgtgtttattagtaaaagataatttttttttttgaaatagttaaatatgaaattagaaaagttttttttattttaattattttaattggttagaaatatagattgtattttatgagttttagaagatgaaaaaaattttatatgttgataaaatttataaattttattgattaattttttggaagattggtttaaaaagaaaagtgtaatgtaagaatttaaagaaatatttttaaagttataattattttaatattggatattaattgtttgtaaaggtgtttttttttttttttgttattgttggttaagattattaatatttgggaaggttttaaagatgtatgttatggtgttaatgtatttttatttttaaattttagattagaattgttgatttgtatttagaatataaatgtataaaatttgtatatgttttttattagaaagatttattggtatgttataggggattttttttttttattttgtaaaggttaataataaaaattaaattatggggttgtttttgttatattagtatagagaatgtgttgaaatttaattttgtaagtttgtatgtggttgttgattttttttttttttatagatatttataataaaatattatattaaaatttttttgttttttgttattttttaaagatttaaaaaatgtatgtttatattaaggaattttagtaattttgaaaaagtatattgaattttaattttatagattaataatgtaataatttttaagaatataaaataatataatatatatttagagtagagataatgtttaatgaggaattttgtagatttttagattatatttgtaggaatttttgtgggatatattggatattgagggtattttgtttgaaagggttaatttttggaaatggtaatatagtaaattaaggtatttttaaattgggaataataagggaggaagatgttgatagtttattagaaagtaattgtaatatgggtttattgaaatatattaatattaagaaaaattgataagtattatatgattttatttttatgtggaatttaaaagagttgaatttattgatgaagaatagaatggtggtttttaagggtagaaggtggggtggggttgggagattttagtttatggatataaaattgtagtaagatagaagttataagtttaagagatttattgtgaaatgtggtgattatagttaataataatgtattatatt

SEQ ID NO: 28 - DNA, 38092 bp, Homo sapiens
taaattttttaatttttattttaggtttaagagtatatgtgtaggtttgttaaattttgtgttatagggattcgttgtatagattattttattatttagttataaagtttattttttaatagttatttttttgttttttttttttttcgacgttttattttttaagtgggttttagtgtttgttttttttttatttgtttttatgagtttttattatttagtttttattaatgtggtatttgggaaaatttaatttttgaaagatttttagtttgttaattatgaatggttaatataattataggtatgttaatatttgtaatattgtgatattttttttgttatttttagttaaaattgattttttgttttaaaaatttttgttattaataatagtttgttttttatagtttttttatatttttgtgttttttttttaattaaataattaatttttttagtattttatttatttttttttttttttttttttatttttaatttatatttttttttttattttaattttaatttgtgtttttttaagtgtattttagttttttttttaaaataattttaagtgatattttgatttttgattgtatatggaagtataagtaatatgtttttttatttttggataatgagttttttgattaattatagtttaagagtaaaatgattgattattatttaatttattttgtgtttttttataataaagtaaagatagaagttttagatttaggaatagataaaatattttaatcgttattatattttttttaagtttagttaattagaaaagttaaatttttttttatagttaagtatattaaaaaaaaattttttttggtaataaatttgaagttttaaataattttataattataaatattttgtgtattttgtaaatatggtataatttgttggtataaaattttattgttttagaaaatatcggtaataaaattatagaaaagttaaagatttttattttttatttcgaagcgtttgggagatattttagaaacggatgggaaatgttaaattttgtatgtttgtttaagtttttatttatatcgattagatgtaaacgagtgttattaaaagtatattataggtatttatatagattttttttataagggatttataaagtttagatgtgaaatgtatttaaaggtttttagtcgttttttatttttttttttgtgaaatagggagatatatgtgttttaaggtagagatggaatttgggcgatgggcggggggtgggggaggtgggaagggacggtttaggatagggtaggattgtggattgtttttgtcgttttggttgtttatattgggtatttttgtaggcgcgtcggttttttttatttttgttgagatgatgtattgcgaaaatattcgtttttttcgggacgtttttcggtggtttagagtagggaaaatgttgttttaggtttaaaataatttgtttaagtattttagcgcgggagaaacgtttttattcgttttttgttcgttgcgggcgtttttcgttttttgttgttagaattttggggatgtgtttagattcggcgtagtatacgttcgggttaatcgcgagtagaataaatttttggcgggcggttaggaggtttttttttagttatcgtttttttttagcgtttttttttttttttatataatataagattttttttttttagtttttttaaagtatagtttagggaaatttttttatagtttttatttagttacgggttagtatgtttgggggtaaatacgtagattcggaggtaggtattcgtgggggggcgtcggttcgggcgtgcggggagtgttcgtttttgttatttgtttttttaaatatttcgattgttgttttggttttagttttttttttatttcggagtatttttttggcgttggtatcgttgaggaatgggtttgggcggggaggtgaagagaagttaggaatgttttatgtttttttaatggagagggggtttagggagtttttgagttaggaggatacggaaaaggggattggggttttgagattgggtttgttgggtttaggacgcgttttttggatgggtttaggatgtttttttgtcgcgggattttcgcggttcggttttgtttgttgggggttcgaagaggtggagtgtagggtggaggtgttatttattcgagttttggggatagttttcgggatttttcgttaggcgtttagatcggtaggtttcgtaggcggcgcgcggtgtgtttgtattttttaaagtttttgaattattttaagaattttttttgtattttggcgtttggtaggggtgtttcgagagaggtagattttttttttttaaattgttattattatttttaacgttttttacgcgttggagttttgttcgggtgtggaaatttcgttttttaatacgtagttgttttttagttattcgttcgtagtttgggagtgttttgagggtgggtcgggggagttgcgtaggtgagattgagttttaggatatttagggggtttggtgtttggtttcgttaaaaatggggattttcgggattgtgattattacggcggattgagtagggagagtcgtggagggataagagagggtcgaggtagggtggggggcgcgggtaggtgcgagggggatgcggttaagaagtagcgataaagggaatattttacgggtcgggcggttgttgttggattttagataaagttggaagggattatcggggtaggggtaatagggatcggggacgggaacgcgaaataggtgaagcgtttagggcgagagcgattcggtttagggagttcgggagaagtttgcggttgttttttcgtcgtcgaggttttgcgggttttgcgggttttgcgtgttgagtcggggcgtgcgcgggcgggggttttcggatcgcgcggcggggtttgttttgatttttggcggcgggcgggggaggtaggcgcgttttgtagagtatagaggggtgtggtgttttttgcgagatttttttaaaaagttggttacgcgtaggcggtttttgtgtacggagtcgtagttgtcggagcggttagttcgatttcgagttcgaggtttttttcgtcgttaggttgattttttatcgtttgtttttttttttgtatttttttttttatcgtcgttgtcgtttttttcgttttggtcgttcgtttttcgttttttgtagggatatttttatatcgtttttattcgggaatagggtaatatttataagtttaataataaggttatggtagacgagttgagcgagaagtaagtgtacgacgcgtatattaaggagatcgatttggttaatcgcgattttaaatattttaacgatgacgtggttaaggtaagttaaggcgattaatagggaagggttgggatagtttttttttggtagttagttcgtgtatttttttttagtattgtcgtgtacgtatattttatttcgttttttatacgcgtatatatatatatatatagagttttgtgggtttgatgtgtgggagttttcgtagtcggtagaaacgttatatttttttttttttatttttttttaatagttagtttagttgaaatttagttaaagtgagttttgtagaagtttttataattatatttttattttagtaaatgagtttattgattttagtaatagacggtttatattttttgggacggtgagatggtttttatttatttttaggttgaaagtttagtgataggtttttattgtacgtggtattaagatagttagataattgtgttaggttttgtgttgaggatgagttagaatataagatgggtatgtttttttaattaaaacgatgggaagtgatttttttaaaaatattatagtggatggaaatgtttaggattaaagataaagaaaatacgtatttatttatatatatatgaaagttattttaattagattaataagttatttgtgtataattaagtaaatttataaaattaaaaataatgtatgttttttggttttttttatttatggatatttgtatttagatgtggaaagttgtttttttagtagttatttgggttagtttgttttgagttaatggtatatttaggttggagtttttttttatatttttaggatgtgtttggtgagattaaaaataattggattgggttattggttagatttagatttgatttagtggttagttttaaattattattgttattagattttgatttttttagttaatttagtgggaggaatttattgtttaaatatatttggattgggatattatgggttagagttatttttggtaaagggttttttttgagaaatggagggttaaggaaaaattttggtttagggattgtagtgtgaagatttatttttatataatttttagtaattaatgaggcggatgagtaatttttatttattacgtttgttatttatggatgggaggagttatagtttataaatcgtttatatttatgaataatatattttaaaaggggaaatagtttaatttgtaattggaagggaaaaaaaaattgttagaattgatttttttggttttttggagtaggaaaaaggaaaattggagtatttgtagttttttttgattagttggattatggaatatttaaaagtaatagtaataaaagtattttataaattagaaaatagaattgttaaaaaattatttattaaaaatattattttaaagggagaggatatttgtgtttttttttatttttattttttttatgtggttttgaataagaaggagagttgttaggaaaagaggtagattttagagagggttggttttattggattttttttgttgttttattgtattgtgagtgagattttttggagtaagcgaatttttcgggatgagttagagaggttaatagtgtggatgtgggtttttatatatagtatgattaagttgagaaagaaaggttttattgggaaaagagattttaatatagatggaaaaaaaatataataggtttggaggaaatagtagtttataaaatagtattttaaagagtaagtgtggggatttttaaattaaagaaattaaaagaaaaagttagagtaagtttttgttagtttaaagaaattaaattttgattatttgtttatagaattgtgagtaaaataagatagttaaattaaaaaatttatttagaaaagaatttggtagttttatttagatgtttggtttagaggggattttagagaatgttttatagagagatattaagattataaatgtaaattttgtttaaagagtgtttggtcgatgaatagggttttatttatattttatggagatttttattttataaatatgtatttttaagtttaagtataaataaaataatagaaatagggatgatttttttttagtttttatgatagtaaataataaatttttttaaattttatttttaataatatagattttttttatttttatttttatttatttatttatttattttttgagacggagttttattttgttatttaggttggagtgtagtggtatgatttgggattattgtaatttttattttttaggtttaagtaatttttttgttttagttttttgagtagttgggattataagtgtacgttattatgtcgggttaatatttgtatttttagtggagacggggttttattatgttggttaggttggttttgaatttttgattttaagtgatttattggttttggttttttaaagtgttgggattatagatgtgagttattatatttggttaataatatagattttttaaaaaaattatgataataattttgggtgttttttaaaagtatttaaagttttattgttaatgtatggtagtttaaaattttatataataagaaagaattagtggttaatggaatttattgttaaaggtatttaattaagtaaggaaaagttggttttaaaagtaagtagttttgtaaaagttgttttgtttaatatggtaattattagttatttgtgtttttatttaaattttaagtaattaatattaagtaaaatttaaaatttagttttttagttatattagttacgttgtgagtgtgtaataggtaaagttagtggtatagatatagaatatttttattagtatagaaatttttattggatagtgttagattagggtgttttttgtattgtaaaagtatttttttgttaagttaaagaaaataataataaaattttagagaagaaatgaaattttagttttatttttggagaggaaagaaaatttatgtgtggtatgagtttatatttaagaaggtgtagtattattatttattttattagtaataatgatatatattatagtatataatttagttttaataaaattaattttttattttattaaaagtttgttgttttatattatgagataatttatttaaatatagatatttatttaaaaatattaagtagtttgtgaatattttttaaaattttttttaattaaagtggttataaatttaaattttttattttttttttgagatttttgtgttattttttgtttatattgttatttatatgtttattatgtatttattttgattttttagataaataaaatggttttaaatttataattttgataaaattagttattaattaatttatttattaaatttatgtaatatgttagattagatgttttgttatgtaatttttataataaattttagtaattataaagattatagttagtgagacgatatgtatataggtaaaaagtgtttttaaaaaatatatatatataattaaaatagtaagttattgttatatggaaattgattggtttttttttttttttttttttttgttttgattgttaggaagtagttttaaatttatagttggattttaagttttattaatttatgtttttatatatggttttgtatttttattttttttttttaattgatatattgttttatgtgatttttattgtaagtttttttattattttggaaatagattaaatataatatatatgataaggaattaaaagtaaatatagtagtgttgaatattgtataataaaaaggtttttaaatagggaatggtattaatatgaagtgttagggagatttagttatgaaaaggatagtagggttagagaaggaggatgtattgtagttggtttaatggagaatggtatgaaggaggtgtagtttgaattgggttatggaggatagatggattgtaaatagttggggtaaaagtataggaaggtattttaaacgagttaggtatggagataagaatgttttttataagggagttgtagtagtttaattagattgggatttgagattttatgtggtagagtggtaggtgataaaggtgaaaagattgattatagtaaaatgcggagtttgtaaatttagtatttatgataagtttggatattatgttaatagtggatagttataaatgattgtaagtatcggtgtggtataatgaaggtgacgtttttgtaaaatgattttggtgaaggtatagaaggtaatgaaaagtagttagtttagttgagtagaaaagagtttagatgtaattgtattatggtttagatgtgaaatgaagataatgcgaagtggtattgtggatcgaaatatatatgtataaaatgatagaattttagaatttgaagggattattatggttattaggttggtttttaattttttttttgtaatattaatagaaattaagggttaataagtttaaaatgttatttatttttttatatagttattgtttaaagtgaatattttgaaatgtattattaaagaagaatagataagattatgtgatttattatggattattgttatgagaggaaaaatgtgtttagatgattttgttagtattgagataaattaggatatttgaaaggaggtttttgttgaaaaatagaaatatgtatttataatttgtttttttaaaattggaatgtaatgatttttaaatatgtatagatataaatttttttttaatagttaagaaaatgtacgtaggtgataattagattagttttggttatagtataaaggtttaatgttttcgtgattttttttaatttgaaagtattttagagtaattggtgattaatattagtataatagttatttataaaattattatttatttgatatatatttaattaaagtataagatttatttttattattattattatattttaagttttagggtatatgtgtataatgtgtaggttagttatatatgtatatatgtgttatgttggtgcgttgtatttattaattcgttgtttagtattaggtttaaaagattagattgtttcggtattatgttaatatttttttttgttggtattagtattagttttgtttgtgtatttgtttaggagatagttttataagttggtgattgatattttattatgtatgaagttatgcgtggaatttagaatttttagtttgtaaaattgtattatgattatttttagtgggaaattgtttttagaatattgagtaaaggatgatattaaaatggtagttattatttatttttaagtatatgaaatgtttttaggtttaatttaaaattatatatattttaaatgtttattaaaagagtttttttttttttttatttattaattgtaattaaaaaatttcggttttaattgaatatgattttatattatttattaaaatttaaggtaaggtgtattaagtatttttgaattatgaaaagttttatgatgtgggatatttttttagttaacggtagggttggttatatttttaaggggtttaaagtaggaatagttgtaatagtgagttgtatttggaaagtttagtaatttgaaaaattatttgtttatgtattttgtttatttaagtttataaaataatagatatttttatattttaaatgaaattgttttttagtttgttttatttttaaatataattttttgtgatggaatgattagaaatagttggtttttaagaggatagggttatgtgcgtttatttgcggggttggattttttataatttttttggttgtggggaaagttgagggttgttgtttttatataaagatggtttattttaagatatatatattttttttttatattttggagattttgtatatttagtattttttttattataatttgaggttttagagaaaaagatttgtaaattatatttgttttaaaataattttttaaaaaagatatttttagtttttagaaattatgtttaatatatagatgtttagaggtaatttgttgtagtgtaagaggattgtgttaagattagaaaataaatatttgtaatttttgtaattgttttttttaaaatttgaatgtggtgattttaaagtaaagatcgatataaaattttttttttttagtagttaggaaaaggtatgtatgaagtaattagattaggtgtggttttagtataatggtttaatgtttttatgattttttttaattggaaagcgttttagttttattggatattaaggaggaagaagggacggaaaatattaggtttataggtttattttttttagtagtttacgagatttgagtttatatgtagggagtaaaattgtttgtttaaaagtagttaataaatgttttaaaaaggttgggcgtagtgatttatttttgtaattttagtattttgggagtttaagattggtggattatgaggttaggagagtaagattattttggttaatacggtgaaattttatttttatgaaaaatataaaaattagttgggtgtggtagcgcgtgtttaattttagttattggggaagttgaggtaggagaatggtttgaatttaggaggttaagattgtagtgagttaagattgcgttattgtattttagtttggtgatatagcgagatttcgttttaaaaaataaaataaataaaataaaataaaataaaataaaataaaataaaataaaataaaataaaataaaataaaaataaaatgaacgttttaaaaatattttgggtaaattattttgtgttttttttttttatttatttattttttttgagataaaattttgttttgttgtttcggttggagtgtaatggtataattttggtttattgtatttttaattttttgggtttaagtaatttttgagtaattgggattatagggatgtgttataattttcggttaattgttttagttaggatataaatgttgtttatatagagtttgtagttatttttttgattttttttatgtagatttttttataaatttttgatggatttttttattaaattttattgtttgttaaaattttttatttttatatttttagtttaaataatacgttatttataaattttaaaattgtttttgggtaaataaataaggtaaaataggaatatatatttttaggtaatttatttttgttttggttttataaaaaattgtaattaaattgtagaaaatattttaatttttttttaatattttttttttatatattggtttttaatttttaatttttttattgaaatattgattgggaggttaaggtaggcggattaattgaggttaggagtttgagattagtttggttaatatggtgaaattttgtttttattaaaaatataaaagattagttgggtatggtggtatgtatttgtagttttagttattttggtggttgaggtacgagaatcgttttaattcgggaggtagaagttatagtgtgttaagattaagttattgaattttagtttgggcgatagagtgagattttattataaaaaaataaaaataaaaattgaaatttgtagtttttttaaaattttatagtttttttataaatttaaaagtattattaaatttggcgaggtgttaaaagaattagaggaatgtttataaatatagatgtttgggtttattttagatatatatatatatatatatatatatatatatattttttttttttttttttttttgagacgatgttttgttttgttatttaggttggagtgtagtggtatgattttagtttattgtaagtttcgtttttcgggtttacgttatttttttgttttagttttttaagtagttgggattataggcgttcgttattacggttggttaattttttttattttttagtagagatagggtgttatcgtgttagttaggatggttttaattttttgattttgtgattcgttcgtttcggttttttaaagtgttgggattataggcgtgagttattgtattcggtttagatatattaaattagaatatttagaggtggagtttgagtatttgtattttttagagttttaaatgatcgttttttaaatgattatattgtgaagttagatttagaaatgattgtatttaaggttggttaaaagatatatattttggttgattttatttgaagagagtaaataagatatatagtaaagttgtagatgttttttttgttagtagaatatttgcgggttaggttatttaaaattttgttagagagttttgaaatattgtggagggtttttaaattaatttgtttaatggttttttatttttttaggttatttgggtttaaagttaattgtaagtttagagttttagagtgatttaggaatggggtgattatatattttaggttgttttatatagattagttagtattatttagtcgtaagtaatagtatttaggtatgtttagaagtgttttatttggaggaaaaaaataatattgttataaatgaattggtaatggtttgtttttgatttttatatttggaatatattggaagtttttatttatgttattttttagtagaataggtaaaatttttatattttaggtatgttaggtttttttttgatttttttttttaatgttattcgtttgttgttttttattatagttattaaattgtattttaatttaaagaggattttttatgttttaatttatttattttttagatttttttttttttgaaatatagggttaatgagattgatatttttttattatatatttttttagttatttagtaaaagatgtaaatgtttaaaatagtttaaattattttttagttagtttaggaaatataaaatggtatgtttgtatataaattattgtttagggtgggggaagtgtttttaattttgttttaaaggaaatttgtatgatttataggttatgtaattattaagggaattagttggtagaatagaattatatttgtatagaatataaattttttgttttttatgggaattatgttgatgttttagatatgaaatatattttgttttttttattgaatttcgagaagatgttttttgttggttattattttatggtaggggaagtatatatttttaaagatataatcgagtttttttttaattattattagttgggttggttattaagaattagacgtttttatttttaaagagatttaagttttgatgttgtatatatgtgtttaatattttattttatagtaatttaaaggtgacgttttaaaaagttgtatttagtgtataaattttttttgattttagtaaggatgttgtgatgattttatttaaaaaggtaagttgtgtttagatatggtagtgggttattttatgtatggtgtagatgttaaatataattatatttttttatttgtaatgattaaaaaaagaagttgagtttaagtagtgagaaagtaggagattgggaggataagaagtaaaggaaaaaagtaatatgagtatcgttttttttgttttgttatttgttttattatggattgggttgcgatattttatattttagttttataatttttaataattatttatgtgtatggtgtttttatgtgtgatgatttaattaggtttaggtgtggattgagtagttaaattataatttttgtttttgaagagtttagggtttagtggggaaatagatatgtaaataaatttgagtgaggttatgtaattaaaggataggttatagttaattataaagaagagagtttttagtagtttttaaagtcgaatatatgtttattaggaatagggttttagtagagggagtaataggagtaattagagttttgaggggtcgtggtttgttttgggtattagtagtggattaatgtggttagagttagggatattagtagaagttagagtagtagggttttttttgtttagtaaaggtatttgtttttttgtaggttatagcgatttatagagggttttttaggttagaaaaaagttattaaggtcgggcgcggtggtttacgtttgtaattttagtattttgggaggtcgaggcgggtggattacgaggttaggagatcgagattattttggttaataaggtgaaatttcgtttttattaaaaatataaaaaattagtcgggcgcggtggcgggcgtttgtagttttagttattcgggaggttgaggtaggagaatggcgtgaatttaggaagcggagtttgtagtgagtcgagattgcgttattgtagttcgtagttcggtttgggtaatagagcgagatttcgttttaaaaaaaaaaaaaaaaaaaaaaagttattaaaaagggagttatgttttttgttggttattattttatggtaggggaattatatatttttaaagatataattatttttttttaatttttattagttgtgttggtaattaaaaaattaaaagtttttatttttaagaagatttaaataatttttgagggtgtatatatgtgtttaatattttgttttatagtaatttaaaagtgaagttttgaaaagttgtattttgcgtttgttagaattatgtttgatgagatattttttttaaagggttttcggtgtaatggggtaaattaagggggtttgtgtaagtgggagtgagataggagatggggtgttttttttagtattttttataggttgattgagtgataaagattattttattgatatttttaatggttttatgagatgggtattattattattattattattatattttttttgtagataaggaaatttaggtttagtagattgttagaataatataggtaggaagtggtagagttagggtttgaatttaggtagtgaaattttaaagttcggatttttaattattgttttttagtgtttttttgtaataagttatgattttagaagttattggtgtggttataatatggaaagagatgatagtgtttttatattgggtgagtagtttatggtgattttagatatgatttttgttgggagtgataggtttgagtttttaggattagattttagattttggtaagtggtttgaggaaagagaaggattaatgtaaaattttaggttttaaggaatgtggatgttgggtagggaggattaagttttaaagattagaaatggggtatatagggtaggtgtggttagagtagaattagagtagaatttttagtgattagaaatagaattagatacgttgtagtggtggataaggtagaatcgtttaagtttttaaagtgtttttgattatttaagttggttagagattttggggtggggttgattttgtttggatatacggggaggggtaagtatgaggaaaggaagtaggttttgataggtattttgtattaaatagttttttataaggtttttaatttgtttgtttaatttttatagatatttgtgggattatattagtatattgtaaaagtaggaaataattgagaaaaatttgagttttatgttggtaggagaaatgtttatggaatatggtaaatcgtttttttgagattttttttttagtaattatatatttgtttttaaaaataaatgttagaaggaagaagtagatttaatagtgtattttataaggtattattaatttttaagaagaataattaaaatgttttagtaattatggtttattgtatattttttttatttttttagaagtaatatatggttggaaatgggtatattaaaatatgttaaggaagtggaattgcgtttattagattttattattaattattttagttagttttatagattttttttttttgtttgtttttgagagcgaggttttttagtaggaagagaaattgtttaaaacgattaataattataaatttattaaattattttgggtaagtttttttatttttttaggtttaaagttaggaataagagttatttttatataatgtattgttttagaaagggtattatattagtttgtttttacgttgttgataaagatatattcgggattgggtgatgtatttaaaaaaagaggtttaatggatttatagttttatatgtttggggaggttttataattatggaggaaggtgaaaggtatattttatatggtggtagataagatagaattgagagttaattaaaaggggaaattttttataaaagtattagatttcgtgggatttattattattataagaatagtatgggggaatcgttattatgatttaattattttttataaaatgggaaaattatgggaattataatttaagatgagatttgggtggggatatagttaaattatattaggtatttaattaatatttgggaagtattagttttgtattaggtacggagtacgttatgagttttgtcgtattatagtttgtttgatagattttagttattttttggagtttgtttttgatatttggatttttttagaattagtattttttttttttgttttcgttattttttgtttttatttttgttgtggtatttattaaagttttttaattattttgcgttattgttttttagtgtttttttttttttttttttttttttattttattttgtgtttgtattttttaagtagagtaatggtatttttatttttgtggttgtttagtgttttatgtagagttagatattagaaaatagatgttgaatttagttgatattttgaaattttttttaaagtaagttaatgtgtgttttgaatgaaaagatattgggattatattattgagtgtttttttttttttgttatttttgtttttattggttatatttgaaaattttgttggaaaaaaaaatttaagaatttaataaataaatttaaaaatatttagtttatttatttaggtgaagagaaaatttattttaatatgtgtgtatatttaaaatatttgttatttagattttttttttaagtttttaggttgaggaggatataaatatatttttttaaattttttagtaagtaagttgtggtatttagatgattttttgggttatgggggataaggttaattttttaggtgtttggtagataggataggtaaatttttagaatgttaaaatatattatttgttgttgtttggtattgtttttaagtttagagtgtggaggttgggggtgggtttttggttataggagaagttttttggtaagggaggggtgaaaggagtgtttgttgaattttttatttattttcgtattatggtaagattgagaggaatgattagattagggaatggttcgaaagaaaaatttaaaattttttaattttggataaggttatagttttgagaaatcgaagtttttgtttttttttttttggttttattgtttttagatgtaaatatatagagttttgagattttgtgtgttgggaggtgataattgttaattttttattttaatagtatagaaatttttttttgttttagaagtggttttttatagattttagatttttttttaggaaaaagaaaaataataataataataatatattaatgattttgaaagagttagatattattaattttattattggtgtttgtgttaagtgaaatgaacgttagttttttttttagatatgttttttttttttgttttttataataagagatgattttattgtaataatataagatttattaatttgattttaaatagtttttttattaataggttaagtgtaaaatattaggattattatttagttgagaatagatagaattaggaagtagttattaaaaaagaatgatgaggtgtattgtggatttggggtgtaatttggtatttaatatatagttagaattatagttatagtatatttaatattttattagaaatttgcgtgaataagttaagaggatttttaatttaaaaatgatattaattgtaatgattttgttaatatttgtgatgaaaataatagtaaagtgatttagataaattataatagtttataaaaataagataaagtttaatataaagtaagatgatgttaaaagatttgaaataaaatagatatgttaagtaggtaatatataggtaagtatataaaaataagaagatattaggatagagttgttatttttgtgggagtttgtgatgtggaaaattaagatgtttggtgagtataatggatatggaaattttttttgtaataattttatagttttaaggggttaaggtttttaggttgagttattattgtaaatatatttatagatgaatttatatgttatatttttttgagtaagtggggatttaaattaggtttgttaattgttttagaaaattaagtatttaaataatttaatgataatttaaaagaagtataatgaaatattttaaggaatgttatatataagattttgtattttttttgttttggttagatttatttagaataggtttttgttttgattttaagagggaggtagagattttggagaagttttagggaagagtaaaaggaaaggaataaggagttaagaggaaatttagggtaaggttgaggagggattgtttcgtgtaggtgatttattggaagggttggaaggaaatatggaatgataattatttttggttattgttaggttagtatgagatttataagaaaagtattgtttagacgtaattattatttaagataagaaataataggaaaggttagtatatttagttttttatttaaaaaagtgttaggtaggttgagtacggtggtttatttttgtaattttagtattttgggaggttaaggtggatagatgatttgagtttagaagtttgagattagtttggataatatggtgaaattttatgtttataaaaaaatataaaaattagttaggtatgatggtatgtatttgtagttttagttatttggggggttaagaggtgggaagattgtttgagtttaggaagtcgaggttgtagtgagttatgattgtgttattgtatgatagtttgggtaatcgagtgagagtttgttttaaaaaaaaaaaaaaaaaaagtgttaggtgatatgagagaagattttttaagtaataagagtggttaattttaggaatgtgttattagaggttattttgtaatagtcgtgtgttaaattttttatttgtttatataattttttaaatttttttgtttttatagttatagtttaattggcgtataatagtttttatatatagttttataattaaatatagatatatatatgaatatttttttttatgttagtaggatatttggtttgtttaggggtaaagaggaattgatgtggcgttgttttaattagtggttgaaaatgtaagtggtaaatattgaaaaatagaatattgtaaaaggtatgtattgtatatattaaaaggttagtatgaagtattatttgtatggtaagtttgtttatttatttttttttatacgttgtatatttatatagttttgtagtttgtataaatttttattgtgatagaaatttatgaaagagtgtggtttttgcgaaagttggttgttttgtgaatttagattagtggttttttattttggttgtaaattatttggggaatatttaaaaatattgttttaaatattttaattttagaaattttgatttaattggtttgtggtggggtttagaattttgtattttttttttaaggtttttaggtgttgttaatgtatagttaaaattgggtttggtttagatttttagaattttttaataattaaatattttattatgataagatttttaggattttaaaggttatagtggggtagttattattttattaggtttttatttggggaggtttttggtatttttattggaatatatttgttatttaaatttttattataaaaaatttttttttgtatattgttttagtaattatatgagatatattttgtatatagtataaattttatattatttatgtaatttagttttgtggttttttttttttttttgtttgtttatttttaattttttttaagaggaagtttagttagttagaatattagagtattatttttttttttttttttttatttgagtttatggtttagatatattaggaatgaagttgataatatgtattagtttttttcgaaattatgtagtaaaatttttaaagtgcgagtggttatagagatttttatagggtttagggataggtagatattattttttttttagtttttggtatagaaaagagattttaggttattgagaagatattagtttttttttagagtagataaggaaattgagttttagaatgaaagattgaattttagtttttttttgaatatggatttttagggttatattgggttttggaaaaggtatttatattttggattgtagtttttttatttataaaattaagaggtagaaatagataatttttaagttgtttttatttataaaatttcgagattttagttgattagtatttatataagagttgaagtttgtaagagtgtagaaagtttatataaagagatagtggaagattttttattagtagtatttttattattttttttttaggttttattagttaatatttttattgttaatatatagatcgtggtatttaattaaattatttttgaaatattgagttattaatagatggtatgttgaatgtaaaaggattataaataaatatttggtattgaagaagattaagagttggagtttattttttattttgatttgggtttagaattttgtggttttttttttaattatttttgttattaaattggttgtatttgttttaagatggattagaaaattagttttaaagttggttataaatttttaggtttgggttttgttttgtttttttgttttgttttgttttgtttttgtaattagttaatttattttagtttatatgatagagaagtgtataattatttgtaattttagttagagtagtggttttaagaaggtttagttaaataaaaagtgtttagattttttgagtgttgatagttgttaaatttatttagtttatatggttttatttttatcgtttgttttgttttgtttttgttttttaatagtttatttgtgagtaataggattagatgattaagagttatagggtagaaatattgttatttagagttaaatttttttattatttagttgtaaagagtttgtttttttttgatttatataaagtttattatttaggtttttgtatgattttaattttattatttaatattttagttatatgattttgaaggtaaatatgaaggcgtttgaattttagattatttaaatatttttaaggaaattattatttttacgggtagagttatgttaaaatttgtaggttttaatttaaattttatgataagtaaaaattgaattaatttgttttttattttgtttatttttttgttaaaattatgtttggattagaataaataaatttaattaatgaatgtaattattaatttttacgttagataataatatatttagaatttttttttttttgggagattttattaggttagtgtttttgtaaataggagaaagagaaaaatataatttagtaaatagtagtatttattaatttatttatttatttaataaatattaatttattatttattatattttagggagtttagagtttagtattagaaataataattatatatatatatatatatatattatattaaataaggatgtgataggttagatgaaataaataaataaataaaaggtttaggtgagaaaagaaggtgggggttagaaagaagttattgaagaaaaaatatttaggttaaaatattatgaataatttagagtgagttaagtgtagagtgttgaaggagtgttttaggtaaaattaatagtaaatggggagtttttgatgtagaaaagggtttgaggaattgttttgggagaaatatttaagattttagtttgaattttagaggttagtgatttagagaggtaagtacgaaaatgatttttttttttattttaaaagtaagtgtattatagaaggaaattatttttttttggtaataatttttgagtgagtttgagaagttagaggttatttttattttataggtattgttttttttttagttatttatggttagtttattgattttgttttggtcgtttttttattttatttattttatttttaaaacgtagacgttttataaatattgtataaatgaatgaatttataaagttatagtatagtaaggtaaaagtgtttgtaataaataagtattttaggttagaaatattttttaattttaaattgtgttttattatattgtatttcgattttttagagtggtagtttttagttaagggaaagtttttttttttttttaggggatatttggtattgtttggagatagttttagttgttacgatttgggggatgtttttggtttaatttgggtagagaagcggggatgtttataattattttatagtgtataggatagtatttttatttatattttagtaatgaagaattattagatttaaaatgttaatggtgtttaggtagaaaaattttgttgtagaggttggggattgcgttttgatagttatattatatagtgtattaaataattttgtataatgggttgtaattatttttgtttagattttgtaagaattttagtgtgtatttttttttttatttgttaagtaatgtttaaatttgtagagatttattttatttattttttgtgtgtttagtaaatagattagaagtattggaggaaaaaatattttagtaatgaggtaagacgaaagttattagtaattttagtttaatttagttgaatagtaggaaataatttttatcgtgaggaagtgtattgtagaaattgaaaagacgttaatgatgtttaaaaagttgtagtttaaataaatgtgtatgtagattaatgggtagattgaaaatgatgaagatattttcgttttttgtgtttttgatagaaaagaaagagtttttattttttttagtgtggtaattatttagatttgttttatgatatgtttagaaggttgaagaataataaatttttaagtgtaaatatagaatttagcgaagaatttaggtttttggatgaatttttgtaattgtatgtttggataaaataagatttttatatattaaataaggtaggatttttttatttgggacggaatttttaatatttggaggggttgtagttatttttttttaaagatggtaaatatgagtgtttcgagttattttttttttttgtttaagttcgttaattaattatttagtatttatgttatcgttggtttttttgtggtttatttttatattgtttattgtttagtgttatttgtttggtaatatttaatattaatatgtgttattaaattgatattagaggataaaaaagaattaagatatgtatagtttgttttgtattgagttagttgttattagatgttttttgtgataatgaatacgtgaggttatgtggacgcgagagatggtttcgggtttttttagacggtttatagttagttggtttgtagtgcggttttagatttcgatgtgggaattttataaaaaagaatatgtaggttaggcgtggtggtttatgtttgtaattttagtaatttgggagtttgaggcgggtggattatttgaggttaggagttcgagattagtttcgttaatatggtgaaattttgtttttattaaaaataaaaaaaaaaaaaattagttaggtgtggtggcggatgtttgtaattttagttatttgggaggttgaggtaggagaatcgtttgaatttgggaggtagaggttgtagtgagtaaagatcgtattattgtattttagattgggtaataagaatgagattttgttataaaaaaaaaaaaaaaaagtttgtaggttgtataaagaggtatgaaaatgttttagaaattttaaattttatttttgaggtttattttggtgagggaatgtgtgtgtattttttagggtttttttaaaaaagtattataagttggatggtttaaagttatagaaattttttggggataaattttatgattttggaagttagaggtttaaaattaaggtgttagtaaggttatgttttttttgaagtttatagggaaggttttttttgttttttttagtttttggtggtttgttggtaatgtttggtattttgtggattgtagttatataattttattttgtttttattattaatggttttttgtttgagtgtttttatatgattatttttatataaggatattagttatatttgatgagggttttattttattttagtatgattttatttttattaattatatttgtaatgattttatatttaaataaagttatattttgagtgtttggggattagaattttaatagagtttgttgaagggggtataatttaatgtataataggatggaaattagaaacgggtatgtttttattagtgtagaaagatttagtttaattttttaaagtgtaataaaaattttaggaaaatttatatttttttttaagaagagtaaaagatggagaaattcgatggttatttttaaataaaaggaaaggaggaataagatgaaaaggaattaatttaaagtaaagagagtggtttatatggaatgttggtgtaattttttttgatatatttgtgtatttattagttggggtattatttttttggggtatatttggttattgtgtgttttatggtaataaattttagaagttttattgatttgttagagatgagtttattttttttgtttgtttaatggtaaaatataaaataagtagttattgatatggaacgattttaggaatgttaaaaggttttttttttttaaaatattttttttatttttttaatattgttattgatattattaatatttttttattttcggttgagatatttgggttagagtttttgatgtggtaggtagtgttttaaacgttttgtataaattaattgatgtttagagtaataattttaagatataggtattattatatcgtattttatagataagaaatttaggtataaagaggtttagtagtttagatgagataattttgatgagtagagattcgaatttagtttttatgttattaattaggatattatattgttttttatatatgttttttaaaggtaatatagtaatcgattattatatttatttatatttgattgttatattttttagatttgtttttttagtagagaatgaagtttaaggtatttttgttttttaaagtgttttttttagattagttgtattaaaatgaggggatgaggtgtaaatgtttggattttgtttttggagtattgatttataattttaagttttaagaatttgtattttaataagtatttttagaaattttttaagtatattaatgtatgggaattattgatattaaagaaatggaataaggggaacgtataatgttatagtaaattaggaaaagttagaaagatatgataatatagtgaggattttggtagttaatggttagttaaatgtttaggggttttggttagaagagagttaggttgttgaggagtaagagtgatgttgaatgtggaggtttgagagtagaaggaagttagttagttatatttttttgtttggattatatattttttttttggtggaaatggttatttgtagagttagagaaggtatgttttatagtttggatggtaggtatggatgtagataataaagagtaattagagtttatgggtttagaaatttttatgtgtttttgtttgaatgagacgtttgtataaatagtataaggagtttggggtggggttaaagagaatggtgtggtatagggagagttgaatgaggaattgagagagtaaaattttgtgtttggtttaattattgattataatttttttgaggttcggttttttaatttgtaaaatggggggaaataatatttgttttgtaggtttttatatatagggtatgatgtgaatttattgaggtatatagtattgtgtaatatgagttattgttattttaaggttcgtaaaaggtttttgttttggaatatatttgttatattaatgtttgtagtttattaatgatatataaaggatattggagataacgatgttttttgttttatgtattttttttatttatgttagaaaagaaaatatagttatttgaagttattttaaagagtatgtttgtttttttttttgtatagatatatatatatagatacgtatatatatagattatgtatatatatatatatgggaaaatatgaggaaaagtggagataagaggtattaaaggataaagttatttttgtcgtttgttttttttttagtagggttgggtttgggttgttttttttgttttttttttgaagttttttttttattatattttagtgcgtgtttattattttggggttaggtttatataattgtagtgatttaggttacgggagaaaatttaaataagtataaaatatgttttaatttatattttttaaattgtttttttttaaaggtgaagatttttgagtttgaattatttttttgttagtgggttttttatgttgtttaagtgatttaagtgataattaatttttattttattttgagaatggttgtggtattttagagttatggtgaataagaaaattatttaaaataaaatgatttttatttatttattgtttttatttattttattttaaatgaattttaaattatttaaaataaaataatgggataaaagaggatgttaaaaataataaatatatatgtattaaagtgtgtttgtaatattaggtaaagaattaataagagataatattatggttggtgaaatgttatgtatggttatatttttttaatgagtatttatagtttttttaaaatatgtttattgaagaaatatttatatgttaattaatatgtgtatagtattattaggtattatagaggatattagatgtttgtagtagatatagattttgttttaagttttggttttgatgtagttattttttagttattataggtgattatatttagttattataagtgatttttttttaatggggaaataaaggattttataaaagacgtagaagataatttttaatataaaagtgatttagatttttataagtttgtgaagagaagtagatgagtgaaatagaatattattaatgtaaaatattattttgaggtttttgtaatgattgggaagtaataagagggaggttattttagagagagaggttttaggttttaagttggatgtttaggttagtgattgtaggttttttttatatttattattttatattttaattttttttagttgtttataaaggtagataaatatttatatttttgtttttttttattttgaaattttggaaatttttgttttcgttaggggaggttatttagtatttgttattttaagggaattaacgtcgaagtttaagaataagagttaatatttttattagaggtttatattttttttaggggtttaggtggatatttttgggaattttcgttaatataggtatttatagtataatttaggttttttgtttttagtaggggttgtaagagtattgtagttttttttttagaggtgttagtttggtttagtaaagattgtttttgagaaaatatatgggtaattagagtaaagtttttatgttttggtaatatttaattgtgttattttttaattttttttgtatttatatatttatatataatatttattttattgattttaaaggaagtttaacgtgttaaaaatatgtgtgggaataaagaagggagtttgaaattggtttaaattttgtataattgggtttgatacgtatattaggattttataagtatgtatttaatttttttttaaaaaaagcgtttatatagggtttagaataatgataataaattaatatttttattgtttatttgtgtgtttttatagtaaataatgtttatttatttttaattagtaatatatatttatgggtttaaattagtaaaagttttttaaaaagtagttttatttatttatttattagtgtttagatgttatttagtatatgaggagtttttagaaaggagtagggaataaattagggttgttaggagtggaggagaaagaatggtatatgtaaaaaggagttgtaattaaatttaagggaatatggtatattttagttttttgtacgagataaagggtaattttggtaaaaatatagatttttaggttttattttaaagagtttgatttgattttgaaatggggtcggagaatttgtattttaataagtatttttattaggtgatttttttgttgagaatttttgagaaatgagaattttgtgttagtgttgaatggagtattatattttagagttgaagtttggtgattagttttttagatggagttggtttttggtgtatatttgggtataaatttaagttaatttaggtatatgagttgatattttaatcgaaatattatttatagtttaaattttttttaatattttgtttggtatgaattttagaaagttgtaaatgttatattttttttttatttatttttggattttgttttaagattaaattttagggtatttgatagatatttattgtatatatttttttgtaaatatgaaaattgaattgtttaatagaaaagggtaaggaagtagaaaataagaaattattattagaagtggtttgttttggaattatattgtttagttgtataataaattatttttaaaattgagtcgtttagaataataaatattgattttttatagtttttgtgtgttaggaattaaagtgatttaatttaatggttttgtttagggtttttcgggggttgtaatttaggttttaggttgggatttttttaaggttgagttggggaaagatttatgtttaagtttatttatatggtcgatggcgggatttagttttttttaggttgttagattgagggttttcgtgttttagtggttttagttagagtttttttttagtttttttttatatgggtttttttatagggtaatttataatatggtagttggtttttagtagagtaagcgagtgagagaataagaaaggtaagtaaggtgaatgttttagttttttgtaattttattttagaagtgttaatttattatttttgttatgttttattatttagaagtaaattattaagtttagtttataattagagggatggtattatataagggaatgaatattagtagatagggttattgaaagttattttagatgttgtttatcgtatttaagtgtgatttttttagatgaaaagaatatattaatttgttttagttttagtcgatgtgttattttatttgtgttttgttaaaatttgtattaatgtaaagtaaatattttttgatataatttaggtagtgtattgtggtaatagagattagtagtgttgaaaagatatgttgaggttagaaattaagtttatgtttttaaaagaggagatatgtataattattatgtaagttaataggaaagagtgttttaagaatgttttttgttataggtaattaaaaatttaaatagttgtggttttaaaataaaggtatatttaagttatataagtaaaagtttaggggtgggtagttgttggtattgttttagtagtttgataatggtaaaagtagtattttttttatttttttggttttttaattatgtatgttattttataattataatataggtaatattttatattttaagtaagatgaaaagggtaaagagttatgttatatgtttttgtttttttttataaggaagataaagtttttttggaagttttttttagtagattttatttagattttattggttagaattgagttatatgtttgttttaaattaattatttattaagaagattaatattattatggtaagtttaaattaattgtgatttatttttgaaattaaaggattattattattattcgaatttattaggattttgttggtagagaagtgggattgtaaattttgagtaggtaataaataagttttttgtaaattttttatgtgttgttttttatgtgttttatatatttagtagaattataatttttaataatagtttaaaaagatattttttaatagaaatagaatgtgtaagattattatttatgaaattttaaatgtatttaaggttttttttttgaaaattttttatttaaaataaaatgtttagattttgaaatttagaaaagattttatattttaaaaattttgtgtatatgtaaattgttttttaaatattgtttttagatatattgaatagaatgaaattttttgagatttattatattagttaagtattattaaaataaataggatagattgttttttttgacgtttgttgtttgatttgtgttaatttatgtttttgaaattgtagtattataagttaatgttgtataaaggtattttatgttatttataaaaatttagtaatgtaaattgttaattttttataaagtatttgttgatatataaaaatattattgaagtgtatttatgttttttttttttaggtttgtataatatttttttttagaaggttaagttgttttataaattatagaatagaaagttggttgtgggaggaatagtttaattttatttgaggtattttattttaagaaattaatggtatttatattttttgggtattgagtttttaagtttatttttaatttttgttttgtttatattttaagtgagtatataaagtgttgttttaagtaagattagtttttgtagaagggtaagtgtagttagttttttaggaaacgggattggggagtgatcgttttaatgagagataaattaaattgatgttaaatatgaataatgagtttattagagattgtgagaaagaggtattattatttatttaataataggtttgtgggattttttgatagtttgaggatgtttaattttaggtgtaggtatttagaatgtagtagttagattgattaaggatgtgtgatgatagtaagtagtagtggaagagtttaggagagtttttaagtttgaattgtaattttgtgttgttataaaatgggaagatatatttggtttagttatttgatagttttggttattaatttttttattttatatgtgattttattgttttaagaatttttttagttttaaatatttatgaatttgttgaagtagttgtgttttgattgatgtggatttttgaatttttttaaatataaagattaattatttagtcgagttttgttggatttagtgtattttgaatatatgttaaaatatatttggatttgtaaaaaatatttttttttgttttttttattatagatagatgtataaaaatgttcgtgtttatatcgtggaaaggatattttttataaatttatatagagatattttttaagttaatgttttagaaagtaatgagagatttaaaggagatttagagatatgaatggagtaggtagagaaggtatgtgaggagaatgatgtaattttttagggaaaaagtatgaagtataaggttggatatagatttgggaattaggaaattagagttttaattgtagtttttttattgatttatttgggattttgagaatatttgttttattttaattattttgggttatagtttttatatttgttaattagagtaagagtttttggttgggtgtttaggattgtgagaatatattatttagagttataaaaatgtaattagtattaataatgtattagtattagtatttaggatgtaaaatattttagatattaggtgttttaatttaaagtggaaatattaataagagtaattttttgaattattaaattgggaatattttaggaagtatatttatttgggtgaaaattaagtaaataagataattgtaaaggtttgtgattttaggaatataaaggtaaaaatgcgtagatttgaaatatgataagttttagttttgttatttagtatttttgtgattttggataattttttaattttcggtagtatttttatttgtaaaatgggaataatgatatgtattttagtggtttgtggtgaagattattataaatagaaattagtttttttgagttattggtggggtttaaatttttagtttttatgtgttttgtagttgttagttttttttattataattgtttatttaaaaatttagttatagttcggtgtagtagtttacgtttgtaattttaatattttgggaggttaaggtaggagaattgtttgagtttaggcgtttaatattagtttaggtaatatagtgagatttttttatttttataaaaagtaaaaaattagttagtgatgtatggttgtagttttagttattttgagggttgaagttggaggattgtttgagtttaggaggttaaggttgtagtgggtagtgattatgtcgttgtattttagtttggatgatagagtaagaatttgtttttaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagatttagttattaaaagtaagagattttttaaatgttattattttttgggtatttattaattatattgttatgttttgtatttaagttaagtaatttaaataaattattttatgtatttttttaaaattaattattgttgtgtaaatggaggtagaaagaaattaagttttatttttgtttttattgtttttttaatttgttttgtttttttttttagttgtatttaattggttgtatttttagttttttttaaaattgttttaaattttaaagattaaagtagtaataattaattgaatatatttatataatatgttatttttgttatgttgttttttatttttggagatttgttttaaatttatttggacgtttgaggataaattatgtttattagtagtttttgaaaatgtagttttattgaaaatgtaggtatttagaaatttagtaagtaatttaaaagaaagtgtaagaattttttatgtatttattgaaaaataatttgaatttatgtttagaaaaatagaattattattaagaaattttatatatttatgtttttaaatatttttattaaggattaattgtgtatatggtgtaatattgtttttaaagaatatgtcgggagaattgttgtagttattagagggttaaatttggtaaatttttttttattaacgtgttttttaattatgaaatagtatatttattttagataaaatttgaaaattatttttgtaaagtggtataatattgaagaaagttgataatttttagattagatttaagttttaaatttattttttttttatttggataatttattagtatttttgaattttatattttttttataaagtgagaatattatattatagagttgttgttagttaaatgagaatagtgtttgattataattagttaataaatgtttataatttttttttttttaggaaaagaattttaaggtagatttgtttcgggtttgttttgtaaagaggtaggaattttttgttttcggtaaattgttttttaattttttttggtaatagattattttttaataaaggtgatggattattttttattatatatttaaaatgtgtgtttattttagggtagttatggatgattattgtttattttttgattttagattaagaatatttgttgtagtattttaattttgtttttaaatttttttataaaataaagatatttttaaaaaataaaattttttaggtgttttgtagttgaatgtaggaaaattagagttttttatttttgatagttttgggaagaatgtagtgttagaatataaatttataatagataaataatttgtatagaaattttataaaagtattgatttgatttgttatgtatttgttattttttaaaatatataattaaatgtttattttgtgtttagatttaaatgggtgaagaaaaatgagtgataatatatttatttaagtttatttatataattgtggttatgtcgttttttttatattatattattagaatattggataataagttaagaaatagaatgttttataaaataaattttaaaaattggtaagtattatgtgttttttttagaagatattttattttgttgaattaaaggtggttttttggtattgagtagtttcgtggagttatggtagtttttattttttaattttgagtttgtttgagtcgttgttgttagttatttatttgttgggattttaaattgtattaaatttttttttatagttgttattgttaagtagttgtattggttttgttttatttttttgttggtaattttgtttttaattttgtgttttagtgtagtttatataaatttttatagagggataaaattttttgtaattaattgtttgggtgaatatgtatttgggagagttattgggaaaggggttaaatttgtattttagttttttttatttttatttttgagttaattaagttttgtggattttttttttagtatttttggaatttttttttttttttttttttttatgattatttttttagttttggttttttaaatttgagtgatagtaatagtttttttgttttgagtttttttttttttttttttagtgtgtatacggttgttaaatttattttgataaattattgtatcgattgtggttatatttttttgtttttatattttttatagattttattgtttgtaaaataatatttagtttggttttaatttgtttttttagtttcggtgatataggtttattttgtttgagatatttattatgatatttttgtttgtttttggggttttgatatatttttaacgttttattgttttttttttttaaattagttaattgtttaagttttgtttaaattttttattttatgaagtttttttgatgttttttagtatattatgatttaattttttgaagtaattatgttaattgggtatttgaagaattgttaatcgattattaattaattgttttttaatattgtatgtgtagttgtttttaaaggtagttaaattatgttatgttttttatattgtattgagtgtttcgtatttttatttatgtttgggggttttattttaagttaagaaatttaattatatttatttggttttttttagagttgtagtttttaattttttgtgtggtagagaaatatttagagaatatgtttaaaaatattttgggttttatttttgagagataataaggtttaaggggaatttaaatatttgtgttttaggttagtttattggtttattttattatattaattttttagaaggttaaggtgggtggattttttgattttaggcgtttaagattagtttgggtaatatcgtgagattttattttttaaaaaaaaaaaaaaaaaggattagttaagtgtggtggtatgaatttgtggttttagttatttaagaggttgaggtagatagattgtttgagtttgggaagtcgaagttgtagtgagttatgattatgttattgtattttagtttgggtgatagagtaagattttgttttaaaaaaataaaaatgaaaaaaatttgtgtttttaagttttaagtgatgttgatgttgttggttgtttttaagtattttataaagaacgaatttataaatgttaatatagtatatgtttatggatattgaatagtgggttttttttttttttttttttattttgtgtttatgttgtgttattttttttttttagattgattttgaagatgtgattgtagaattagaagggatatatagttttgacggtatttggaaggttagttttattatttttattgtgacgaaatattggttttatcgtttgttgtttgttttttttggtatttcgatggtatttatttggggtatttatttcgttatttttttttttttgtatatttgggtagttgtattatgtattaagagttttttgattgagatttagtgtattagtcgtgtttattttatttacgtttatatcgtttgtgatttattttttgaagttgttgggaaaatatttagtaatgttcgtattaatttgtagaaagaaatataaatgatattttaaggatagaagtatatttgattttttttttttttaatttttttggtgttaattttaagttttaagttgttaatatagtaataatttatgaattgaattattttggttgaaaataaaaagattatttttttagtttttataagtattatgttttttttgagttattttatttatttttggtagtttgaatttttaaaatttatttaaatttttttttttatttttttatttgtatgtggattaattatcgttttattggttgagatatgaatatattgttgaaaggtaatttgagagaaatatgaagaattgaggaggaaaaaaaaaaaaaagaaaagaattaataattttaattgtttattttaaaatgttggttattttatgttaagggaagaattttagggtatggttatggagtgtataagtatgtgggtagatttttagtaaattttttttttattgtttaaggagttagtggattattgttatttattttataatttagtaggatttagtgatttttataagttagaaaatataattttttgtttttttatgatttaattaatgttttattttttttgaaattttaatttatgatattttttgtgtttgaatatttgttatgtagataataagattttagtgtttttttgttttttatatttttttttttaaatagggtttaatttagtaattcgttttaggttagtagtttttttgaagattaaaattagaatatttatgatttagttttttatgcgtgtttttgattttgagttatagagtttggtgaagtttatttttgggttttatttggtaatatttttattcgtagtgggtatggttgatattagtttaatgaaatgaattaaagtggattaatagggttgagttttttgtgggttggtagttttggaagttagttttttttgttttttattaattgaatgaggttagtatgtttatttagtttcgtttatttttaagaataattacgtttttttgaatttaaattaatttattatcggggtggtttagtggtttaatattgtgtttttattttagttgattagtgggtttttaaggaggggttgtaaaatggaggttattgtgtgagtttattagagttgttgtaaatttgatttttgtttagtaaagtatttgtaatcgtttgttatgttgtgatatatggtttttttttttgttaggagttttggatttaatttaagtatttttttgtttagaaagaagatgggggaggaggtagtaataaaaagattgaagtattttgttggaataagtttaaatttttttgaatttaaattgaggaattttatttgtaaatttgagtcgtatagaaagttgtttggtatatttaaaagttttttattttttttgtttatattgtgattttgtttttggggattttttttaaatttttagttatgattttttttttatatatttattggaattttgtttgatttttgttttttttagtttttttgatattttaattattaatttgttatttattttgattttttgtatttaaaatagatattggtatggatatagttttatttttaaattgtgtatataattgaaaatgtgttatattgtatattttttaaatgtaaagatatttttatttttatatgaagaaaattatttaggaaatggttttgtgatttaatttgtaaattgtgtattttaagatatgtttgttttatatagatgtttagttttttatgtaaattaattattggtttaaaagattgttgaaattttatatgtttattgatatattttataattttttattatgtatgttttgtaaaggttataagtttgtataataaaaatgtttaacggttaaatagttagttttattatttttttttaaaataggtgtttatgtgttagagtttgtgtatgtttatgtatttgtatgtaatgagtatgtgtatagtgtgtgtatgtgtttgtatgtgtttgtggggggtaatggttttttattttaaaattattataaagttatttaggatatttttgttaaggttattattatttatga

SEQ ID NO: 29 - DNA, 38092 bp, Homo sapiens
taaattttttaatttttattttaggtttaagagtatatgtgtaggtttgttaaattttgtgttatagggatttgttgtatagattattttattatttagttataaagtttattttttaatagttatttttttgtttttttttttttttgatgttttattttttaagtgggttttagtgtttgttttttttttatttgtttttatgagtttttattatttagtttttattaatgtggtatttgggaaaatttaatttttgaaagatttttagtttgttaattatgaatggttaatataattataggtatgttaatatttgtaatattgtgatattttttttgttatttttagttaaaattgattttttgttttaaaaatttttgttattaataatagtttgttttttatagtttttttatatttttgtgttttttttttaattaaataattaatttttttagtattttatttatttttttttttttttttttttatttttaatttatatttttttttttattttaattttaatttgtgtttttttaagtgtattttagttttttttttaaaataattttaagtgatattttgatttttgattgtatatggaagtataagtaatatgtttttttatttttggataatgagttttttgattaattatagtttaagagtaaaatgattgattattatttaatttattttgtgtttttttataataaagtaaagatagaagttttagatttaggaatagataaaatattttaattgttattatattttttttaagtttagttaattagaaaagttaaatttttttttatagttaagtatattaaaaaaaaattttttttggtaataaatttgaagttttaaataattttataattataaatattttgtgtattttgtaaatatggtataatttgttggtataaaattttattgttttagaaaatattggtaataaaattatagaaaagttaaagatttttattttttattttgaagtgtttgggagatattttagaaatggatgggaaatgttaaattttgtatgtttgtttaagtttttatttatattgattagatgtaaatgagtgttattaaaagtatattataggtatttatatagattttttttataagggatttataaagtttagatgtgaaatgtatttaaaggtttttagttgttttttatttttttttttgtgaaatagggagatatatgtgttttaaggtagagatggaatttgggtgatgggtggggggtgggggaggtgggaagggatggtttaggatagggtaggattgtggattgtttttgttgttttggttgtttatattgggtatttttgtaggtgtgttggttttttttatttttgttgagatgatgtattgtgaaaatatttgttttttttgggatgttttttggtggtttagagtagggaaaatgttgttttaggtttaaaataatttgtttaagtattttagtgtgggagaaatgtttttatttgttttttgtttgttgtgggtgttttttgttttttgttgttagaattttggggatgtgtttagatttggtgtagtatatgtttgggttaattgtgagtagaataaatttttggtgggtggttaggaggtttttttttagttattgtttttttttagtgtttttttttttttttatataatataagattttttttttttagtttttttaaagtatagtttagggaaatttttttatagtttttatttagttatgggttagtatgtttgggggtaaatatgtagatttggaggtaggtatttgtgggggggtgttggtttgggtgtgtggggagtgtttgtttttgttatttgtttttttaaatattttgattgttgttttggttttagttttttttttattttggagtatttttttggtgttggtattgttgaggaatgggtttgggtggggaggtgaagagaagttaggaatgttttatgtttttttaatggagagggggtttagggagtttttgagttaggaggatatggaaaaggggattggggttttgagattgggtttgttgggtttaggatgtgttttttggatgggtttaggatgtttttttgttgtgggatttttgtggtttggttttgtttgttgggggtttgaagaggtggagtgtagggtggaggtgttatttatttgagttttggggatagtttttgggattttttgttaggtgtttagattggtaggttttgtaggtggtgtgtggtgtgtttgtattttttaaagtttttgaattattttaagaattttttttgtattttggtgtttggtaggggtgttttgagagaggtagattttttttttttaaattgttattattatttttaatgttttttatgtgttggagttttgtttgggtgtggaaattttgttttttaatatgtagttgttttttagttatttgtttgtagtttgggagtgttttgagggtgggttgggggagttgtgtaggtgagattgagttttaggatatttagggggtttggtgtttggttttgttaaaaatggggatttttgggattgtgattattatggtggattgagtagggagagttgtggagggataagagagggttgaggtagggtggggggtgtgggtaggtgtgagggggatgtggttaagaagtagtgataaagggaatattttatgggttgggtggttgttgttggattttagataaagttggaagggattattggggtaggggtaatagggattggggatgggaatgtgaaataggtgaagtgtttagggtgagagtgatttggtttagggagtttgggagaagtttgtggttgtttttttgttgttgaggttttgtgggttttgtgggttttgtgtgttgagttggggtgtgtgtgggtgggggtttttggattgtgtggtggggtttgttttgatttttggtggtgggtgggggaggtaggtgtgttttgtagagtatagaggggtgtggtgttttttgtgagatttttttaaaaagttggttatgtgtaggtggtttttgtgtatggagttgtagttgttggagtggttagtttgattttgagtttgaggttttttttgttgttaggttgattttttattgtttgtttttttttttgtatttttttttttattgttgttgttgttttttttgttttggttgtttgttttttgttttttgtagggatatttttatattgtttttatttgggaatagggtaatatttataagtttaataataaggttatggtagatgagttgagtgagaagtaagtgtatgatgtgtatattaaggagattgatttggttaattgtgattttaaatattttaatgatgatgtggttaaggtaagttaaggtgattaatagggaagggttgggatagtttttttttggtagttagtttgtgtatttttttttagtattgttgtgtatgtatattttattttgttttttatatgtgtatatatatatatatatagagttttgtgggtttgatgtgtgggagtttttgtagttggtagaaatgttatatttttttttttttatttttttttaatagttagtttagttgaaatttagttaaagtgagttttgtagaagtttttataattatatttttattttagtaaatgagtttattgattttagtaatagatggtttatattttttgggatggtgagatggtttttatttatttttaggttgaaagtttagtgataggtttttattgtatgtggtattaagatagttagataattgtgttaggttttgtgttgaggatgagttagaatataagatgggtatgtttttttaattaaaatgatgggaagtgatttttttaaaaatattatagtggatggaaatgtttaggattaaagataaagaaaatatgtatttatttatatatatatgaaagttattttaattagattaataagttatttgtgtataattaagtaaatttataaaattaaaaataatgtatgttttttggttttttttatttatggatatttgtatttagatgtggaaagttgtttttttagtagttatttgggttagtttgttttgagttaatggtatatttaggttggagtttttttttatatttttaggatgtgtttggtgagattaaaaataattggattgggttattggttagatttagatttgatttagtggttagttttaaattattattgttattagattttgatttttttagttaatttagtgggaggaatttattgtttaaatatatttggattgggatattatgggttagagttatttttggtaaagggttttttttgagaaatggagggttaaggaaaaattttggtttagggattgtagtgtgaagatttatttttatataatttttagtaattaatgaggtggatgagtaatttttatttattatgtttgttatttatggatgggaggagttatagtttataaattgtttatatttatgaataatatattttaaaaggggaaatagtttaatttgtaattggaagggaaaaaaaaattgttagaattgatttttttggttttttggagtaggaaaaaggaaaattggagtatttgtagttttttttgattagttggattatggaatatttaaaagtaatagtaataaaagtattttataaattagaaaatagaattgttaaaaaattatttattaaaaatattattttaaagggagaggatatttgtgtttttttttatttttattttttttatgtggttttgaataagaaggagagttgttaggaaaagaggtagattttagagagggttggttttattggattttttttgttgttttattgtattgtgagtgagattttttggagtaagtgaattttttgggatgagttagagaggttaatagtgtggatgtgggtttttatatatagtatgattaagttgagaaagaaaggttttattgggaaaagagattttaatatagatggaaaaaaaatataataggtttggaggaaatagtagtttataaaatagtattttaaagagtaagtgtggggatttttaaattaaagaaattaaaagaaaaagttagagtaagtttttgttagtttaaagaaattaaattttgattatttgtttatagaattgtgagtaaaataagatagttaaattaaaaaatttatttagaaaagaatttggtagttttatttagatgtttggtttagaggggattttagagaatgttttatagagagatattaagattataaatgtaaattttgtttaaagagtgtttggttgatgaatagggttttatttatattttatggagatttttattttataaatatgtatttttaagtttaagtataaataaaataatagaaatagggatgatttttttttagtttttatgatagtaaataataaatttttttaaattttatttttaataatatagattttttttatttttatttttatttatttatttatttattttttgagatggagttttattttgttatttaggttggagtgtagtggtatgatttgggattattgtaatttttattttttaggtttaagtaatttttttgttttagttttttgagtagttgggattataagtgtatgttattatgttgggttaatatttgtatttttagtggagatggggttttattatgttggttaggttggttttgaatttttgattttaagtgatttattggttttggttttttaaagtgttgggattatagatgtgagttattatatttggttaataatatagattttttaaaaaaattatgataataattttgggtgttttttaaaagtatttaaagttttattgttaatgtatggtagtttaaaattttatataataagaaagaattagtggttaatggaatttattgttaaaggtatttaattaagtaaggaaaagttggttttaaaagtaagtagttttgtaaaagttgttttgtttaatatggtaattattagttatttgtgtttttatttaaattttaagtaattaatattaagtaaaatttaaaatttagttttttagttatattagttatgttgtgagtgtgtaataggtaaagttagtggtatagatatagaatatttttattagtatagaaatttttattggatagtgttagattagggtgttttttgtattgtaaaagtatttttttgttaagttaaagaaaataataataaaattttagagaagaaatgaaattttagttttatttttggagaggaaagaaaatttatgtgtggtatgagtttatatttaagaaggtgtagtattattatttattttattagtaataatgatatatattatagtatataatttagttttaataaaattaattttttattttattaaaagtttgttgttttatattatgagataatttatttaaatatagatatttatttaaaaatattaagtagtttgtgaatattttttaaaattttttttaattaaagtggttataaatttaaattttttattttttttttgagatttttgtgttattttttgtttatattgttatttatatgtttattatgtatttattttgattttttagataaataaaatggttttaaatttataattttgataaaattagttattaattaatttatttattaaatttatgtaatatgttagattagatgttttgttatgtaatttttataataaattttagtaattataaagattatagttagtgagatgatatgtatataggtaaaaagtgtttttaaaaaatatatatatataattaaaatagtaagttattgttatatggaaattgattggtttttttttttttttttttttttgttttgattgttaggaagtagttttaaatttatagttggattttaagttttattaatttatgtttttatatatggttttgtatttttattttttttttttaattgatatattgttttatgtgatttttattgtaagtttttttattattttggaaatagattaaatataatatatatgataaggaattaaaagtaaatatagtagtgttgaatattgtataataaaaaggtttttaaatagggaatggtattaatatgaagtgttagggagatttagttatgaaaaggatagtagggttagagaaggaggatgtattgtagttggtttaatggagaatggtatgaaggaggtgtagtttgaattgggttatggaggatagatggattgtaaatagttggggtaaaagtataggaaggtattttaaatgagttaggtatggagataagaatgttttttataagggagttgtagtagtttaattagattgggatttgagattttatgtggtagagtggtaggtgataaaggtgaaaagattgattatagtaaaatgtggagtttgtaaatttagtatttatgataagtttggatattatgttaatagtggatagttataaatgattgtaagtattggtgtggtataatgaaggtgatgtttttgtaaaatgattttggtgaaggtatagaaggtaatgaaaagtagttagtttagttgagtagaaaagagtttagatgtaattgtattatggtttagatgtgaaatgaagataatgtgaagtggtattgtggattgaaatatatatgtataaaatgatagaattttagaatttgaagggattattatggttattaggttggtttttaattttttttttgtaatattaatagaaattaagggttaataagtttaaaatgttatttatttttttatatagttattgtttaaagtgaatattttgaaatgtattattaaagaagaatagataagattatgtgatttattatggattattgttatgagaggaaaaatgtgtttagatgattttgttagtattgagataaattaggatatttgaaaggaggtttttgttgaaaaatagaaatatgtatttataatttgtttttttaaaattggaatgtaatgatttttaaatatgtatagatataaatttttttttaatagttaagaaaatgtatgtaggtgataattagattagttttggttatagtataaaggtttaatgtttttgtgattttttttaatttgaaagtattttagagtaattggtgattaatattagtataatagttatttataaaattattatttatttgatatatatttaattaaagtataagatttatttttattattattattatattttaagttttagggtatatgtgtataatgtgtaggttagttatatatgtatatatgtgttatgttggtgtgttgtatttattaatttgttgtttagtattaggtttaaaagattagattgttttggtattatgttaatatttttttttgttggtattagtattagttttgtttgtgtatttgtttaggagatagttttataagttggtgattgatattttattatgtatgaagttatgtgtggaatttagaatttttagtttgtaaaattgtattatgattatttttagtgggaaattgtttttagaatattgagtaaaggatgatattaaaatggtagttattatttatttttaagtatatgaaatgtttttaggtttaatttaaaattatatatattttaaatgtttattaaaagagtttttttttttttttatttattaattgtaattaaaaaattttggttttaattgaatatgattttatattatttattaaaatttaaggtaaggtgtattaagtatttttgaattatgaaaagttttatgatgtgggatatttttttagttaatggtagggttggttatatttttaaggggtttaaagtaggaatagttgtaatagtgagttgtatttggaaagtttagtaatttgaaaaattatttgtttatgtattttgtttatttaagtttataaaataatagatatttttatattttaaatgaaattgttttttagtttgttttatttttaaatataattttttgtgatggaatgattagaaatagttggtttttaagaggatagggttatgtgtgtttatttgtggggttggattttttataatttttttggttgtggggaaagttgagggttgttgtttttatataaagatggtttattttaagatatatatattttttttttatattttggagattttgtatatttagtattttttttattataatttgaggttttagagaaaaagatttgtaaattatatttgttttaaaataattttttaaaaaagatatttttagtttttagaaattatgtttaatatatagatgtttagaggtaatttgttgtagtgtaagaggattgtgttaagattagaaaataaatatttgtaatttttgtaattgttttttttaaaatttgaatgtggtgattttaaagtaaagattgatataaaattttttttttttagtagttaggaaaaggtatgtatgaagtaattagattaggtgtggttttagtataatggtttaatgtttttatgattttttttaattggaaagtgttttagttttattggatattaaggaggaagaagggatggaaaatattaggtttataggtttattttttttagtagtttatgagatttgagtttatatgtagggagtaaaattgtttgtttaaaagtagttaataaatgttttaaaaaggttgggtgtagtgatttatttttgtaattttagtattttgggagtttaagattggtggattatgaggttaggagagtaagattattttggttaatatggtgaaattttatttttatgaaaaatataaaaattagttgggtgtggtagtgtgtgtttaattttagttattggggaagttgaggtaggagaatggtttgaatttaggaggttaagattgtagtgagttaagattgtgttattgtattttagtttggtgatatagtgagattttgttttaaaaaataaaataaataaaataaaataaaataaaataaaataaaataaaataaaataaaataaaataaaataaaaataaaatgaatgttttaaaaatattttgggtaaattattttgtgttttttttttttatttatttattttttttgagataaaattttgttttgttgttttggttggagtgtaatggtataattttggtttattgtatttttaattttttgggtttaagtaatttttgagtaattgggattatagggatgtgttataatttttggttaattgttttagttaggatataaatgttgtttatatagagtttgtagttatttttttgattttttttatgtagatttttttataaatttttgatggatttttttattaaattttattgtttgttaaaattttttatttttatatttttagtttaaataatatgttatttataaattttaaaattgtttttgggtaaataaataaggtaaaataggaatatatatttttaggtaatttatttttgttttggttttataaaaaattgtaattaaattgtagaaaatattttaatttttttttaatattttttttttatatattggtttttaatttttaatttttttattgaaatattgattgggaggttaaggtaggtggattaattgaggttaggagtttgagattagtttggttaatatggtgaaattttgtttttattaaaaatataaaagattagttgggtatggtggtatgtatttgtagttttagttattttggtggttgaggtatgagaattgttttaatttgggaggtagaagttatagtgtgttaagattaagttattgaattttagtttgggtgatagagtgagattttattataaaaaaataaaaataaaaattgaaatttgtagtttttttaaaattttatagtttttttataaatttaaaagtattattaaatttggtgaggtgttaaaagaattagaggaatgtttataaatatagatgtttgggtttattttagatatatatatatatatatatatatatatatatattttttttttttttttttttttgagatgatgttttgttttgttatttaggttggagtgtagtggtatgattttagtttattgtaagttttgttttttgggtttatgttatttttttgttttagttttttaagtagttgggattataggtgtttgttattatggttggttaattttttttattttttagtagagatagggtgttattgtgttagttaggatggttttaattttttgattttgtgatttgtttgttttggttttttaaagtgttgggattataggtgtgagttattgtatttggtttagatatattaaattagaatatttagaggtggagtttgagtatttgtattttttagagttttaaatgattgttttttaaatgattatattgtgaagttagatttagaaatgattgtatttaaggttggttaaaagatatatattttggttgattttatttgaagagagtaaataagatatatagtaaagttgtagatgttttttttgttagtagaatatttgtgggttaggttatttaaaattttgttagagagttttgaaatattgtggagggtttttaaattaatttgtttaatggttttttatttttttaggttatttgggtttaaagttaattgtaagtttagagttttagagtgatttaggaatggggtgattatatattttaggttgttttatatagattagttagtattatttagttgtaagtaatagtatttaggtatgtttagaagtgttttatttggaggaaaaaaataatattgttataaatgaattggtaatggtttgtttttgatttttatatttggaatatattggaagtttttatttatgttattttttagtagaataggtaaaatttttatattttaggtatgttaggtttttttttgatttttttttttaatgttatttgtttgttgttttttattatagttattaaattgtattttaatttaaagaggattttttatgttttaatttatttattttttagatttttttttttttgaaatatagggttaatgagattgatatttttttattatatatttttttagttatttagtaaaagatgtaaatgtttaaaatagtttaaattattttttagttagtttaggaaatataaaatggtatgtttgtatataaattattgtttagggtgggggaagtgtttttaattttgttttaaaggaaatttgtatgatttataggttatgtaattattaagggaattagttggtagaatagaattatatttgtatagaatataaattttttgttttttatgggaattatgttgatgttttagatatgaaatatattttgttttttttattgaattttgagaagatgttttttgttggttattattttatggtaggggaagtatatatttttaaagatataattgagtttttttttaattattattagttgggttggttattaagaattagatgtttttatttttaaagagatttaagttttgatgttgtatatatgtgtttaatattttattttatagtaatttaaaggtgatgttttaaaaagttgtatttagtgtataaattttttttgattttagtaaggatgttgtgatgattttatttaaaaaggtaagttgtgtttagatatggtagtgggttattttatgtatggtgtagatgttaaatataattatatttttttatttgtaatgattaaaaaaagaagttgagtttaagtagtgagaaagtaggagattgggaggataagaagtaaaggaaaaaagtaatatgagtattgttttttttgttttgttatttgttttattatggattgggttgtgatattttatattttagttttataatttttaataattatttatgtgtatggtgtttttatgtgtgatgatttaattaggtttaggtgtggattgagtagttaaattataatttttgtttttgaagagtttagggtttagtggggaaatagatatgtaaataaatttgagtgaggttatgtaattaaaggataggttatagttaattataaagaagagagtttttagtagtttttaaagttgaatatatgtttattaggaatagggttttagtagagggagtaataggagtaattagagttttgaggggttgtggtttgttttgggtattagtagtggattaatgtggttagagttagggatattagtagaagttagagtagtagggttttttttgtttagtaaaggtatttgtttttttgtaggttatagtgatttatagagggttttttaggttagaaaaaagttattaaggttgggtgtggtggtttatgtttgtaattttagtattttgggaggttgaggtgggtggattatgaggttaggagattgagattattttggttaataaggtgaaattttgtttttattaaaaatataaaaaattagttgggtgtggtggtgggtgtttgtagttttagttatttgggaggttgaggtaggagaatggtgtgaatttaggaagtggagtttgtagtgagttgagattgtgttattgtagtttgtagtttggtttgggtaatagagtgagattttgttttaaaaaaaaaaaaaaaaaaaaaaagttattaaaaagggagttatgttttttgttggttattattttatggtaggggaattatatatttttaaagatataattatttttttttaatttttattagttgtgttggtaattaaaaaattaaaagtttttatttttaagaagatttaaataatttttgagggtgtatatatgtgtttaatattttgttttatagtaatttaaaagtgaagttttgaaaagttgtattttgtgtttgttagaattatgtttgatgagatattttttttaaagggtttttggtgtaatggggtaaattaagggggtttgtgtaagtgggagtgagataggagatggggtgttttttttagtattttttataggttgattgagtgataaagattattttattgatatttttaatggttttatgagatgggtattattattattattattattatattttttttgtagataaggaaatttaggtttagtagattgttagaataatataggtaggaagtggtagagttagggtttgaatttaggtagtgaaattttaaagtttggatttttaattattgttttttagtgtttttttgtaataagttatgattttagaagttattggtgtggttataatatggaaagagatgatagtgtttttatattgggtgagtagtttatggtgattttagatatgatttttgttgggagtgataggtttgagtttttaggattagattttagattttggtaagtggtttgaggaaagagaaggattaatgtaaaattttaggttttaaggaatgtggatgttgggtagggaggattaagttttaaagattagaaatggggtatatagggtaggtgtggttagagtagaattagagtagaatttttagtgattagaaatagaattagatatgttgtagtggtggataaggtagaattgtttaagtttttaaagtgtttttgattatttaagttggttagagattttggggtggggttgattttgtttggatatatggggaggggtaagtatgaggaaaggaagtaggttttgataggtattttgtattaaatagttttttataaggtttttaatttgtttgtttaatttttatagatatttgtgggattatattagtatattgtaaaagtaggaaataattgagaaaaatttgagttttatgttggtaggagaaatgtttatggaatatggtaaattgtttttttgagattttttttttagtaattatatatttgtttttaaaaataaatgttagaaggaagaagtagatttaatagtgtattttataaggtattattaatttttaagaagaataattaaaatgttttagtaattatggtttattgtatattttttttatttttttagaagtaatatatggttggaaatgggtatattaaaatatgttaaggaagtggaattgtgtttattagattttattattaattattttagttagttttatagattttttttttttgtttgtttttgagagtgaggttttttagtaggaagagaaattgtttaaaatgattaataattataaatttattaaattattttgggtaagtttttttatttttttaggtttaaagttaggaataagagttatttttatataatgtattgttttagaaagggtattatattagtttgtttttatgttgttgataaagatatatttgggattgggtgatgtatttaaaaaaagaggtttaatggatttatagttttatatgtttggggaggttttataattatggaggaaggtgaaaggtatattttatatggtggtagataagatagaattgagagttaattaaaaggggaaattttttataaaagtattagattttgtgggatttattattattataagaatagtatgggggaattgttattatgatttaattattttttataaaatgggaaaattatgggaattataatttaagatgagatttgggtggggatatagttaaattatattaggtatttaattaatatttgggaagtattagttttgtattaggtatggagtatgttatgagttttgttgtattatagtttgtttgatagattttagttattttttggagtttgtttttgatatttggatttttttagaattagtattttttttttttgtttttgttattttttgtttttatttttgttgtggtatttattaaagttttttaattattttgtgttattgttttttagtgtttttttttttttttttttttttttattttattttgtgtttgtattttttaagtagagtaatggtatttttatttttgtggttgtttagtgttttatgtagagttagatattagaaaatagatgttgaatttagttgatattttgaaattttttttaaagtaagttaatgtgtgttttgaatgaaaagatattgggattatattattgagtgtttttttttttttgttatttttgtttttattggttatatttgaaaattttgttggaaaaaaaaatttaagaatttaataaataaatttaaaaatatttagtttatttatttaggtgaagagaaaatttattttaatatgtgtgtatatttaaaatatttgttatttagattttttttttaagtttttaggttgaggaggatataaatatatttttttaaattttttagtaagtaagttgtggtatttagatgattttttgggttatgggggataaggttaattttttaggtgtttggtagataggataggtaaatttttagaatgttaaaatatattatttgttgttgtttggtattgtttttaagtttagagtgtggaggttgggggtgggtttttggttataggagaagttttttggtaagggaggggtgaaaggagtgtttgttgaattttttatttatttttgtattatggtaagattgagaggaatgattagattagggaatggtttgaaagaaaaatttaaaattttttaattttggataaggttatagttttgagaaattgaagtttttgtttttttttttttggttttattgtttttagatgtaaatatatagagttttgagattttgtgtgttgggaggtgataattgttaattttttattttaatagtatagaaatttttttttgttttagaagtggttttttatagattttagatttttttttaggaaaaagaaaaataataataataataatatattaatgattttgaaagagttagatattattaattttattattggtgtttgtgttaagtgaaatgaatgttagttttttttttagatatgttttttttttttgttttttataataagagatgattttattgtaataatataagatttattaatttgattttaaatagtttttttattaataggttaagtgtaaaatattaggattattatttagttgagaatagatagaattaggaagtagttattaaaaaagaatgatgaggtgtattgtggatttggggtgtaatttggtatttaatatatagttagaattatagttatagtatatttaatattttattagaaatttgtgtgaataagttaagaggatttttaatttaaaaatgatattaattgtaatgattttgttaatatttgtgatgaaaataatagtaaagtgatttagataaattataatagtttataaaaataagataaagtttaatataaagtaagatgatgttaaaagatttgaaataaaatagatatgttaagtaggtaatatataggtaagtatataaaaataagaagatattaggatagagttgttatttttgtgggagtttgtgatgtggaaaattaagatgtttggtgagtataatggatatggaaattttttttgtaataattttatagttttaaggggttaaggtttttaggttgagttattattgtaaatatatttatagatgaatttatatgttatatttttttgagtaagtggggatttaaattaggtttgttaattgttttagaaaattaagtatttaaataatttaatgataatttaaaagaagtataatgaaatattttaaggaatgttatatataagattttgtattttttttgttttggttagatttatttagaataggtttttgttttgattttaagagggaggtagagattttggagaagttttagggaagagtaaaaggaaaggaataaggagttaagaggaaatttagggtaaggttgaggagggattgttttgtgtaggtgatttattggaagggttggaaggaaatatggaatgataattatttttggttattgttaggttagtatgagatttataagaaaagtattgtttagatgtaattattatttaagataagaaataataggaaaggttagtatatttagttttttatttaaaaaagtgttaggtaggttgagtatggtggtttatttttgtaattttagtattttgggaggttaaggtggatagatgatttgagtttagaagtttgagattagtttggataatatggtgaaattttatgtttataaaaaaatataaaaattagttaggtatgatggtatgtatttgtagttttagttatttggggggttaagaggtgggaagattgtttgagtttaggaagttgaggttgtagtgagttatgattgtgttattgtatgatagtttgggtaattgagtgagagtttgttttaaaaaaaaaaaaaaaaaaagtgttaggtgatatgagagaagattttttaagtaataagagtggttaattttaggaatgtgttattagaggttattttgtaatagttgtgtgttaaattttttatttgtttatataattttttaaatttttttgtttttatagttatagtttaattggtgtataatagtttttatatatagttttataattaaatatagatatatatatgaatatttttttttatgttagtaggatatttggtttgtttaggggtaaagaggaattgatgtggtgttgttttaattagtggttgaaaatgtaagtggtaaatattgaaaaatagaatattgtaaaaggtatgtattgtatatattaaaaggttagtatgaagtattatttgtatggtaagtttgtttatttatttttttttatatgttgtatatttatatagttttgtagtttgtataaatttttattgtgatagaaatttatgaaagagtgtggtttttgtgaaagttggttgttttgtgaatttagattagtggttttttattttggttgtaaattatttggggaatatttaaaaatattgttttaaatattttaattttagaaattttgatttaattggtttgtggtggggtttagaattttgtattttttttttaaggtttttaggtgttgttaatgtatagttaaaattgggtttggtttagatttttagaattttttaataattaaatattttattatgataagatttttaggattttaaaggttatagtggggtagttattattttattaggtttttatttggggaggtttttggtatttttattggaatatatttgttatttaaatttttattataaaaaatttttttttgtatattgttttagtaattatatgagatatattttgtatatagtataaattttatattatttatgtaatttagttttgtggttttttttttttttttgtttgtttatttttaattttttttaagaggaagtttagttagttagaatattagagtattatttttttttttttttttttatttgagtttatggtttagatatattaggaatgaagttgataatatgtattagttttttttgaaattatgtagtaaaatttttaaagtgtgagtggttatagagatttttatagggtttagggataggtagatattattttttttttagtttttggtatagaaaagagattttaggttattgagaagatattagtttttttttagagtagataaggaaattgagttttagaatgaaagattgaattttagtttttttttgaatatggatttttagggttatattgggttttggaaaaggtatttatattttggattgtagtttttttatttataaaattaagaggtagaaatagataatttttaagttgtttttatttataaaattttgagattttagttgattagtatttatataagagttgaagtttgtaagagtgtagaaagtttatataaagagatagtggaagattttttattagtagtatttttattattttttttttaggttttattagttaatatttttattgttaatatatagattgtggtatttaattaaattatttttgaaatattgagttattaatagatggtatgttgaatgtaaaaggattataaataaatatttggtattgaagaagattaagagttggagtttattttttattttgatttgggtttagaattttgtggttttttttttaattatttttgttattaaattggttgtatttgttttaagatggattagaaaattagttttaaagttggttataaatttttaggtttgggttttgttttgtttttttgttttgttttgttttgtttttgtaattagttaatttattttagtttatatgatagagaagtgtataattatttgtaattttagttagagtagtggttttaagaaggtttagttaaataaaaagtgtttagattttttgagtgttgatagttgttaaatttatttagtttatatggttttatttttattgtttgttttgttttgtttttgttttttaatagtttatttgtgagtaataggattagatgattaagagttatagggtagaaatattgttatttagagttaaatttttttattatttagttgtaaagagtttgtttttttttgatttatataaagtttattatttaggtttttgtatgattttaattttattatttaatattttagttatatgattttgaaggtaaatatgaaggtgtttgaattttagattatttaaatatttttaaggaaattattatttttatgggtagagttatgttaaaatttgtaggttttaatttaaattttatgataagtaaaaattgaattaatttgttttttattttgtttatttttttgttaaaattatgtttggattagaataaataaatttaattaatgaatgtaattattaatttttatgttagataataatatatttagaatttttttttttttgggagattttattaggttagtgtttttgtaaataggagaaagagaaaaatataatttagtaaatagtagtatttattaatttatttatttatttaataaatattaatttattatttattatattttagggagtttagagtttagtattagaaataataattatatatatatatatatatatattatattaaataaggatgtgataggttagatgaaataaataaataaataaaaggtttaggtgagaaaagaaggtgggggttagaaagaagttattgaagaaaaaatatttaggttaaaatattatgaataatttagagtgagttaagtgtagagtgttgaaggagtgttttaggtaaaattaatagtaaatggggagtttttgatgtagaaaagggtttgaggaattgttttgggagaaatatttaagattttagtttgaattttagaggttagtgatttagagaggtaagtatgaaaatgatttttttttttattttaaaagtaagtgtattatagaaggaaattatttttttttggtaataatttttgagtgagtttgagaagttagaggttatttttattttataggtattgttttttttttagttatttatggttagtttattgattttgttttggttgtttttttattttatttattttatttttaaaatgtagatgttttataaatattgtataaatgaatgaatttataaagttatagtatagtaaggtaaaagtgtttgtaataaataagtattttaggttagaaatattttttaattttaaattgtgttttattatattgtattttgattttttagagtggtagtttttagttaagggaaagtttttttttttttttaggggatatttggtattgtttggagatagttttagttgttatgatttgggggatgtttttggtttaatttgggtagagaagtggggatgtttataattattttatagtgtataggatagtatttttatttatattttagtaatgaagaattattagatttaaaatgttaatggtgtttaggtagaaaaattttgttgtagaggttggggattgtgttttgatagttatattatatagtgtattaaataattttgtataatgggttgtaattatttttgtttagattttgtaagaattttagtgtgtatttttttttttatttgttaagtaatgtttaaatttgtagagatttattttatttattttttgtgtgtttagtaaatagattagaagtattggaggaaaaaatattttagtaatgaggtaagatgaaagttattagtaattttagtttaatttagttgaatagtaggaaataatttttattgtgaggaagtgtattgtagaaattgaaaagatgttaatgatgtttaaaaagttgtagtttaaataaatgtgtatgtagattaatgggtagattgaaaatgatgaagatatttttgttttttgtgtttttgatagaaaagaaagagtttttattttttttagtgtggtaattatttagatttgttttatgatatgtttagaaggttgaagaataataaatttttaagtgtaaatatagaatttagtgaagaatttaggtttttggatgaatttttgtaattgtatgtttggataaaataagatttttatatattaaataaggtaggatttttttatttgggatggaatttttaatatttggaggggttgtagttatttttttttaaagatggtaaatatgagtgttttgagttattttttttttttgtttaagtttgttaattaattatttagtatttatgttattgttggtttttttgtggtttatttttatattgtttattgtttagtgttatttgtttggtaatatttaatattaatatgtgttattaaattgatattagaggataaaaaagaattaagatatgtatagtttgttttgtattgagttagttgttattagatgttttttgtgataatgaatatgtgaggttatgtggatgtgagagatggttttgggtttttttagatggtttatagttagttggtttgtagtgtggttttagattttgatgtgggaattttataaaaaagaatatgtaggttaggtgtggtggtttatgtttgtaattttagtaatttgggagtttgaggtgggtggattatttgaggttaggagtttgagattagttttgttaatatggtgaaattttgtttttattaaaaataaaaaaaaaaaaaattagttaggtgtggtggtggatgtttgtaattttagttatttgggaggttgaggtaggagaattgtttgaatttgggaggtagaggttgtagtgagtaaagattgtattattgtattttagattgggtaataagaatgagattttgttataaaaaaaaaaaaaaaaagtttgtaggttgtataaagaggtatgaaaatgttttagaaattttaaattttatttttgaggtttattttggtgagggaatgtgtgtgtattttttagggtttttttaaaaaagtattataagttggatggtttaaagttatagaaattttttggggataaattttatgattttggaagttagaggtttaaaattaaggtgttagtaaggttatgttttttttgaagtttatagggaaggttttttttgttttttttagtttttggtggtttgttggtaatgtttggtattttgtggattgtagttatataattttattttgtttttattattaatggttttttgtttgagtgtttttatatgattatttttatataaggatattagttatatttgatgagggttttattttattttagtatgattttatttttattaattatatttgtaatgattttatatttaaataaagttatattttgagtgtttggggattagaattttaatagagtttgttgaagggggtataatttaatgtataataggatggaaattagaaatgggtatgtttttattagtgtagaaagatttagtttaattttttaaagtgtaataaaaattttaggaaaatttatatttttttttaagaagagtaaaagatggagaaatttgatggttatttttaaataaaaggaaaggaggaataagatgaaaaggaattaatttaaagtaaagagagtggtttatatggaatgttggtgtaattttttttgatatatttgtgtatttattagttggggtattatttttttggggtatatttggttattgtgtgttttatggtaataaattttagaagttttattgatttgttagagatgagtttattttttttgtttgtttaatggtaaaatataaaataagtagttattgatatggaatgattttaggaatgttaaaaggttttttttttttaaaatattttttttatttttttaatattgttattgatattattaatatttttttatttttggttgagatatttgggttagagtttttgatgtggtaggtagtgttttaaatgttttgtataaattaattgatgtttagagtaataattttaagatataggtattattatattgtattttatagataagaaatttaggtataaagaggtttagtagtttagatgagataattttgatgagtagagatttgaatttagtttttatgttattaattaggatattatattgttttttatatatgttttttaaaggtaatatagtaattgattattatatttatttatatttgattgttatattttttagatttgtttttttagtagagaatgaagtttaaggtatttttgttttttaaagtgttttttttagattagttgtattaaaatgaggggatgaggtgtaaatgtttggattttgtttttggagtattgatttataattttaagttttaagaatttgtattttaataagtatttttagaaattttttaagtatattaatgtatgggaattattgatattaaagaaatggaataaggggaatgtataatgttatagtaaattaggaaaagttagaaagatatgataatatagtgaggattttggtagttaatggttagttaaatgtttaggggttttggttagaagagagttaggttgttgaggagtaagagtgatgttgaatgtggaggtttgagagtagaaggaagttagttagttatatttttttgtttggattatatattttttttttggtggaaatggttatttgtagagttagagaaggtatgttttatagtttggatggtaggtatggatgtagataataaagagtaattagagtttatgggtttagaaatttttatgtgtttttgtttgaatgagatgtttgtataaatagtataaggagtttggggtggggttaaagagaatggtgtggtatagggagagttgaatgaggaattgagagagtaaaattttgtgtttggtttaattattgattataatttttttgaggtttggttttttaatttgtaaaatggggggaaataatatttgttttgtaggtttttatatatagggtatgatgtgaatttattgaggtatatagtattgtgtaatatgagttattgttattttaaggtttgtaaaaggtttttgttttggaatatatttgttatattaatgtttgtagtttattaatgatatataaaggatattggagataatgatgttttttgttttatgtattttttttatttatgttagaaaagaaaatatagttatttgaagttattttaaagagtatgtttgtttttttttttgtatagatatatatatatagatatgtatatatatagattatgtatatatatatatatgggaaaatatgaggaaaagtggagataagaggtattaaaggataaagttatttttgttgtttgttttttttttagtagggttgggtttgggttgttttttttgttttttttttgaagttttttttttattatattttagtgtgtgtttattattttggggttaggtttatataattgtagtgatttaggttatgggagaaaatttaaataagtataaaatatgttttaatttatattttttaaattgtttttttttaaaggtgaagatttttgagtttgaattatttttttgttagtgggttttttatgttgtttaagtgatttaagtgataattaatttttattttattttgagaatggttgtggtattttagagttatggtgaataagaaaattatttaaaataaaatgatttttatttatttattgtttttatttattttattttaaatgaattttaaattatttaaaataaaataatgggataaaagaggatgttaaaaataataaatatatatgtattaaagtgtgtttgtaatattaggtaaagaattaataagagataatattatggttggtgaaatgttatgtatggttatatttttttaatgagtatttatagtttttttaaaatatgtttattgaagaaatatttatatgttaattaatatgtgtatagtattattaggtattatagaggatattagatgtttgtagtagatatagattttgttttaagttttggttttgatgtagttattttttagttattataggtgattatatttagttattataagtgatttttttttaatggggaaataaaggattttataaaagatgtagaagataatttttaatataaaagtgatttagatttttataagtttgtgaagagaagtagatgagtgaaatagaatattattaatgtaaaatattattttgaggtttttgtaatgattgggaagtaataagagggaggttattttagagagagaggttttaggttttaagttggatgtttaggttagtgattgtaggttttttttatatttattattttatattttaattttttttagttgtttataaaggtagataaatatttatatttttgtttttttttattttgaaattttggaaatttttgtttttgttaggggaggttatttagtatttgttattttaagggaattaatgttgaagtttaagaataagagttaatatttttattagaggtttatattttttttaggggtttaggtggatatttttgggaatttttgttaatataggtatttatagtataatttaggttttttgtttttagtaggggttgtaagagtattgtagttttttttttagaggtgttagtttggtttagtaaagattgtttttgagaaaatatatgggtaattagagtaaagtttttatgttttggtaatatttaattgtgttattttttaattttttttgtatttatatatttatatataatatttattttattgattttaaaggaagtttaatgtgttaaaaatatgtgtgggaataaagaagggagtttgaaattggtttaaattttgtataattgggtttgatatgtatattaggattttataagtatgtatttaatttttttttaaaaaaagtgtttatatagggtttagaataatgataataaattaatatttttattgtttatttgtgtgtttttatagtaaataatgtttatttatttttaattagtaatatatatttatgggtttaaattagtaaaagttttttaaaaagtagttttatttatttatttattagtgtttagatgttatttagtatatgaggagtttttagaaaggagtagggaataaattagggttgttaggagtggaggagaaagaatggtatatgtaaaaaggagttgtaattaaatttaagggaatatggtatattttagttttttgtatgagataaagggtaattttggtaaaaatatagatttttaggttttattttaaagagtttgatttgattttgaaatggggttggagaatttgtattttaataagtatttttattaggtgatttttttgttgagaatttttgagaaatgagaattttgtgttagtgttgaatggagtattatattttagagttgaagtttggtgattagttttttagatggagttggtttttggtgtatatttgggtataaatttaagttaatttaggtatatgagttgatattttaattgaaatattatttatagtttaaattttttttaatattttgtttggtatgaattttagaaagttgtaaatgttatattttttttttatttatttttggattttgttttaagattaaattttagggtatttgatagatatttattgtatatatttttttgtaaatatgaaaattgaattgtttaatagaaaagggtaaggaagtagaaaataagaaattattattagaagtggtttgttttggaattatattgtttagttgtataataaattatttttaaaattgagttgtttagaataataaatattgattttttatagtttttgtgtgttaggaattaaagtgatttaatttaatggttttgtttagggttttttgggggttgtaatttaggttttaggttgggatttttttaaggttgagttggggaaagatttatgtttaagtttatttatatggttgatggtgggatttagttttttttaggttgttagattgagggtttttgtgttttagtggttttagttagagtttttttttagtttttttttatatgggtttttttatagggtaatttataatatggtagttggtttttagtagagtaagtgagtgagagaataagaaaggtaagtaaggtgaatgttttagttttttgtaattttattttagaagtgttaatttattatttttgttatgttttattatttagaagtaaattattaagtttagtttataattagagggatggtattatataagggaatgaatattagtagatagggttattgaaagttattttagatgttgtttattgtatttaagtgtgatttttttagatgaaaagaatatattaatttgttttagttttagttgatgtgttattttatttgtgttttgttaaaatttgtattaatgtaaagtaaatattttttgatataatttaggtagtgtattgtggtaatagagattagtagtgttgaaaagatatgttgaggttagaaattaagtttatgtttttaaaagaggagatatgtataattattatgtaagttaataggaaagagtgttttaagaatgttttttgttataggtaattaaaaatttaaatagttgtggttttaaaataaaggtatatttaagttatataagtaaaagtttaggggtgggtagttgttggtattgttttagtagtttgataatggtaaaagtagtattttttttatttttttggttttttaattatgtatgttattttataattataatataggtaatattttatattttaagtaagatgaaaagggtaaagagttatgttatatgtttttgtttttttttataaggaagataaagtttttttggaagttttttttagtagattttatttagattttattggttagaattgagttatatgtttgttttaaattaattatttattaagaagattaatattattatggtaagtttaaattaattgtgatttatttttgaaattaaaggattattattattatttgaatttattaggattttgttggtagagaagtgggattgtaaattttgagtaggtaataaataagttttttgtaaattttttatgtgttgttttttatgtgttttatatatttagtagaattataatttttaataatagtttaaaaagatattttttaatagaaatagaatgtgtaagattattatttatgaaattttaaatgtatttaaggttttttttttgaaaattttttatttaaaataaaatgtttagattttgaaatttagaaaagattttatattttaaaaattttgtgtatatgtaaattgttttttaaatattgtttttagatatattgaatagaatgaaattttttgagatttattatattagttaagtattattaaaataaataggatagattgttttttttgatgtttgttgtttgatttgtgttaatttatgtttttgaaattgtagtattataagttaatgttgtataaaggtattttatgttatttataaaaatttagtaatgtaaattgttaattttttataaagtatttgttgatatataaaaatattattgaagtgtatttatgttttttttttttaggtttgtataatatttttttttagaaggttaagttgttttataaattatagaatagaaagttggttgtgggaggaatagtttaattttatttgaggtattttattttaagaaattaatggtatttatattttttgggtattgagtttttaagtttatttttaatttttgttttgtttatattttaagtgagtatataaagtgttgttttaagtaagattagtttttgtagaagggtaagtgtagttagttttttaggaaatgggattggggagtgattgttttaatgagagataaattaaattgatgttaaatatgaataatgagtttattagagattgtgagaaagaggtattattatttatttaataataggtttgtgggattttttgatagtttgaggatgtttaattttaggtgtaggtatttagaatgtagtagttagattgattaaggatgtgtgatgatagtaagtagtagtggaagagtttaggagagtttttaagtttgaattgtaattttgtgttgttataaaatgggaagatatatttggtttagttatttgatagttttggttattaatttttttattttatatgtgattttattgttttaagaatttttttagttttaaatatttatgaatttgttgaagtagttgtgttttgattgatgtggatttttgaatttttttaaatataaagattaattatttagttgagttttgttggatttagtgtattttgaatatatgttaaaatatatttggatttgtaaaaaatatttttttttgttttttttattatagatagatgtataaaaatgtttgtgtttatattgtggaaaggatattttttataaatttatatagagatattttttaagttaatgttttagaaagtaatgagagatttaaaggagatttagagatatgaatggagtaggtagagaaggtatgtgaggagaatgatgtaattttttagggaaaaagtatgaagtataaggttggatatagatttgggaattaggaaattagagttttaattgtagtttttttattgatttatttgggattttgagaatatttgttttattttaattattttgggttatagtttttatatttgttaattagagtaagagtttttggttgggtgtttaggattgtgagaatatattatttagagttataaaaatgtaattagtattaataatgtattagtattagtatttaggatgtaaaatattttagatattaggtgttttaatttaaagtggaaatattaataagagtaattttttgaattattaaattgggaatattttaggaagtatatttatttgggtgaaaattaagtaaataagataattgtaaaggtttgtgattttaggaatataaaggtaaaaatgtgtagatttgaaatatgataagttttagttttgttatttagtatttttgtgattttggataattttttaatttttggtagtatttttatttgtaaaatgggaataatgatatgtattttagtggtttgtggtgaagattattataaatagaaattagtttttttgagttattggtggggtttaaatttttagtttttatgtgttttgtagttgttagttttttttattataattgtttatttaaaaatttagttatagtttggtgtagtagtttatgtttgtaattttaatattttgggaggttaaggtaggagaattgtttgagtttaggtgtttaatattagtttaggtaatatagtgagatttttttatttttataaaaagtaaaaaattagttagtgatgtatggttgtagttttagttattttgagggttgaagttggaggattgtttgagtttaggaggttaaggttgtagtgggtagtgattatgttgttgtattttagtttggatgatagagtaagaatttgtttttaaaaaaagaaaggaaggaaggaaggaaggaaggaaggaggaaagaaaagaaagaaagaaagaaagaaagaaagaaagaaagagagagagagagagagagagagagaaagaaagaaagaaagaaagaaagaaagaaagaaagaaagaaagaaagaaagaaagaaagagaaagaaagaaagaagggagggagggagggagaggagagaaagaaaaaggaaggaaggaaggaagagagagagagagagagaaagatttagttattaaaagtaagagattttttaaatgttattattttttgggtatttattaattatattgttatgttttgtatttaagttaagtaatttaaataaattattttatgtatttttttaaaattaattattgttgtgtaaatggaggtagaaagaaattaagttttatttttgtttttattgtttttttaatttgttttgtttttttttttagttgtatttaattggttgtatttttagttttttttaaaattgttttaaattttaaagattaaagtagtaataattaattgaatatatttatataatatgttatttttgttatgttgttttttatttttggagatttgttttaaatttatttggatgtttgaggataaattatgtttattagtagtttttgaaaatgtagttttattgaaaatgtaggtatttagaaatttagtaagtaatttaaaagaaagtgtaagaattttttatgtatttattgaaaaataatttgaatttatgtttagaaaaatagaattattattaagaaattttatatatttatgtttttaaatatttttattaaggattaattgtgtatatggtgtaatattgtttttaaagaatatgttgggagaattgttgtagttattagagggttaaatttggtaaatttttttttattaatgtgttttttaattatgaaatagtatatttattttagataaaatttgaaaattatttttgtaaagtggtataatattgaagaaagttgataatttttagattagatttaagttttaaatttattttttttttatttggataatttattagtatttttgaattttatattttttttataaagtgagaatattatattatagagttgttgttagttaaatgagaatagtgtttgattataattagttaataaatgtttataatttttttttttttaggaaaagaattttaaggtagatttgttttgggtttgttttgtaaagaggtaggaattttttgtttttggtaaattgttttttaattttttttggtaatagattattttttaataaaggtgatggattattttttattatatatttaaaatgtgtgtttattttagggtagttatggatgattattgtttattttttgattttagattaagaatatttgttgtagtattttaattttgtttttaaatttttttataaaataaagatatttttaaaaaataaaattttttaggtgttttgtagttgaatgtaggaaaattagagttttttatttttgatagttttgggaagaatgtagtgttagaatataaatttataatagataaataatttgtatagaaattttataaaagtattgatttgatttgttatgtatttgttattttttaaaatatataattaaatgtttattttgtgtttagatttaaatgggtgaagaaaaatgagtgataatatatttatttaagtttatttatataattgtggttatgttgttttttttatattatattattagaatattggataataagttaagaaatagaatgttttataaaataaattttaaaaattggtaagtattatgtgttttttttagaagatattttattttgttgaattaaaggtggttttttggtattgagtagttttgtggagttatggtagtttttattttttaattttgagtttgtttgagttgttgttgttagttatttatttgttgggattttaaattgtattaaatttttttttatagttgttattgttaagtagttgtattggttttgttttatttttttgttggtaattttgtttttaattttgtgttttagtgtagtttatataaatttttatagagggataaaattttttgtaattaattgtttgggtgaatatgtatttgggagagttattgggaaaggggttaaatttgtattttagttttttttatttttatttttgagttaattaagttttgtggattttttttttagtatttttggaatttttttttttttttttttttttatgattatttttttagttttggttttttaaatttgagtgatagtaatagtttttttgttttgagtttttttttttttttttttagtgtgtatatggttgttaaatttattttgataaattattgtattgattgtggttatatttttttgtttttatattttttatagattttattgtttgtaaaataatatttagtttggttttaatttgtttttttagttttggtgatataggtttattttgtttgagatatttattatgatatttttgtttgtttttggggttttgatatatttttaatgttttattgttttttttttttaaattagttaattgtttaagttttgtttaaattttttattttatgaagtttttttgatgttttttagtatattatgatttaattttttgaagtaattatgttaattgggtatttgaagaattgttaattgattattaattaattgttttttaatattgtatgtgtagttgtttttaaaggtagttaaattatgttatgttttttatattgtattgagtgttttgtatttttatttatgtttgggggttttattttaagttaagaaatttaattatatttatttggttttttttagagttgtagtttttaattttttgtgtggtagagaaatatttagagaatatgtttaaaaatattttgggttttatttttgagagataataaggtttaaggggaatttaaatatttgtgttttaggttagtttattggtttattttattatattaattttttagaaggttaaggtgggtggattttttgattttaggtgtttaagattagtttgggtaatattgtgagattttattttttaaaaaaaaaaaaaaaaaggattagttaagtgtggtggtatgaatttgtggttttagttatttaagaggttgaggtagatagattgtttgagtttgggaagttgaagttgtagtgagttatgattatgttattgtattttagtttgggtgatagagtaagattttgttttaaaaaaataaaaatgaaaaaaatttgtgtttttaagttttaagtgatgttgatgttgttggttgtttttaagtattttataaagaatgaatttataaatgttaatatagtatatgtttatggatattgaatagtgggttttttttttttttttttttattttgtgtttatgttgtgttattttttttttttagattgattttgaagatgtgattgtagaattagaagggatatatagttttgatggtatttggaaggttagttttattatttttattgtgatgaaatattggttttattgtttgttgtttgttttttttggtattttgatggtatttatttggggtatttattttgttatttttttttttttgtatatttgggtagttgtattatgtattaagagttttttgattgagatttagtgtattagttgtgtttattttatttatgtttatattgtttgtgatttattttttgaagttgttgggaaaatatttagtaatgtttgtattaatttgtagaaagaaatataaatgatattttaaggatagaagtatatttgattttttttttttttaatttttttggtgttaattttaagttttaagttgttaatatagtaataatttatgaattgaattattttggttgaaaataaaaagattatttttttagtttttataagtattatgttttttttgagttattttatttatttttggtagtttgaatttttaaaatttatttaaatttttttttttatttttttatttgtatgtggattaattattgttttattggttgagatatgaatatattgttgaaaggtaatttgagagaaatatgaagaattgaggaggaaaaaaaaaaaaaagaaaagaattaataattttaattgtttattttaaaatgttggttattttatgttaagggaagaattttagggtatggttatggagtgtataagtatgtgggtagatttttagtaaattttttttttattgtttaaggagttagtggattattgttatttattttataatttagtaggatttagtgatttttataagttagaaaatataattttttgtttttttatgatttaattaatgttttattttttttgaaattttaatttatgatattttttgtgtttgaatatttgttatgtagataataagattttagtgtttttttgttttttatatttttttttttaaatagggtttaatttagtaatttgttttaggttagtagtttttttgaagattaaaattagaatatttatgatttagttttttatgtgtgtttttgattttgagttatagagtttggtgaagtttatttttgggttttatttggtaatatttttatttgtagtgggtatggttgatattagtttaatgaaatgaattaaagtggattaatagggttgagttttttgtgggttggtagttttggaagttagttttttttgttttttattaattgaatgaggttagtatgtttatttagttttgtttatttttaagaataattatgtttttttgaatttaaattaatttattattggggtggtttagtggtttaatattgtgtttttattttagttgattagtgggtttttaaggaggggttgtaaaatggaggttattgtgtgagtttattagagttgttgtaaatttgatttttgtttagtaaagtatttgtaattgtttgttatgttgtgatatatggtttttttttttgttaggagttttggatttaatttaagtatttttttgtttagaaagaagatgggggaggaggtagtaataaaaagattgaagtattttgttggaataagtttaaatttttttgaatttaaattgaggaattttatttgtaaatttgagttgtatagaaagttgtttggtatatttaaaagttttttattttttttgtttatattgtgattttgtttttggggattttttttaaatttttagttatgattttttttttatatatttattggaattttgtttgatttttgttttttttagtttttttgatattttaattattaatttgttatttattttgattttttgtatttaaaatagatattggtatggatatagttttatttttaaattgtgtatataattgaaaatgtgttatattgtatattttttaaatgtaaagatatttttatttttatatgaagaaaattatttaggaaatggttttgtgatttaatttgtaaattgtgtattttaagatatgtttgttttatatagatgtttagttttttatgtaaattaattattggtttaaaagattgttgaaattttatatgtttattgatatattttataattttttattatgtatgttttgtaaaggttataagtttgtataataaaaatgtttaatggttaaatagttagttttattatttttttttaaaataggtgtttatgtgttagagtttgtgtatgtttatgtatttgtatgtaatgagtatgtgtatagtgtgtgtatgtgtttgtatgtgtttgtggggggtaatggttttttattttaaaattattataaagttatttaggatatttttgttaaggttattattatttatga

SEQ ID NO: 30 - DNA, 16293 bp, Homo sapiens
ttattttttatgttagtttgagattttattttttttgtaattttttggagaagataatttagggaaagattgttattgtttagaggaagtattttaaattttttattggtttaggaatttaatattatcgagtaacggttttagaaggtaaggcgattgttaggaggaattaaataggttagtgttggatttagttatttagttttggtttatatagaggttgttttttatgtttttttattttgttaatttggtttgttttttaaatatgggttaaataatttttttttagaagcggtagtagtagaaggaaatgttattaaaaatgagtttgttagtgggaatggtgtgtggatgaagtttttgggagttttggttgttaaataaagattttattgttatttttttttttttaagtttttttttttttttttttttttttttttttttttttttttttttttttttttttttttttttatgatttgtttttttttttttttaagttaatttttttattttaataggatttggtggaagaaaagttaggtaaatataagtacgtatatattattgggagattagattttttagttggttttttgttgttatagtttcgtcgaagggagggggtggaagaggaggattaaatttagagttgagaggagaggtaggtgtgtgtaggtaagtttagttgggagatgggtaggagattgggaagaattttttatttagtaagttttttttagttttgtttatttattgatttagtttttatttttttattttttttttttttttatttttttttttttttaaatgagtttaaatttagtttttttaattttttttttatagttttttttttttttttttattattttgtatttttatatttgtttattgtaaaagttaagtttttttgttgtagatgtttgttgtagtatagagagttacgttgtataaagtgtttttatagattaggtgtttttatagaaattggattttagaatttatttttttgtattttttgtgtattgttatatattgtggaagttatatatattatacggaggttgtacgtttattattattattttatacgattatataaaatgaagatattttgtttatttatttttgttttttgtatttgatatgtagagttagattatattattattagatattagtagatatatatatatatgtatgtatatatgttttttgtattttgtttttcgtttttttatatatatttttttagttgtaagagtaaagataaagtacgtttttttattgagatggtagagttagaagaaaattttgtattttaagtttaggtcgaatagggaggagataagtaagagcgggagttggaagggtttttttattatttagggttttattgggtaggagggagagaaaaacggttttttttaatttgtatagtgtttttttagtagtttttaatttttgttttattggtttaaattatttggtttttggaaagaaagaagaaagcgatttagtttttaatttttgaaggttttaatttttagttttggggatagtttatttttttattttttttttttgtaggtagttagaaaaatatttttttttaaagtcgttttgaaattattttaattatttaggttggtaaaaggttttgtggtagaggagaaaaaaaaaaaaaggtagtagttttttaagtagttggggaggggaaaattgaagggcggttttttttttgtttttttgtttatttttttttattaatagagagggtttgttttaaggtaggcggggtgtagggagattaggggttttatatatagttgatttttatagttatttaagggttggagagggaggagtgtggagggtttattaaaaatatagatgtcggtttttattgtagatttattgaatcgagatttaggaattttgttttaatattttaggagattttgatggtttattagggttcgagaattaggggtttgagagagagttttgttgtaatttttaagtttaagatttcggtagtgttagttgggtagaaggattgtgttttggaaaaggagtattagagtgttttaaataggttattttttttttggggagtgggagtaaatagggaagagttgttttttttttttttttttgtaagtataagtagttatatatattatagaggaatattttagtaagaaagtttttttaagatggttttatagagtttttgtttttttttatttgttaatttgtttgttttaggattttaggagtatgtgttgggttttttttttgatttttataggtttttgttttttttttttagtagttatttgtttgggtttttatagagggtgagttgaatattttttttatgttttttttatttttttagtgggtaattttatttattgggtatgtgagtgaagtattttaaggttggaaggggtaaaaagttgggagaagttaagaatcgtagtggaattttatggtttattgaggaaggtagatttgtattttttgtggttagtgtttttttatttgttgtagaaagtatcggtgagaagttggtgaattagaaagatagaataagttttttttaggtggttggggatttttagagtttttttagttagttgtttttgagatttaagtgtgattttataagttataaaggggaggaagttgttttgtgtggaagagttggtattttatttataaggatttttgttttcgagtagtgtatgggggttgttttttagttaggttggagggaaggagattttattattttgaaataatattaataagattttaatatttagaaaatatttattttgtatgtattaatttatttaatttttaaaatagaaaagaaggtgttagtatttttattttatagagtagaaaagtaattgttttgtttaagtttatttagttaagtatttgaatgaagaattgtaggattgggttttagatttataattatttaaggtattagatatatttttttaggttttttttaaggtttggagatgttgggggaatggggtagaggatatggtaggtggcgggttgttagagaagagtcgttttattttggttttttttttatcgtttagaatggaaaatttttttttttaaattagtggtttgaggttagaaaatttttattttgtttatattttgttttgtggtagatattggggagatagatggtttttttataatagtgttatttttatttttagtattttttgatttgtagtgtattttaaagttgttaattgtatttgtttttgataattgggtaaggaatataggtatagggaagatttttttatttttattttatagataagaaaattgaggtttagaatagggttcgtattattaggtagtggtggaggggtgagaatttttttttttaattagtatgtattataggttttttttttattgttttaggtaagtttatttttgtatcgttttatttttttagaaaggggtattttgaagttattatgtttttataaggtttttttgttattttaggattatattagttttaatgggggttttgaaagggttttaggtttatttttttattaattttgtttataaattggtaaagattgtttgattttttttgtttttaatatttttttggattataggaagagatatagagagtaggatggtttttagatatttaggttgagaatagaaagaagggaaaaaagagagaggggtgtttcgatatttatcggtatagcgttaggttagaagtagttttattttttattgtagggtagttttgggttaaggtatggaggtttaggggtgattaattagataggagatttgataagtaagaagaatgttagtttagagtgcggcgtaattttgttgttagttttgtttagttttgggagataaatttaattttatttttagtttaattttaatttttttatataaagttaattagttttaaatagttgtttttaatgatttgattaatttattaggatttttatttaattttgttttgagtagaaatattttattatttttgggttttaatattaaattaatgagagagatagggaagggggttattttattttaaaaattaaggagtttttggggcgttgtggtttatgtttgtaattttagtattttgggagattgaggaggatagattatttgagtttaggggttggagattagtttgggtaatatggtaaaattttatttttataaaaaagataaaaattagttagttgtggtagtatatgtttatagtattagttgtttaggacgttgagatggaaggattatttgagtttagggaggttaaggttgtagtgagttgtgattgtattattgtattttagtttggttaataaagggagattttgtattattaaaaaaaaaaaaaaaaaaaaaaaaaaaaaattaaggagtttttttagagaatttgttgtttataaataaataaatgagtaagtaagtttttgttatttgtagagattttgtattttataatatgtttttaaatgtatgattttatttgatttttatatagatgaggagttcgggttggagagttagagttaggagttaagtttagatttataatagttggaattgaaattagaatttaaaatttttttagaggttgggtgtagtggtttatatttgtaattttagtaatttgaaaggtcgaggtgggaggattgtttgagtttaggagtttaagattagtttgagtaatatagtgagatttttattttatttttgtttaaagtgaaaaaagaaaaaaaaattaagatttttttaggaaacgttttttaatgtggagagtgaatgttgggttgggtaaagtaattgtttttttttttcgtgaagtagtagtttttttagaattgatggtggagagtagaattgtatgtagttggttgttgtaggtggttaataaatttttattgattgagtaatgagtagagtttagtagaaagttgtgggtggagaagtgtatttgtgaaagtataagaaaaatttaaaaatatatatatggatttattttaaggaattttatgattggatagaagtttttagaaggtaggagtatagagtgtgggtttgaggttttgtaggagggattatgattatttatggagtttaggtatttttagtttgttatatagattttggttttagagatttaggatattacggagtattgttagagagaatggttgtgttgttagttgttagaattttttattttgttttatggtaaagtttcggtaggaaggggtattattttatgagaaaagttttagaaatgaatgttatttttttaagagagaagtatttttgtatttggaatggttttgatttagttttggggttgagggaaggggaggagagtaggtttagtttttttatataatttgtttttgggagtattttttggggaattttttgttggttttgggagtagtttggttaggtttagaggtttggaatgtaaacgggttagaggattagtgaaaagataagtttttaaagggtttggtgttgtatatggggatgaggaaggtttgtgtttattgtggatgagaaggcgcgtatagttagtttgttgggtggagttgtgagtaatttgtttgttttttttatttttgataatgaagattagggttgttttggtattgagttaaggaaatttcgtttcgtttagtataggttatagttatagtgttttattgtttttgttggaagttttgggtaaattggtgtttagtttttggtatatgttttcggtgataaaggtaatgaagggatatagaaaaattttcgttagtgttgggagtttttttgggatagggttttttatagtatgaaagatttttagattatttttaggtttttgggtgattagaaaataaatttttttttttaaattagggttataaaaattgaggtttttagaaatgtttgttttagaatattaatgttttaattatttttttaatttatatgtaagatgattgttttgttttttagaaaattatagaatttatataatgttaatttatagtttattaattataagtgaagtggggtttagttaataagatttaagtttaaagttttgtaattaatgttttttttttttaatttttgtaatgtatttttgataatgttatatttttaacgggagattaagttaaaaatttaattgtaaggttttttgtgataggaggttagggaaaatggttttttagatttttttggagaggtttgttttggaagagattattttagagggaggtggagaaagatagtttttgttttttttttttttcgttttttttttttttttttaatatttagtgtattgcgtatgggtttatatacgtatatagaggataagtgagtgagtttgtttatgtgtatgggatttgaagaggtgtgtgtgtgagtgtgtagattggatttgttgttaaatagtattttggttttggcgagttattttttttttttagtttttagtttttgtaaatggtggggtttggagttgattggtggattttaagttatttttagtaaagaaacgtgttttttgttttttaataaatgaatgtttcggttaaattttaatatatataataggtttttttaaagagagttgttgaggttggtatagggatgggttgagggtattttagggttatttttttagttttttttttataggggtatgttatagaaatgaaagtagagttggaaaattattaggttataggatttttaaggatttttttggatttaattaggacgttaaggtttatatattttaatattttttttatgaagatattgatgatttttttatgttgtgaatgggaggattgagggttagagtggttaagggttttttttgataagttttaggatttttgattcggagtttagtgtgttttttttttttttttttttttttttgagaaagagttttgtttttgttgtttaggttggagtgtattggtgtaatttcggtttattgtaattttttttttttgggtttaagcgatttttttgttttagttttttaagtagttgagattataggtgtttaatattatattttgttaattttttgtatttagtagagatggggtttttttatgttggttaggttgatttcgaatttttgatttgaagtgatttattcgttttggttttttaaagtgttgggattataggtttgtatgttattgttttattagttttaatgtgttttttttttttttttttttttttttgagatggagttttattttgttatttaggttggagtgtagtggtgtaatttcggtttattgtaaatttcgtttttcgggtttacgttatttttttgttttagttttttaagtagttgggattataggtattcgttattacgtttggttaattttttgtatttttagtagagatagggttttatcgtgttagttaggatggtttcgattttttgattttatgatttgtttattttggttttttaaagtgttggattataggtgtgagttatcgtatttggttattaatgtgttttttattagtatgtttttcgttttttttagagtaggtttaatatatcgagtggttaagttaatggttagggaatttagagttttaagtttttgttatttttttatttgttgggtataggtaaataaggagatgtttttatagttttttgagttttgtttattttttttagagttttagttttgtttaattttggttttaaaaatatgataattagttattgagggtttaaggataatgattttatgtgttttttttttgtaggtgtattatttggattatgaggttatttttttgttggttttttttattttttattttggttttagtggtttaaggttagttaataagacgattaagattcgggattgggttcgggcgtagatttaggtttaggtttaggtttatatttagttttttttagtttgatgaattagtagagttaatagatttgtttttttttttttttttaggttttttatttattttttttgattgttttcgcgaatgttattgtttttttgattttttatttgttttttattgtgatagtcgtaatttgcgaaaggtttttgttatttcgtttcgtatttattatttttatttttagaataattttattattgagttttcggtggagtttttttagaatgttataggtttgcgatggattaatttggataataatcgaattcgtaagatagattagagggtgttggagaaattgttcggtttggtgtttttttatatggagaagaattagttggaagaggttttttcggttttgtttcggaatttggagtagttgaggttgagttagaattatatttttagaatttcgtttggtgtttttagtaagttggagaatttgttgtttttggatttttagtataataggttgagcgacggcgtttttaagttcgatattttttatggttttaagaattttatgtagtttaatttggtttataatattttgagaaagatgtcgtttagggtttttatcgttatttattagttttatttggatagtaataagattgagattatttttaacggatattttaagagtttttttaattttgtttttattcggtttaattataataagttgatagataggggattttttaagaatttttttaatatttttaatttgtttgtgttttatttgttttataataggattagtagtgtgttcgttattaataataggttggaatatttgtattttaataataatagtatcgagagtgagtggggtgggtcggggcggggtcgaaggtaaggaggttggtttgtgtagtatttttattttttttagggagatttagggtggggtggtataaaaagtatttattttggtattggattttaatttatggttttgttatttgttatttgggtgattttgaaaagatatttgattagtttgggaagtttttttatttgtaaagtgagaatggtaataatattttttattataaaggtgatatgaggatgtaatagtttaatatggagaaagtgtttagaatattatatttggagggttataggttttttttttttatttttttttagttttagttttttggtaattggatttataggtagggtagatatggaatatatttttggatattttgttaaaaatagaatagagatatttaaatatttattttgaaatgttttgggtttgttttttgtagaaatttgtttttgtgggaagatgtttttttttaagtttgagtttgggttttgatttagggtatgtaattggtaaaaatgtggtagttaggaaaagaaggtttgtatgttggtgttttttgaatttatttggaagggtgcgatgtttaggtgtatttaaggaagagtttgtttaagtgatatttatagggttttggatttggagtattaattgtagtttaggagaggaggttggaagttgtagttttgttttaattaaaaattttagttcggagtagagtattagtagaaaggtttagaagtgaaataatattttttggtttttgaataaaattagtttatatttatagaagggatgtagtagtagaagggaagagagggattgagggaaaagagaaggatttttagaatgatatttggggatttttaggttttaaattaaagaatgagatggagattgttggtgtttttatcgatattaataatgggcgaatagatcgtttatttatttgggataattttaagaagtaggggaggattttttttttaattttataaaaaaaaaatgggaaaaggggaagattgtataattttattttggagatagtatattaaaataaaatatattatttttaggaagttatgaggttaaaatatagatagaagggatattttgattaataaatggttgataggtttttattagattgtggaagaataggttgttggaggatattttaattttttaaggttgaagttagagaatttatattttatttatatgagtttattttatttagtttgttttttgtgttttttattcgatagaatgggttgagtggggtttaggttagtggggtgattacgttttttataatgattataatgttgttattggtattgtttttaaatagtttataaaatgtttttgttaatatttttttttttgattatagggtaggtattatttttattattttatagattgaagaatttagtatgagggtggttaggttatagttttaagtttataagagaaaattttcgtgttagggtttttttgttattttaatggtaaagaagaaagacgaggaaaaggaagaggaagataattataatgaagatgatgtttattttttttttttttgtttttttataaatgataagtgaggtaaggtttagggagaataaaatagtttatttaaatgttggtatgtttggtgttataggtatttaataagatgtgatggaggaaatggaattttaggttatggattttttagaattagtaggtttattatgtttcgggggtttcggagttttttttagatttttttttttttttttgttatttttattttagttattattttttgtttatttttatgttttatatttaatttaaaggaaaatttgtagagtaatttttatatttatttattggttttagattttattttattttattgtttttttatagtgtagtcggattatttttgtatagtataaatttgaatatagggatttttaaggatttttttagatttaacgttttaggatattatggtttaagtattttgttaataatatcgtttttataaagatagttttgtttattgttattttttagattagagattaaaagttttttagtgaaagtttaattatttttttagtttattttttttagtatattatattgggtattattattatttttagattcgtttataagtagaattttggtttttataattttatttaaatagatttttttattagaatattattttttaggtttttatttgttgtaattttatttatttttgaaggtttagtttaaaatttatttttaattttttagagttaatttgtaataatagttgttgattaattttaatttaatttattttataaatgagtaaattgagtttggaggttaaggtagtttatttatgattatatatttttaaagttagttagttttagagagaagtttatagtttttgttttcgggtgtttttttttttttttttttttattttggtcgttagtttttatttttttttgatttttcgtttttttttttcgtagaaattaacggaatttagatttgttttaacgatttagtggcgttttatgattttttttcggatttggagaacgtgttatatttgcgttatttgcggttggatggaaattatttgaagtcgtttatttcgttggattttatgatgtgttttcgttttttgtagttcgtggttatttaggttttatttcgttatcggatttgttttgatcgtatttgaaggttggggtttaggtatttgtgtcggttattcgtttttttttttttttttttttttttttagttttgttttttttattttattttcgaggtagggaaaagttatttatttttttgtagttttaggagcgagattttaaggatttagtttggttttatttagttgaaagatatttagtgtatatttaaatttttggttttttgtggtttttttttgttttagaaatatagatgtgtttaaagatttggtgtttttttttttttttttttttattcgttatttttgggtatatttgggtcgtggattatttgattttggttttggtcgagtaaatagttcggaggtaaggtttagaaagtttttttggggatttttttattttcggtagttttggtttaaagaggtcgagaaatttagtttttttgggttaaggattttttttggtaaagttgttgtttcgtcgtttggtttttcggtattagatatcgttttggttttgttggttcgggtatcgggaaggaggagcgagggaatgacggaggtagggtgtagggttagggttttcgtaggggtttgtatttggttagtaggatatagggatgcgtagggcgtttttttttgttttagggtgaatatagtatacgtttttttggttgggttttaggaggaatagttaaggagaagaatggtttaaggaattaggaagtagttatgggagaggggaagggtttaagttcgggatgggttcgcgtgacgtcgatgggttttgcggtttttttgtttaatttcgggtttagggaggagggtttatagtgtttttgtgggggcgggggaaggaagaggtagtttcgttttcgttatttgttttttattagtgtgcgcggtttagttatttttattttcgggaggcggtttttgagaaatagggaggaaggggcggagtatttggacgttttttagaagtttttttacgtttgaaaatgcgtttttttttcggagatagacgtatcggtgttatttagtggttggtgggagtaatagttggttttagttttgcgtttggttttttttttggggtgatttttttcggtggaggaggttcgtggggttttaatacggaagagttatgggtcgtgtgtatggtgtcgtttttttttagggtttagcgggtataaacgtttttaggttgggtttatttttatcgtgagtgagtttaggtgaggatatagtcggttttcgtttgttgtaggttttttttaggtgtttttttagtttttttatttgtaaatcgaggaggtggataagatgttttcggtcgggcgcggtggtttacgtttgtaattttagtattttgggaggtcgaggcgggtagattattgtttgagtttaggagttcgaaattattttgggtaatatggtgaaattttcgtttttattaaaatataaaaaaattagttaggtatagtggcgcgcgtttataattttagttattgggaggttgaggcgggagaatcgtttgagtcggggaggcggaggttgtagtgaggcgagattgtgttattgtattttagtttgggcgatagagtgagatttcgttttaaaaaagaaaaaaaaaagatgtttttttgaggttttttcggcgtttatgtttcgagtttgtagttttatattttaaattatattcgaatgtaggataagttttaaatatttgtttttttttttgtagtaatttattttttgtatggattgttttttttttagaggtttttttattttttattgtttggtttaggtgagtagtttggtaggtttttaagtggaattcggtttagatagggttgtttcgattttatttttttttttaattttttttaagggatgttgtttttttttagttttttgcgtgtgtatattggtgggaggtatagaggatggatgttttagaaatgagtaagatatagtgtttatttttaagttaggatgaaaaaagttttagaggtttttaagaaattggattaagttgggtttttaattttaagaaatttttattatgtttttttttattttttttttttgttaattatggaaaatagggtttattttattatagtttttttttttcgtgttttattataatcgtcgtattttttttagttgtagttggtttttttaaggtttttgtttaaagtttatacgttattatggtcgaaagtaatttggtgtttcggtttggataagagttttttttgtattttatttatagtttgtagttttagtttttttgatgaggtttttaggggagaggttattattttgattttgtaaatttagattcgttgagtagtaacgtaattattattattttattgtttaatttagaatatgtttgtttttttttgttttttgtagttgtaagttagaggggatttaaggtaaataggttttataggttttttttttttaaatatatatagaatgggttggttttttttaagtttaaaaaaagtttttttttttatgtataagtttattttttttatgttgtcgttatcgatatatataggtgtgtacgtaggtgtatgtgtgtattttgtacgtatattttttttgttttgaagattttgttaattttgtgaaataatttttatattttaatatattttatagtataggaaataaagtaatatgaaaaatattttgcgtgaatttaacggtgtgaataggttaagaataatattttaaagttattttgttagttaggcgtggtggattacgtttgtaattttagtattttgggaggttaaagcgggtagattatttgaggttaggagtttaagattagtttggttaatatagtgaaattttttgtttatttaaaatataaaaattggttgggtgcggtggtatatgtttgtagttttagttatttgggaggttgaggtaggagaattgtttgaattttggaggtagaagttgtagtgagtcgagatcgtattattgtattttagtttaggagataaaacgagattttatttaaaaaaaataaaaataaaaataaaaataaagttattttgttatttattttttattattgagttattatgtttagttttaaagttttttaattgttttaataagatgagtggggaaaagattatatttttaagaaatttttacgaaagttatttaaaagtttttttttttttttttttttattatttttaaatagaggtagggttttattatgttgtttaggttggtttggaatttttggttttaagtgatttttttattttggtttttttagagtgttgggattatatacgtgagttattatgtttagttttaaagttattttttgaagaatttttcgtaaatttataatttttatgaaaaattaatttttagttttacgagattgtttatttatagataaaaaaatatatatatttttaaagtcggattagaaatttgatagttgtttttgaaatttaaagtttcgggtttttttaagttatatgtattaaattgtcgaaggttttttaggagttttgtattgaggtagatatagaaagatataaaacggtcgttttttttgtttaagtaaagtttatagattaattggggagatgtagtgtgtatataaaatagtaaaagagttattttaaggatagagagtatagattaagttatttggaatggtttatatgttatgcggaagtttatcgaagggttagaatagggtgttttagatttttttttttgagggaaggttggttgtaaaagtgggatttatgatttttttaggttatattattttttttagaatgagaattgttaggtgacgttttcgttgtttttatttggttattaaatatcgatttcggtttattttacggatgtttagtggatatcggttatatgttaggtttttagttacgtatttaaggatggataatatatatagtagtatatttttgaggaatttatattttggtaaagggaaagaaatttatgaatggatatttttgtgttttaagtgtttgtaataatgttgtgtgttaggtttttgagtttaagttaagttattatattttttgtgatttgtatgtgtatatttagacggttggtttttattttaattgatgatattttattataaaagaagtgaaaatggttggtttttgttttaattgatgatattattttgtgaaatttttttttttggtttattttggtttaaaagtttttttattgaatattttgtaatttttatttttggttattagagaataattttttttgattgtaattttttattatttatttatattttataaaatggttttatttttattttttttcgttgatttttttcggatttagttcgtttgtatttaggtgaaataaatagttttgttgtttatataaagtttgtttggtggtcgttttatatagatacgagtgaaattattgtgtatgaatagtataaaggaaagggtttttatttttatttgaggaaaattagaaagatttttattatgtgagttggtttttaagggataaattagattttgttaggtggatgaaagaaaaaaagacgttatttggataggaaatagtatga

SEQ ID NO: 31 - DNA, 16293 bp, Homo sapiens
ttattttttatgttagtttgagattttattttttttgtaattttttggagaagataatttagggaaagattgttattgtttagaggaagtattttaaattttttattggtttaggaatttaatattattgagtaatggttttagaaggtaaggtgattgttaggaggaattaaataggttagtgttggatttagttatttagttttggtttatatagaggttgttttttatgtttttttattttgttaatttggtttgttttttaaatatgggttaaataatttttttttagaagtggtagtagtagaaggaaatgttattaaaaatgagtttgttagtgggaatggtgtgtggatgaagtttttgggagttttggttgttaaataaagattttattgttatttttttttttttaagtttttttttttttttttttttttttttttttttttttttttttttttttttttttttttttttatgatttgtttttttttttttttaagttaatttttttattttaataggatttggtggaagaaaagttaggtaaatataagtatgtatatattattgggagattagattttttagttggttttttgttgttatagttttgttgaagggagggggtggaagaggaggattaaatttagagttgagaggagaggtaggtgtgtgtaggtaagtttagttgggagatgggtaggagattgggaagaattttttatttagtaagttttttttagttttgtttatttattgatttagtttttatttttttattttttttttttttttatttttttttttttttaaatgagtttaaatttagtttttttaattttttttttatagttttttttttttttttttattattttgtatttttatatttgtttattgtaaaagttaagtttttttgttgtagatgtttgttgtagtatagagagttatgttgtataaagtgtttttatagattaggtgtttttatagaaattggattttagaatttatttttttgtattttttgtgtattgttatatattgtggaagttatatatattatatggaggttgtatgtttattattattattttatatgattatataaaatgaagatattttgtttatttatttttgttttttgtatttgatatgtagagttagattatattattattagatattagtagatatatatatatatgtatgtatatatgttttttgtattttgttttttgtttttttatatatatttttttagttgtaagagtaaagataaagtatgtttttttattgagatggtagagttagaagaaaattttgtattttaagtttaggttgaatagggaggagataagtaagagtgggagttggaagggtttttttattatttagggttttattgggtaggagggagagaaaaatggttttttttaatttgtatagtgtttttttagtagtttttaatttttgttttattggtttaaattatttggtttttggaaagaaagaagaaagtgatttagtttttaatttttgaaggttttaatttttagttttggggatagtttatttttttattttttttttttgtaggtagttagaaaaatatttttttttaaagttgttttgaaattattttaattatttaggttggtaaaaggttttgtggtagaggagaaaaaaaaaaaaaggtagtagttttttaagtagttggggaggggaaaattgaagggtggttttttttttgtttttttgtttatttttttttattaatagagagggtttgttttaaggtaggtggggtgtagggagattaggggttttatatatagttgatttttatagttatttaagggttggagagggaggagtgtggagggtttattaaaaatatagatgttggtttttattgtagatttattgaattgagatttaggaattttgttttaatattttaggagattttgatggtttattagggtttgagaattaggggtttgagagagagttttgttgtaatttttaagtttaagattttggtagtgttagttgggtagaaggattgtgttttggaaaaggagtattagagtgttttaaataggttattttttttttggggagtgggagtaaatagggaagagttgttttttttttttttttttgtaagtataagtagttatatatattatagaggaatattttagtaagaaagtttttttaagatggttttatagagtttttgtttttttttatttgttaatttgtttgttttaggattttaggagtatgtgttgggttttttttttgatttttataggtttttgttttttttttttagtagttatttgtttgggtttttatagagggtgagttgaatattttttttatgttttttttatttttttagtgggtaattttatttattgggtatgtgagtgaagtattttaaggttggaaggggtaaaaagttgggagaagttaagaattgtagtggaattttatggtttattgaggaaggtagatttgtattttttgtggttagtgtttttttatttgttgtagaaagtattggtgagaagttggtgaattagaaagatagaataagttttttttaggtggttggggatttttagagtttttttagttagttgtttttgagatttaagtgtgattttataagttataaaggggaggaagttgttttgtgtggaagagttggtattttatttataaggatttttgtttttgagtagtgtatgggggttgttttttagttaggttggagggaaggagattttattattttgaaataatattaataagattttaatatttagaaaatatttattttgtatgtattaatttatttaatttttaaaatagaaaagaaggtgttagtatttttattttatagagtagaaaagtaattgttttgtttaagtttatttagttaagtatttgaatgaagaattgtaggattgggttttagatttataattatttaaggtattagatatatttttttaggttttttttaaggtttggagatgttgggggaatggggtagaggatatggtaggtggtgggttgttagagaagagttgttttattttggttttttttttattgtttagaatggaaaatttttttttttaaattagtggtttgaggttagaaaatttttattttgtttatattttgttttgtggtagatattggggagatagatggtttttttataatagtgttatttttatttttagtattttttgatttgtagtgtattttaaagttgttaattgtatttgtttttgataattgggtaaggaatataggtatagggaagatttttttatttttattttatagataagaaaattgaggtttagaatagggtttgtattattaggtagtggtggaggggtgagaatttttttttttaattagtatgtattataggttttttttttattgttttaggtaagtttatttttgtattgttttatttttttagaaaggggtattttgaagttattatgtttttataaggtttttttgttattttaggattatattagttttaatgggggttttgaaagggttttaggtttatttttttattaattttgtttataaattggtaaagattgtttgattttttttgtttttaatatttttttggattataggaagagatatagagagtaggatggtttttagatatttaggttgagaatagaaagaagggaaaaaagagagaggggtgttttgatatttattggtatagtgttaggttagaagtagttttattttttattgtagggtagttttgggttaaggtatggaggtttaggggtgattaattagataggagatttgataagtaagaagaatgttagtttagagtgtggtgtaattttgttgttagttttgtttagttttgggagataaatttaattttatttttagtttaattttaatttttttatataaagttaattagttttaaatagttgtttttaatgatttgattaatttattaggatttttatttaattttgttttgagtagaaatattttattatttttgggttttaatattaaattaatgagagagatagggaagggggttattttattttaaaaattaaggagtttttggggtgttgtggtttatgtttgtaattttagtattttgggagattgaggaggatagattatttgagtttaggggttggagattagtttgggtaatatggtaaaattttatttttataaaaaagataaaaattagttagttgtggtagtatatgtttatagtattagttgtttaggatgttgagatggaaggattatttgagtttagggaggttaaggttgtagtgagttgtgattgtattattgtattttagtttggttaataaagggagattttgtattattaaaaaaaaaaaaaaaaaaaaaaaaaaaaaattaaggagtttttttagagaatttgttgtttataaataaataaatgagtaagtaagtttttgttatttgtagagattttgtattttataatatgtttttaaatgtatgattttatttgatttttatatagatgaggagtttgggttggagagttagagttaggagttaagtttagatttataatagttggaattgaaattagaatttaaaatttttttagaggttgggtgtagtggtttatatttgtaattttagtaatttgaaaggttgaggtgggaggattgtttgagtttaggagtttaagattagtttgagtaatatagtgagatttttattttatttttgtttaaagtgaaaaaagaaaaaaaaattaagatttttttaggaaatgttttttaatgtggagagtgaatgttgggttgggtaaagtaattgttttttttttttgtgaagtagtagtttttttagaattgatggtggagagtagaattgtatgtagttggttgttgtaggtggttaataaatttttattgattgagtaatgagtagagtttagtagaaagttgtgggtggagaagtgtatttgtgaaagtataagaaaaatttaaaaatatatatatggatttattttaaggaattttatgattggatagaagtttttagaaggtaggagtatagagtgtgggtttgaggttttgtaggagggattatgattatttatggagtttaggtatttttagtttgttatatagattttggttttagagatttaggatattatggagtattgttagagagaatggttgtgttgttagttgttagaattttttattttgttttatggtaaagttttggtaggaaggggtattattttatgagaaaagttttagaaatgaatgttatttttttaagagagaagtatttttgtatttggaatggttttgatttagttttggggttgagggaaggggaggagagtaggtttagtttttttatataatttgtttttgggagtattttttggggaattttttgttggttttgggagtagtttggttaggtttagaggtttggaatgtaaatgggttagaggattagtgaaaagataagtttttaaagggtttggtgttgtatatggggatgaggaaggtttgtgtttattgtggatgagaaggtgtgtatagttagtttgttgggtggagttgtgagtaatttgtttgttttttttatttttgataatgaagattagggttgttttggtattgagttaaggaaattttgttttgtttagtataggttatagttatagtgttttattgtttttgttggaagttttgggtaaattggtgtttagtttttggtatatgtttttggtgataaaggtaatgaagggatatagaaaaatttttgttagtgttgggagtttttttgggatagggttttttatagtatgaaagatttttagattatttttaggtttttgggtgattagaaaataaatttttttttttaaattagggttataaaaattgaggtttttagaaatgtttgttttagaatattaatgttttaattatttttttaatttatatgtaagatgattgttttgttttttagaaaattatagaatttatataatgttaatttatagtttattaattataagtgaagtggggtttagttaataagatttaagtttaaagttttgtaattaatgttttttttttttaatttttgtaatgtatttttgataatgttatatttttaatgggagattaagttaaaaatttaattgtaaggttttttgtgataggaggttagggaaaatggttttttagatttttttggagaggtttgttttggaagagattattttagagggaggtggagaaagatagtttttgtttttttttttttttgttttttttttttttttttaatatttagtgtattgtgtatgggtttatatatgtatatagaggataagtgagtgagtttgtttatgtgtatgggatttgaagaggtgtgtgtgtgagtgtgtagattggatttgttgttaaatagtattttggttttggtgagttattttttttttttagtttttagtttttgtaaatggtggggtttggagttgattggtggattttaagttatttttagtaaagaaatgtgttttttgttttttaataaatgaatgttttggttaaattttaatatatataataggtttttttaaagagagttgttgaggttggtatagggatgggttgagggtattttagggttatttttttagttttttttttataggggtatgttatagaaatgaaagtagagttggaaaattattaggttataggatttttaaggatttttttggatttaattaggatgttaaggtttatatattttaatattttttttatgaagatattgatgatttttttatgttgtgaatgggaggattgagggttagagtggttaagggttttttttgataagttttaggatttttgatttggagtttagtgtgttttttttttttttttttttttttttgagaaagagttttgtttttgttgtttaggttggagtgtattggtgtaattttggtttattgtaattttttttttttgggtttaagtgatttttttgttttagttttttaagtagttgagattataggtgtttaatattatattttgttaattttttgtatttagtagagatggggtttttttatgttggttaggttgattttgaatttttgatttgaagtgatttatttgttttggttttttaaagtgttgggattataggtttgtatgttattgttttattagttttaatgtgttttttttttttttttttttttttttgagatggagttttattttgttatttaggttggagtgtagtggtgtaattttggtttattgtaaattttgttttttgggtttatgttatttttttgttttagttttttaagtagttgggattataggtatttgttattatgtttggttaattttttgtatttttagtagagatagggttttattgtgttagttaggatggttttgattttttgattttatgatttgtttattttggttttttaaagtgttggattataggtgtgagttattgtatttggttattaatgtgttttttattagtatgttttttgttttttttagagtaggtttaatatattgagtggttaagttaatggttagggaatttagagttttaagtttttgttatttttttatttgttgggtataggtaaataaggagatgtttttatagttttttgagttttgtttattttttttagagttttagttttgtttaattttggttttaaaaatatgataattagttattgagggtttaaggataatgattttatgtgttttttttttgtaggtgtattatttggattatgaggttatttttttgttggttttttttattttttattttggttttagtggtttaaggttagttaataagatgattaagatttgggattgggtttgggtgtagatttaggtttaggtttaggtttatatttagttttttttagtttgatgaattagtagagttaatagatttgtttttttttttttttttaggttttttatttattttttttgattgtttttgtgaatgttattgtttttttgattttttatttgttttttattgtgatagttgtaatttgtgaaaggtttttgttattttgttttgtatttattatttttatttttagaataattttattattgagtttttggtggagtttttttagaatgttataggtttgtgatggattaatttggataataattgaatttgtaagatagattagagggtgttggagaaattgtttggtttggtgtttttttatatggagaagaattagttggaagaggtttttttggttttgttttggaatttggagtagttgaggttgagttagaattatatttttagaattttgtttggtgtttttagtaagttggagaatttgttgtttttggatttttagtataataggttgagtgatggtgtttttaagtttgatattttttatggttttaagaattttatgtagtttaatttggtttataatattttgagaaagatgttgtttagggtttttattgttatttattagttttatttggatagtaataagattgagattatttttaatggatattttaagagtttttttaattttgtttttatttggtttaattataataagttgatagataggggattttttaagaatttttttaatatttttaatttgtttgtgttttatttgttttataataggattagtagtgtgtttgttattaataataggttggaatatttgtattttaataataatagtattgagagtgagtggggtgggttggggtggggttgaaggtaaggaggttggtttgtgtagtatttttattttttttagggagatttagggtggggtggtataaaaagtatttattttggtattggattttaatttatggttttgttatttgttatttgggtgattttgaaaagatatttgattagtttgggaagtttttttatttgtaaagtgagaatggtaataatattttttattataaaggtgatatgaggatgtaatagtttaatatggagaaagtgtttagaatattatatttggagggttataggttttttttttttatttttttttagttttagttttttggtaattggatttataggtagggtagatatggaatatatttttggatattttgttaaaaatagaatagagatatttaaatatttattttgaaatgttttgggtttgttttttgtagaaatttgtttttgtgggaagatgtttttttttaagtttgagtttgggttttgatttagggtatgtaattggtaaaaatgtggtagttaggaaaagaaggtttgtatgttggtgttttttgaatttatttggaagggtgtgatgtttaggtgtatttaaggaagagtttgtttaagtgatatttatagggttttggatttggagtattaattgtagtttaggagaggaggttggaagttgtagttttgttttaattaaaaattttagtttggagtagagtattagtagaaaggtttagaagtgaaataatattttttggtttttgaataaaattagtttatatttatagaagggatgtagtagtagaagggaagagagggattgagggaaaagagaaggatttttagaatgatatttggggatttttaggttttaaattaaagaatgagatggagattgttggtgtttttattgatattaataatgggtgaatagattgtttatttatttgggataattttaagaagtaggggaggattttttttttaattttataaaaaaaaaatgggaaaaggggaagattgtataattttattttggagatagtatattaaaataaaatatattatttttaggaagttatgaggttaaaatatagatagaagggatattttgattaataaatggttgataggtttttattagattgtggaagaataggttgttggaggatattttaattttttaaggttgaagttagagaatttatattttatttatatgagtttattttatttagtttgttttttgtgttttttatttgatagaatgggttgagtggggtttaggttagtggggtgattatgttttttataatgattataatgttgttattggtattgtttttaaatagtttataaaatgtttttgttaatatttttttttttgattatagggtaggtattatttttattattttatagattgaagaatttagtatgagggtggttaggttatagttttaagtttataagagaaaatttttgtgttagggtttttttgttattttaatggtaaagaagaaagatgaggaaaaggaagaggaagataattataatgaagatgatgtttattttttttttttttgtttttttataaatgataagtgaggtaaggtttagggagaataaaatagtttatttaaatgttggtatgtttggtgttataggtatttaataagatgtgatggaggaaatggaattttaggttatggattttttagaattagtaggtttattatgttttgggggttttggagttttttttagatttttttttttttttttgttatttttattttagttattattttttgtttatttttatgttttatatttaatttaaaggaaaatttgtagagtaatttttatatttatttattggttttagattttattttattttattgtttttttatagtgtagttggattatttttgtatagtataaatttgaatatagggatttttaaggatttttttagatttaatgttttaggatattatggtttaagtattttgttaataatattgtttttataaagatagttttgtttattgttattttttagattagagattaaaagttttttagtgaaagtttaattatttttttagtttattttttttagtatattatattgggtattattattatttttagatttgtttataagtagaattttggtttttataattttatttaaatagatttttttattagaatattattttttaggtttttatttgttgtaattttatttatttttgaaggtttagtttaaaatttatttttaattttttagagttaatttgtaataatagttgttgattaattttaatttaatttattttataaatgagtaaattgagtttggaggttaaggtagtttatttatgattatatatttttaaagttagttagttttagagagaagtttatagtttttgtttttgggtgtttttttttttttttttttttattttggttgttagtttttatttttttttgattttttgttttttttttttgtagaaattaatggaatttagatttgttttaatgatttagtggtgttttatgatttttttttggatttggagaatgtgttatatttgtgttatttgtggttggatggaaattatttgaagttgtttattttgttggattttatgatgtgtttttgttttttgtagtttgtggttatttaggttttattttgttattggatttgttttgattgtatttgaaggttggggtttaggtatttgtgttggttatttgtttttttttttttttttttttttttttagttttgttttttttattttatttttgaggtagggaaaagttatttatttttttgtagttttaggagtgagattttaaggatttagtttggttttatttagttgaaagatatttagtgtatatttaaatttttggttttttgtggtttttttttgttttagaaatatagatgtgtttaaagatttggtgtttttttttttttttttttttatttgttatttttgggtatatttgggttgtggattatttgattttggttttggttgagtaaatagtttggaggtaaggtttagaaagtttttttggggatttttttatttttggtagttttggtttaaagaggttgagaaatttagtttttttgggttaaggattttttttggtaaagttgttgttttgttgtttggttttttggtattagatattgttttggttttgttggtttgggtattgggaaggaggagtgagggaatgatggaggtagggtgtagggttagggtttttgtaggggtttgtatttggttagtaggatatagggatgtgtagggtgtttttttttgttttagggtgaatatagtatatgtttttttggttgggttttaggaggaatagttaaggagaagaatggtttaaggaattaggaagtagttatgggagaggggaagggtttaagtttgggatgggtttgtgtgatgttgatgggttttgtggtttttttgtttaattttgggtttagggaggagggtttatagtgtttttgtgggggtgggggaaggaagaggtagttttgtttttgttatttgttttttattagtgtgtgtggtttagttatttttatttttgggaggtggtttttgagaaatagggaggaaggggtggagtatttggatgttttttagaagtttttttatgtttgaaaatgtgttttttttttggagatagatgtattggtgttatttagtggttggtgggagtaatagttggttttagttttgtgtttggttttttttttggggtgattttttttggtggaggaggtttgtggggttttaatatggaagagttatgggttgtgtgtatggtgttgtttttttttagggtttagtgggtataaatgtttttaggttgggtttatttttattgtgagtgagtttaggtgaggatatagttggtttttgtttgttgtaggttttttttaggtgtttttttagtttttttatttgtaaattgaggaggtggataagatgtttttggttgggtgtggtggtttatgtttgtaattttagtattttgggaggttgaggtgggtagattattgtttgagtttaggagtttgaaattattttgggtaatatggtgaaatttttgtttttattaaaatataaaaaaattagttaggtatagtggtgtgtgtttataattttagttattgggaggttgaggtgggagaattgtttgagttggggaggtggaggttgtagtgaggtgagattgtgttattgtattttagtttgggtgatagagtgagattttgttttaaaaaagaaaaaaaaaagatgtttttttgaggtttttttggtgtttatgttttgagtttgtagttttatattttaaattatatttgaatgtaggataagttttaaatatttgtttttttttttgtagtaatttattttttgtatggattgttttttttttagaggtttttttattttttattgtttggtttaggtgagtagtttggtaggtttttaagtggaatttggtttagatagggttgttttgattttatttttttttttaattttttttaagggatgttgtttttttttagttttttgtgtgtgtatattggtgggaggtatagaggatggatgttttagaaatgagtaagatatagtgtttatttttaagttaggatgaaaaaagttttagaggtttttaagaaattggattaagttgggtttttaattttaagaaatttttattatgtttttttttattttttttttttgttaattatggaaaatagggtttattttattatagttttttttttttgtgttttattataattgttgtattttttttagttgtagttggtttttttaaggtttttgtttaaagtttatatgttattatggttgaaagtaatttggtgttttggtttggataagagttttttttgtattttatttatagtttgtagttttagtttttttgatgaggtttttaggggagaggttattattttgattttgtaaatttagatttgttgagtagtaatgtaattattattattttattgtttaatttagaatatgtttgtttttttttgttttttgtagttgtaagttagaggggatttaaggtaaataggttttataggttttttttttttaaatatatatagaatgggttggttttttttaagtttaaaaaaagtttttttttttatgtataagtttattttttttatgttgttgttattgatatatataggtgtgtatgtaggtgtatgtgtgtattttgtatgtatattttttttgttttgaagattttgttaattttgtgaaataatttttatattttaatatattttatagtataggaaataaagtaatatgaaaaatattttgtgtgaatttaatggtgtgaataggttaagaataatattttaaagttattttgttagttaggtgtggtggattatgtttgtaattttagtattttgggaggttaaagtgggtagattatttgaggttaggagtttaagattagtttggttaatatagtgaaattttttgtttatttaaaatataaaaattggttgggtgtggtggtatatgtttgtagttttagttatttgggaggttgaggtaggagaattgtttgaattttggaggtagaagttgtagtgagttgagattgtattattgtattttagtttaggagataaaatgagattttatttaaaaaaaataaaaataaaaataaaaataaagttattttgttatttattttttattattgagttattatgtttagttttaaagttttttaattgttttaataagatgagtggggaaaagattatatttttaagaaatttttatgaaagttatttaaaagtttttttttttttttttttttattatttttaaatagaggtagggttttattatgttgtttaggttggtttggaatttttggttttaagtgatttttttattttggtttttttagagtgttgggattatatatgtgagttattatgtttagttttaaagttattttttgaagaattttttgtaaatttataatttttatgaaaaattaatttttagttttatgagattgtttatttatagataaaaaaatatatatatttttaaagttggattagaaatttgatagttgtttttgaaatttaaagttttgggtttttttaagttatatgtattaaattgttgaaggttttttaggagttttgtattgaggtagatatagaaagatataaaatggttgttttttttgtttaagtaaagtttatagattaattggggagatgtagtgtgtatataaaatagtaaaagagttattttaaggatagagagtatagattaagttatttggaatggtttatatgttatgtggaagtttattgaagggttagaatagggtgttttagatttttttttttgagggaaggttggttgtaaaagtgggatttatgatttttttaggttatattattttttttagaatgagaattgttaggtgatgtttttgttgtttttatttggttattaaatattgattttggtttattttatggatgtttagtggatattggttatatgttaggtttttagttatgtatttaaggatggataatatatatagtagtatatttttgaggaatttatattttggtaaagggaaagaaatttatgaatggatatttttgtgttttaagtgtttgtaataatgttgtgtgttaggtttttgagtttaagttaagttattatattttttgtgatttgtatgtgtatatttagatggttggtttttattttaattgatgatattttattataaaagaagtgaaaatggttggtttttgttttaattgatgatattattttgtgaaatttttttttttggtttattttggtttaaaagtttttttattgaatattttgtaatttttatttttggttattagagaataattttttttgattgtaattttttattatttatttatattttataaaatggttttatttttatttttttttgttgattttttttggatttagtttgtttgtatttaggtgaaataaatagttttgttgtttatataaagtttgtttggtggttgttttatatagatatgagtgaaattattgtgtatgaatagtataaaggaaagggtttttatttttatttgaggaaaattagaaagatttttattatgtgagttggtttttaagggataaattagattttgttaggtggatgaaagaaaaaaagatgttatttggataggaaatagtatga

SEQ ID NO: 32 - DNA, 8460 bp, Homo sapiens
ttttattttatatagaattttatattttaatgttattagtgttatttgtttaagtaataagttattgtatattcgaaattataaagttaagtttgagtagtaaaggatagaggtaagttttttgaattttttgtaggtttgaataatagttttttggttttttaataagtataattatataggtaagagtggttgtagatattatttttatgttatttaaatcgaaagaaataaaaatttattttatttaattttatattaatgtttttttttatttttttttttttttatgggatttttaagtgttttttttggatgttgaatgtttatttcgtaaatgaaaaagttagttaatgatattgtatataagtaatgttttaattgtagattgtgtgtgtgcgtttttgtttttttttgttttaattataaaattagagggggaagtgtgggagtaggtgggttgggtagtggtagaaaattttatgatataattttttcgtttttttgtgttggtggaggatgtttgtagtagtatttaaattttgggagggtttggttgttagtagtagtaggaggaggtagagtatagtatcgtcgggattagattcgttttaggttagttgtagtttttttagttaaacgtcgattaaggtatagttttagtttgttattgggttgtgtatttagttgaattttatggggaagtttaaattttaaggaaaaatatttttaattgtaatgttgttaaatagatttaaattttttagtttttttaataagtagattagatatattgtaggttttttggaataaaggtgtttagatattttgaatgttaattaaatttaaaatttaaaaatatttttattgggtttttaaaagaacggaaattatcgatgttaattagaaaatagtaaaattaaatttttttttggaataattatatttatataatttttagtgggtgattgtgtaggaatttaaaagaaaagggattttttatgttaattaaattaattataatgttattttttaaatgatgtattttatttttaaggggaagaaaattttttttgaatatgttattgttaaatttagttgttaaaatatttattaagatatttgtatgatattgtgtaggtttattattataaatagaaaagttgttggttatttttaatgtttttttttgaattttaaatttttagaatattttatttaaataataaattttagagatagtttgattttatttaagtagtatttatttgataattaagttaaaagttatatttaaagtatatgttggaaaaatggataaagtaaattttttttatttttttttgtgagtttttttttttttaaaaaatatttttatattagtttattaatataattaagttattgttgatttgtttgtaggtttagagagttagatatataaggtagtaatggtataatttttggaattttaaattttaaagttgaataaatatagatttgtaaaattttttttttttttgtttaatagtgaaagatggataataggtggtaatataaatattaatttgaaagattataatattaaaaagaaaaggtatttttaagaagtagaaaagattttatagaaaatatattttatttgtgattattttgtaatgtggtagtataaaaaggtattattgttgtaatttatgaagatgttagttattttttatgaaatattttgtaggaaaatttattattatgagaattgtagtgatttgtttttgttttttaggtattatttgtgttatattagtgagtatagttgtattttaaagaaaatttttgaaaataattgaattgtgtgtttttatgtgttaggaggatatttttgtaatttttttttattttttttgtttttaaggttaaataggttgattttggaagttttgaggaaaagtaggtaagtattttttatgtttttatatagttaaattatttatttaattatggcgagaggtgtaagaaacgtatttgttgcgatattatttatttttttagttaaatttattggtttataagtattgattgattgtttgttatgaatttaggttagtattaagtatagtatagtttttaataaatataagtttataaaattaatttagatattttaaatataataatatttaggtatgtatgatgagttatcgtatgtaagataagttatatgaagttgtgtgattttttttttattagtttatatattgatttaaaagtagaaaattttagtttttgttttgtttagtggattgttaagtttaaaatttatattggatattagttagaattgtttgtatgattataatatttataatattgtttgagatattagttgagaagtttattgtgaaaagaaagtttatgtgtgttgtttgtatttattgtgattgttagttgatgttagattatattttttaattaaatataagattaattaaattttttattataattatttgattagtattaaagatgtatttatttttttataatagatgaaattgtgttagttaaataataaatgggtattgtttttagaagtttggataaaaaggtatatagagtttaattttagttgaatagaataaaggttaaaatagagttgttttgggggttattgtaattagattgtttaatgaagatattaaaagaagtattttgtgttcgtttgtgtgtggaggggtgtgtgtgtttgttttttaattgatttgaaaatataggtgttgaattttaataataaattagaaaaattaatatttttagagaagatagaggttatattatttgaggtaagaattagcgtttttttaataaacgaaaatatggtaaagatgtattttagaaggtacgtggagttataataatttaagaaatacgtgaagagtttaaggtttagttttttagaattttagaaatttaaagttagtaaaaaattggggaagtttttaaggatatatgtttgaaaatatatattggttatttgtgagtgttaggattattgggtggtttttagtttatttattttgtttatttttattttttttatattagtttttaaaaattataaatgtaatttatatatttattttttttgagtttgtattatatgtgttatgagaatagatagatagatatgaaaaagtgaagagaaaaattttgaatttatttggttttattgttttttcgttttttttttttttttttttttttttttttgagacggagtttcgtttcgtcgtttaggttggagtgtagtggtgtgatttcggtttattgtaagtttcgttttttaggtttattttatttttttgagtagttgggattataggcgttcgttattacgttcggataattttttgtatttttagtagagacggggttttatcgtgttagttaggatggtttttattttttgatttcgtgatttattttttttggttttttaaagtgttgggattataggcgtgagttattgcgttcggttgtttttttatttttttaaagtaaggaatttttttttttagtaaaatttttcggagaagtttaatattaagtttttttggttagagttagttatgagagaaattttaagtatttttgattggttttttttttatttatttattttttaggtggttgtagaaggaattttgtgtaatttttagagtttttatttttagtgatagggaaatgtaatgattggttttggatgatttagtagattagatgatatttatttagagtaatttttatttttttgtagtagtatattattagtattttttagataaataatttggttaaagaaaaatttattttatttatatttttggtattttatagtaatagaatttttgtgtaatgattttaatattatatttttatattggttgataagatatatatggttattgagtatttaaaatgtgggttagtgtaattgaggaattgaatttttattttttttttttttttttttttttttgagatggagttttgttttgttatttaggttggagtgtagtggcgtaattttggtttattgtaagttttgttttttgggtttacgttatttttttgttttagtttttttagtagttgggggtataggtgtttgttattacgttcggttatttttttttatttttattttttttagtagaaacggggttttattgtgttagttaggatgttttcgattttttgatttcgtgattcgtttgtttcggttttttaaagtgttgggattataggggtgagttatcgtgtttagttattttattttaattaatttaaatttaaatagttttatgtggttagaggatattgaattagtatagttttagagagtttttttttgttttatggattggatataatgaagattaatagtaattaaggttatttttggtttagatgtgttttatttgagaggaaaatttagttagtaaatatataaaaagaaagtatagtgtgaagttcggtgttaagagttagtttgtttgcgtttgaattttgtttggttttgttattttttattatttaattgtattgtggttgagttttttgatttgtaaggtgggaataataatgatatttattttataggggaatgaaaggattaaatgagtttatatttgtaaagtaatttgaaagagtgtttagtttatagtaagtgttatataagagtttgttaaatgaatttgtaaaaaaaaaaaaattataaaaaggtatttaagggttcgggtgattatatgtttttattaagattagtgaagaatggttgttttttttatttatttttatatttttttttttaataatgataaatatgtaatttttttgtagttttataataaatatttagatgttgtggttatatggttaaattttgatttattttagaagtagaattttttagttttataggtatttttaaattttttataattaaattatagtgatgaaagatagttatatttaggttatttgggttgtttagatgaattttgtttgtttgttggtaaatatgtgtttaggatattgattgatttgttatgttggtttttttttgtgttaagttatttatagatgaggttgaaaaataaaaattgttttggattaaaaaggttaatttttgaataaaaaagttaggtatgtgtgatgcgtattaatacgtgttattttttttttagaatgttgtgttttttgaagaaattaatgattttaaataagaggtaagtttttatttttaattagaggtttattatgttttgaagagatgaaagaaggtattgtttggatttttttttgatgaaattttattagtaagttttttagttaattggtagtttaaaatttgtttataaataaaatatgtatttattaaatattagaaatattaggttttttcggataagtttagtattatagaagatgtttattaatgtttgttatttgaaatattaatttgtttgtaatttatttaaggtattttgtagatatttaatatttaataagtatttaattaatgtatattaaagttaagattttgtttttaggaaagtttttttttttaataaaatagtttatttgataattattttttttattaggattatttatatatttgttaagtaaagagtaaatttattttttttaagatttaatttgaatatattaagaatattaaagtaagttagataaattatttaatatatttgttaatttgaaatttgatagatattagttgtttaatttaatgggtagttttgagttgtagtttatatatatatgtataatagagttattttttaattatttatgttaataggaaagtggttatagattttagtatatatattaaaatatggatattttttttttttgataaattttattttaaataaaaaaattagttttataattatgtatttgtatttattatattattgaatttagtaaataatgtttaatatgtataaggaaaaataatgttattgatatgaagattatatttatatatttggtttgaaaatatttataaaaataatttttgttgtaaagtaagaaatgttttttagaatgttattaatttttgtgttaaaagagaaattggaagatgtttattttagtttttaaaagttatggtatgtattgtgaatgtaaagattttgaaattaaataaaaagaaagatagtaaaagattaatgtgttataaaggttaagggaaaataaaaatttatatattaattttttcggttattttaatttttagatttttttaagtaagtttaacgaaagttatgattatatggatgatatggatgatgaagatgatgatgattatgtggatagttaggattttattgattcgaacgattttgatgatgtagatgatattgatgatttttattagtttgatgagttttattattttgatgaatttgatgaattggttattgatttttttacggatttgttagtaatcgaagtttttattttagttgtttttatagtagatatatatgatggtcgaggtgatagtgtggtttatggattgaggttaaaatttaagaagtttcgtagatttgatatttaggtaaattttttaatagatatatttgatggttttgattagcgtttaagtttaggaaattatagtttgtatatttatttatttatttatttatttatttatttatttagtaagaatttatttatattttattttatgattattgaatataaatttttttttgtttggcggtttttgtaagtttatataatttttttttagatttgatttttaaatataattttattttttgaaattttggattatttatttttagattaaaataaatggaaaatattaattatttaaaaaaaataatggttatgttttgaagttaaatatttaagaggaattgtagttgtaaattatattgaatttttagttatagaatttggatttgatatagttttgtcgtttattattttttttattttttaattaataatttattttttttttatgtaggttttaatataatgaaatttattttataggttttattatatatgtaagtgatgtagttattaaattaaatgagatgatatatgtgaaaggttttggtaaagtattatataaagtaatatgttagtattattttagttagatttagataatttttagtataagatgatttaaaagttagagagtggaaaaggattattatatttttatttttagtcgtttatataattattttttatttgtgtcgtgatttagtattttgatgttatagacgaggatattattttatatatggaaagcgaggagttgaatggtgtatataaggttattttcgttgtttaggatttgaacgcgttttttgattgggatagtcgtgggaaggatagttatgaaacgagttagttggatgattagagtgttgaaatttatagttataagtagtttagattatataagcggaaagttaatgatgagagtaatgagtatttcgatgtgattgatagttaggaattttttaaagttagtcgtgaattttatagttatgaattttatagttatgaagatatgttggttgtagattttaaaagtaaggaagaagataaatatttgaaatttcgtattttttatgaattagatagtgtattttttgaggttaattaaaaggagaaaaaatataattttttattttgtatttagttaaaagaaaaaatgttttatagtaaaatgaaagagaatatgaaatgttttttttttagtttattggttgaatgtgtatttatttgagtttggaaataattaatgtgtttgataattagtttagtttgtggttttatggaaattttttgtaaattaaaagttttagggttatgtttatgtttattttatagaagaaatgtaaattattattgtattttaatatttgttatttttttatgaatagaaatttatgtagaagtaaataaaatatttttatttatttaaaaagagaatataatattttatgttattataattttttgttttttaagttagtgtatattttgttgtgattatttttttgtggtgtgaataaattttttattttgaatgtaataagaatttggtggtgttaattgtttatttgtttttttacggttgtttagtaattaataaaatataattttttttattgtttatataatgtttttaaaggtttattttggttttaattgatatataataagtgtatatatttatggggtacggtgtgatgttttgttatatatatatattgtataattattaaagggtaattattatatttattatttgaaatatttgttatttatttgtgttgagaatatttaatttttttttttagttattttgaagta

SEQ ID NO: 33 - DNA, 8460 bp, Homo sapiens
ttttattttatatagaattttatattttaatgttattagtgttatttgtttaagtaataagttattgtatatttgaaattataaagttaagtttgagtagtaaaggatagaggtaagttttttgaattttttgtaggtttgaataatagttttttggttttttaataagtataattatataggtaagagtggttgtagatattatttttatgttatttaaattgaaagaaataaaaatttattttatttaattttatattaatgtttttttttatttttttttttttttatgggatttttaagtgttttttttggatgttgaatgtttattttgtaaatgaaaaagttagttaatgatattgtatataagtaatgttttaattgtagattgtgtgtgtgtgtttttgtttttttttgttttaattataaaattagagggggaagtgtgggagtaggtgggttgggtagtggtagaaaattttatgatataatttttttgtttttttgtgttggtggaggatgtttgtagtagtatttaaattttgggagggtttggttgttagtagtagtaggaggaggtagagtatagtattgttgggattagatttgttttaggttagttgtagtttttttagttaaatgttgattaaggtatagttttagtttgttattgggttgtgtatttagttgaattttatggggaagtttaaattttaaggaaaaatatttttaattgtaatgttgttaaatagatttaaattttttagtttttttaataagtagattagatatattgtaggttttttggaataaaggtgtttagatattttgaatgttaattaaatttaaaatttaaaaatatttttattgggtttttaaaagaatggaaattattgatgttaattagaaaatagtaaaattaaatttttttttggaataattatatttatataatttttagtgggtgattgtgtaggaatttaaaagaaaagggattttttatgttaattaaattaattataatgttattttttaaatgatgtattttatttttaaggggaagaaaattttttttgaatatgttattgttaaatttagttgttaaaatatttattaagatatttgtatgatattgtgtaggtttattattataaatagaaaagttgttggttatttttaatgtttttttttgaattttaaatttttagaatattttatttaaataataaattttagagatagtttgattttatttaagtagtatttatttgataattaagttaaaagttatatttaaagtatatgttggaaaaatggataaagtaaattttttttatttttttttgtgagtttttttttttttaaaaaatatttttatattagtttattaatataattaagttattgttgatttgtttgtaggtttagagagttagatatataaggtagtaatggtataatttttggaattttaaattttaaagttgaataaatatagatttgtaaaattttttttttttttgtttaatagtgaaagatggataataggtggtaatataaatattaatttgaaagattataatattaaaaagaaaaggtatttttaagaagtagaaaagattttatagaaaatatattttatttgtgattattttgtaatgtggtagtataaaaaggtattattgttgtaatttatgaagatgttagttattttttatgaaatattttgtaggaaaatttattattatgagaattgtagtgatttgtttttgttttttaggtattatttgtgttatattagtgagtatagttgtattttaaagaaaatttttgaaaataattgaattgtgtgtttttatgtgttaggaggatatttttgtaatttttttttattttttttgtttttaaggttaaataggttgattttggaagttttgaggaaaagtaggtaagtattttttatgtttttatatagttaaattatttatttaattatggtgagaggtgtaagaaatgtatttgttgtgatattatttatttttttagttaaatttattggtttataagtattgattgattgtttgttatgaatttaggttagtattaagtatagtatagtttttaataaatataagtttataaaattaatttagatattttaaatataataatatttaggtatgtatgatgagttattgtatgtaagataagttatatgaagttgtgtgattttttttttattagtttatatattgatttaaaagtagaaaattttagtttttgttttgtttagtggattgttaagtttaaaatttatattggatattagttagaattgtttgtatgattataatatttataatattgtttgagatattagttgagaagtttattgtgaaaagaaagtttatgtgtgttgtttgtatttattgtgattgttagttgatgttagattatattttttaattaaatataagattaattaaattttttattataattatttgattagtattaaagatgtatttatttttttataatagatgaaattgtgttagttaaataataaatgggtattgtttttagaagtttggataaaaaggtatatagagtttaattttagttgaatagaataaaggttaaaatagagttgttttgggggttattgtaattagattgtttaatgaagatattaaaagaagtattttgtgtttgtttgtgtgtggaggggtgtgtgtgtttgttttttaattgatttgaaaatataggtgttgaattttaataataaattagaaaaattaatatttttagagaagatagaggttatattatttgaggtaagaattagtgtttttttaataaatgaaaatatggtaaagatgtattttagaaggtatgtggagttataataatttaagaaatatgtgaagagtttaaggtttagttttttagaattttagaaatttaaagttagtaaaaaattggggaagtttttaaggatatatgtttgaaaatatatattggttatttgtgagtgttaggattattgggtggtttttagtttatttattttgtttatttttattttttttatattagtttttaaaaattataaatgtaatttatatatttattttttttgagtttgtattatatgtgttatgagaatagatagatagatatgaaaaagtgaagagaaaaattttgaatttatttggttttattgtttttttgttttttttttttttttttttttttttttttgagatggagttttgttttgttgtttaggttggagtgtagtggtgtgattttggtttattgtaagttttgttttttaggtttattttatttttttgagtagttgggattataggtgtttgttattatgtttggataattttttgtatttttagtagagatggggttttattgtgttagttaggatggtttttattttttgattttgtgatttattttttttggttttttaaagtgttgggattataggtgtgagttattgtgtttggttgtttttttatttttttaaagtaaggaatttttttttttagtaaaattttttggagaagtttaatattaagtttttttggttagagttagttatgagagaaattttaagtatttttgattggttttttttttatttatttattttttaggtggttgtagaaggaattttgtgtaatttttagagtttttatttttagtgatagggaaatgtaatgattggttttggatgatttagtagattagatgatatttatttagagtaatttttatttttttgtagtagtatattattagtattttttagataaataatttggttaaagaaaaatttattttatttatatttttggtattttatagtaatagaatttttgtgtaatgattttaatattatatttttatattggttgataagatatatatggttattgagtatttaaaatgtgggttagtgtaattgaggaattgaatttttattttttttttttttttttttttttttgagatggagttttgttttgttatttaggttggagtgtagtggtgtaattttggtttattgtaagttttgttttttgggtttatgttatttttttgttttagtttttttagtagttgggggtataggtgtttgttattatgtttggttatttttttttatttttattttttttagtagaaatggggttttattgtgttagttaggatgtttttgattttttgattttgtgatttgtttgttttggttttttaaagtgttgggattataggggtgagttattgtgtttagttattttattttaattaatttaaatttaaatagttttatgtggttagaggatattgaattagtatagttttagagagtttttttttgttttatggattggatataatgaagattaatagtaattaaggttatttttggtttagatgtgttttatttgagaggaaaatttagttagtaaatatataaaaagaaagtatagtgtgaagtttggtgttaagagttagtttgtttgtgtttgaattttgtttggttttgttattttttattatttaattgtattgtggttgagttttttgatttgtaaggtgggaataataatgatatttattttataggggaatgaaaggattaaatgagtttatatttgtaaagtaatttgaaagagtgtttagtttatagtaagtgttatataagagtttgttaaatgaatttgtaaaaaaaaaaaaattataaaaaggtatttaagggtttgggtgattatatgtttttattaagattagtgaagaatggttgttttttttatttatttttatatttttttttttaataatgataaatatgtaatttttttgtagttttataataaatatttagatgttgtggttatatggttaaattttgatttattttagaagtagaattttttagttttataggtatttttaaattttttataattaaattatagtgatgaaagatagttatatttaggttatttgggttgtttagatgaattttgtttgtttgttggtaaatatgtgtttaggatattgattgatttgttatgttggtttttttttgtgttaagttatttatagatgaggttgaaaaataaaaattgttttggattaaaaaggttaatttttgaataaaaaagttaggtatgtgtgatgtgtattaatatgtgttattttttttttagaatgttgtgttttttgaagaaattaatgattttaaataagaggtaagtttttatttttaattagaggtttattatgttttgaagagatgaaagaaggtattgtttggatttttttttgatgaaattttattagtaagttttttagttaattggtagtttaaaatttgtttataaataaaatatgtatttattaaatattagaaatattaggtttttttggataagtttagtattatagaagatgtttattaatgtttgttatttgaaatattaatttgtttgtaatttatttaaggtattttgtagatatttaatatttaataagtatttaattaatgtatattaaagttaagattttgtttttaggaaagtttttttttttaataaaatagtttatttgataattattttttttattaggattatttatatatttgttaagtaaagagtaaatttattttttttaagatttaatttgaatatattaagaatattaaagtaagttagataaattatttaatatatttgttaatttgaaatttgatagatattagttgtttaatttaatgggtagttttgagttgtagtttatatatatatgtataatagagttattttttaattatttatgttaataggaaagtggttatagattttagtatatatattaaaatatggatattttttttttttgataaattttattttaaataaaaaaattagttttataattatgtatttgtatttattatattattgaatttagtaaataatgtttaatatgtataaggaaaaataatgttattgatatgaagattatatttatatatttggtttgaaaatatttataaaaataatttttgttgtaaagtaagaaatgttttttagaatgttattaatttttgtgttaaaagagaaattggaagatgtttattttagtttttaaaagttatggtatgtattgtgaatgtaaagattttgaaattaaataaaaagaaagatagtaaaagattaatgtgttataaaggttaagggaaaataaaaatttatatattaatttttttggttattttaatttttagatttttttaagtaagtttaatgaaagttatgattatatggatgatatggatgatgaagatgatgatgattatgtggatagttaggattttattgatttgaatgattttgatgatgtagatgatattgatgatttttattagtttgatgagttttattattttgatgaatttgatgaattggttattgatttttttatggatttgttagtaattgaagtttttattttagttgtttttatagtagatatatatgatggttgaggtgatagtgtggtttatggattgaggttaaaatttaagaagttttgtagatttgatatttaggtaaattttttaatagatatatttgatggttttgattagtgtttaagtttaggaaattatagtttgtatatttatttatttatttatttatttatttatttatttagtaagaatttatttatattttattttatgattattgaatataaatttttttttgtttggtggtttttgtaagtttatataatttttttttagatttgatttttaaatataattttattttttgaaattttggattatttatttttagattaaaataaatggaaaatattaattatttaaaaaaaataatggttatgttttgaagttaaatatttaagaggaattgtagttgtaaattatattgaatttttagttatagaatttggatttgatatagttttgttgtttattattttttttattttttaattaataatttattttttttttatgtaggttttaatataatgaaatttattttataggttttattatatatgtaagtgatgtagttattaaattaaatgagatgatatatgtgaaaggttttggtaaagtattatataaagtaatatgttagtattattttagttagatttagataatttttagtataagatgatttaaaagttagagagtggaaaaggattattatatttttatttttagttgtttatataattattttttatttgtgttgtgatttagtattttgatgttatagatgaggatattattttatatatggaaagtgaggagttgaatggtgtatataaggttatttttgttgtttaggatttgaatgtgttttttgattgggatagttgtgggaaggatagttatgaaatgagttagttggatgattagagtgttgaaatttatagttataagtagtttagattatataagtggaaagttaatgatgagagtaatgagtattttgatgtgattgatagttaggaattttttaaagttagttgtgaattttatagttatgaattttatagttatgaagatatgttggttgtagattttaaaagtaaggaagaagataaatatttgaaattttgtattttttatgaattagatagtgtattttttgaggttaattaaaaggagaaaaaatataattttttattttgtatttagttaaaagaaaaaatgttttatagtaaaatgaaagagaatatgaaatgttttttttttagtttattggttgaatgtgtatttatttgagtttggaaataattaatgtgtttgataattagtttagtttgtggttttatggaaattttttgtaaattaaaagttttagggttatgtttatgtttattttatagaagaaatgtaaattattattgtattttaatatttgttatttttttatgaatagaaatttatgtagaagtaaataaaatatttttatttatttaaaaagagaatataatattttatgttattataattttttgttttttaagttagtgtatattttgttgtgattatttttttgtggtgtgaataaattttttattttgaatgtaataagaatttggtggtgttaattgtttatttgtttttttatggttgtttagtaattaataaaatataattttttttattgtttatataatgtttttaaaggtttattttggttttaattgatatataataagtgtatatatttatggggtatggtgtgatgttttgttatatatatatattgtataattattaaagggtaattattatatttattatttgaaatatttgttatttatttgtgttgagaatatttaatttttttttttagttattttgaagta

SEQ ID NO: 34 - DNA, 6163 bp, Homo sapiens
tttttattaaaataaaaaaataatttaagtagtgattttaaaaattagtggtatttttattttattttttttatttttagtggttggaaagtttgagtaatagaaaaattagaagttagttttggagaagtttaaatattattaaggaatggtttaggttaagtatgatttttttattttagaggtaaggggtagagaggtttgggaaaagggtaggttttggaaattaggttttaatacgagggtattgggtaagggaagagaggttagttatttcgtattttaggttttttttaattaacggatattagattttatttatttttttttttgtattaagttttttttatattagttgttttggttttggtacggttggggtttggtttaatgtgggttttggtttttttttttattttttattatagataatattttgtgttaggtagtttggagtttattttgaggttagagttgtgattttgtttgtttatttttttttttttataggaattcggatatcgtggttggtaagtgggtatatagaaatttggcgggttggggcgggattgtttatagaatttagggtttggtagttagagtcgtttagggttggtttttcgatttgttttattttttttcgtatttttttttatagttttggggttatcgttcgaatgtggtatttgttaagtatatttcggcgttatttagtcgttattttgagattttttaggggcgggttttgattattagggttggggatgagggatggagatatttcggggcgatgaaggaggggggatggtgcgattgtgtttgtggtttgtggtttttaggtgtgtttgttatttttgtgggttatttttttttattttttatttttttgtttagtttttagcggtggaaaaaggggatgagggcgtcggcgatagaaacgtaagcggggttggaagagaggggtgggggcgcgttcgagggtggggaaggagttcgggtttatttagggttagtttcggcgcgtcgagtttgaagtgggagatcgacgtcggggcggtttttacgttcggtaggcgtcgtataagcgtttttttaaagcgtaggtagttggtttatcgtagggagacgtatttagttgttcggtttcgttttttttcgtttcgtatttagggtattcggtcgagcgtgtgtggatggcgcggcgtggaggtttaaatttgagtaaataaataagttgagggaacgttttttttttttcgatgtaaattcggggttttagatataattattttttttttttagaaaagtttcgggaaaggcggtaggtagaggagtattataggagagcggggggttatagtcggggtttagggttcggggttcgggggttacggttttatttttttatgtacggtagtcggttgggggaacggtttcgttttttttttcgtggagggcgggggcgtatttttgggcgcgagcgagttaagtttagtggtttcgatgttttacgtaggagttggttcggttgtcggttgcggttagggttatcgtataaagagggcggtagattcgagcgtttaggattcgtcgttgttcgcgtttcgtcgtcgttgttgtttttagtttcggttttaggcgttttagttatggttcgtttaatgtttttgtttagtttcggttttttggttggtttgttgtcggcgttggtcgtttgtttttagaattgttattgttatagcgatttgtagtacgttatttgcgataaggtggggttgtagaagatttttaaggtgttagagaagattaagttgtttaatttatagcgtaataatttttcggtgttggttgttaattcgtttcgggttatgtcgaatttcgtgttattgtatttgtagtattgttagattcgcgaggtggtcgtcggtgtttttcgcggttttaagtaatttatttatttgtatttgttttataacgatattcgcgtgttgcgcgtaggtgttttcgacgatttgatcgagttgatttatttttatttggattataataaggttattgagttgtttcgggggttgtttttttcgttggttaatttttttattttgtagtttaataataataagattcgtgagttgcgcgtaggcgttttttagggagttaaggatttgcgttggttttatttgtcggaaaacgcgttgagttttttgtagttcggggttttggacgacgtggagaatttcgttaaattttacgtggataggaattagttgtttagttattttttagttgttttgagtaagttacgggtggtggaggagttgaagttgttttataattttttgaaaagtatttcggataatgttttttagttttttggtagatatttggagattttttggttggataatattaatttggagaaggtgagtttttggttgtgggttttgttttggtttttttttttttttttggaggttttaggagttagggttatagttggtattatttttcgtttttaggttttttgtttttttggttatttttaaggtgagtagttttgttatttttttttttcgttttgttatatttttattttaatttttgtttgttgttagtttcgattattgtttttttaggatttttatatataaaaggagtgggattgttttggttttataaaaggttttttagggttatttttagtgtttttaaatttttaattgtgagtagtagttatttttttttgttgggttttttattttttttttgttgtttttttcgtttttagtaaatttattattttataaaggaaggtttgtttattgaggagttttttagaggagttgggtagattaggtttataaagagattttgtttttggtgggggttgtgtatgtgtgttaagggggagtgggggattggggagtgaggggaagtaaatgtttgaggaagatattttttatgttttatagaggttttggtggatggttttgtttaatttatatagatataatttattgtatttttaagtttattgtagtttagtaggcgtgggattaagggtttttttaggatgtaagtatcgtgtttatgggtttcgtgaaggggtaaaggtaagattattattgttaatttttggtttaagattttaggtgtttttttatagagaagattggcgtgatttattgtttttagattgttaattgttttttgttttttttcgttattagatttattttttgtttgtatttttatttattttttttttttttggggtgtttagtgtttggttaggtggggttattttggattagagtagaattttttttttgggattggaaaaattattttggtataggggttttagttaggaggtttgggtggggaattaataaggtagaggagagtttggttattggagatttttatattttaatgtgggttataggaaagggtgcgggtgtggagatgtgggtagaattttatttgggtagtagttaatttttgtttgggtggaaggagtttgtttaagtttgtttttttttagttttgtttttttttagttgaagttggagttttttgtggtttattagtgttagagtggttttttagtgggtagtagagtagcgaattaggggttggtttggggtaggggaggttagataggaattgtggcgtttgggtaaaggtgtgggtattaatagaatattttttttggagtcgtttaatttggttaaaggttttattaaggtggttttataaatagcgtttggttggtagtgggggagtagtgaggatagagttgagggaagttttgggattttgggattgtggggagtttgggtttattgtttattttattaagtatagattaagtttatcgtgtattagtttggattgttggggttaaattttggtagttttatagttttagtgtttgtgtagggattgtggtgttaggggaagaggagttgggtgtggttttgtggttattgtttatttattgttgtgatttagggtaaaggattgcgtttttttcgtttttttatttgtatattgaaaataatattatttggttgggcgtggtggtttacgtttgtaattttagtattttgggaggttgaggcgggtagattacgaggttaggagatcgagattattttggttaatatggtgaaattgcgtttttattaaaaaaatataaaaaaattagtcgggtatggtggcgggtatttgtagttttagttatttaggaggttgaggtcggagaatggcgtgaattcgggaggcggagtttgtagtgagttgagatcgtgttattgtgttttagtttgggtaatatagtgagattttattttaaaaaaaaaaaaaggaaaaaaaaaaaaaaaagaaaataatattatttgttttaaagggggttgtgtagattggattatttgagattatttggttatattgttttgaaaattgggaaattttttaaagtgttatggtttaggtttagggaaggattttgtttttttggtattcgggtgtttatttatttatttatgattattttgtttttattttgtttttattttgttttttagtttttagatggtgtttttttgggtgtaattacgttgaaatacgtttatttggagaataatcgtttgaattagttattttttaatttttttttcgatagtttggagattttcgtttttattaataatttttggaagtgtatttgttagtttcggggttttcggcggtaagaatatttttatgttatttttagagtttatttttatgtgatagaggtatattagttttgtattaagatatgttggatatgtattttagatttgttatttaataagtatgggattttgggagttttagtttttttatttgtaaaatgaagatgatagttttagattattttgtggttaagttaattttggttttatagtttattgtttttttttttagtatttttatttttttttttagttttagtaagtttttgtttttttaggtggttggaagttaaggtttttcgtttagatgttatttgtgttttatttgttaagtttaagggttagtatattcgtgatacggacgtttttcgtagttgtaagttttttattaagaggtttaagaaagttggtcgttattaaataggtgggggttaggtaaataggttttttatgtttttttttggtgattttagtaagtgagttggtattttttaggatattttttggttttggagggttaggtagattttttatttttatagagagaggaggggacgattgggttttttgttgaagggaggaaaaggttttgtttaggatttttattattttttttaagtattatttgtgttgttggagtattgatatcgatttttgtttttttgtaggttttgatttagttagttttggtgattggtttttgttttttatcggagagattattgatttttttatttttatttatattttttttttatagtttttgttgatgtatagagttgtttatatttagatacgttttggtagggggtttcgggtattttattattaatttagttttatttagtagtgttttggggagaaggaaggttgagtttttttttagtttttatgttttttttattttttagttttttttggagaagttgttgttgagattttttttttaagttaattagaattataataggttggttattaggatggttatttttttaggattattttttttttgtttttttttttttgttacgtggaaataattattagatttttgttttattttttgtttttagaaagggttttaaagtttatgttttaattttgttagtttttatttgttaggacgttttagtaggatatcggtgttttgttgtttatttttttatgttgtaatttttttttgagatttttataaatataaatgtatgtatgtattatatttatttttttgttatttattttttttatttattaggtgttgatgaggttagattatttttttttatatttgttttttggaaggagggttggttgagagggttttttttgaatatttggtttggatttatttttatgtttgtttatttgttgttattttaggtttggtttgtttatagttcgggtcgtagttatta

SEQ ID NO: 35 - DNA, 6163 bp, Homo sapiens
tttttattaaaataaaaaaataatttaagtagtgattttaaaaattagtggtatttttattttattttttttatttttagtggttggaaagtttgagtaatagaaaaattagaagttagttttggagaagtttaaatattattaaggaatggtttaggttaagtatgatttttttattttagaggtaaggggtagagaggtttgggaaaagggtaggttttggaaattaggttttaatatgagggtattgggtaagggaagagaggttagttattttgtattttaggttttttttaattaatggatattagattttatttatttttttttttgtattaagttttttttatattagttgttttggttttggtatggttggggtttggtttaatgtgggttttggtttttttttttattttttattatagataatattttgtgttaggtagtttggagtttattttgaggttagagttgtgattttgtttgtttatttttttttttttataggaatttggatattgtggttggtaagtgggtatatagaaatttggtgggttggggtgggattgtttatagaatttagggtttggtagttagagttgtttagggttggttttttgatttgttttatttttttttgtatttttttttatagttttggggttattgtttgaatgtggtatttgttaagtatattttggtgttatttagttgttattttgagattttttaggggtgggttttgattattagggttggggatgagggatggagatattttggggtgatgaaggaggggggatggtgtgattgtgtttgtggtttgtggtttttaggtgtgtttgttatttttgtgggttatttttttttattttttatttttttgtttagtttttagtggtggaaaaaggggatgagggtgttggtgatagaaatgtaagtggggttggaagagaggggtgggggtgtgtttgagggtggggaaggagtttgggtttatttagggttagttttggtgtgttgagtttgaagtgggagattgatgttggggtggtttttatgtttggtaggtgttgtataagtgtttttttaaagtgtaggtagttggtttattgtagggagatgtatttagttgtttggttttgtttttttttgttttgtatttagggtatttggttgagtgtgtgtggatggtgtggtgtggaggtttaaatttgagtaaataaataagttgagggaatgtttttttttttttgatgtaaatttggggttttagatataattattttttttttttagaaaagttttgggaaaggtggtaggtagaggagtattataggagagtggggggttatagttggggtttagggtttggggtttgggggttatggttttatttttttatgtatggtagttggttgggggaatggttttgtttttttttttgtggagggtgggggtgtatttttgggtgtgagtgagttaagtttagtggttttgatgttttatgtaggagttggtttggttgttggttgtggttagggttattgtataaagagggtggtagatttgagtgtttaggatttgttgttgtttgtgttttgttgttgttgttgtttttagttttggttttaggtgttttagttatggtttgtttaatgtttttgtttagttttggttttttggttggtttgttgttggtgttggttgtttgtttttagaattgttattgttatagtgatttgtagtatgttatttgtgataaggtggggttgtagaagatttttaaggtgttagagaagattaagttgtttaatttatagtgtaataattttttggtgttggttgttaatttgttttgggttatgttgaattttgtgttattgtatttgtagtattgttagatttgtgaggtggttgttggtgttttttgtggttttaagtaatttatttatttgtatttgttttataatgatatttgtgtgttgtgtgtaggtgtttttgatgatttgattgagttgatttatttttatttggattataataaggttattgagttgttttgggggttgttttttttgttggttaatttttttattttgtagtttaataataataagatttgtgagttgtgtgtaggtgttttttagggagttaaggatttgtgttggttttatttgttggaaaatgtgttgagttttttgtagtttggggttttggatgatgtggagaattttgttaaattttatgtggataggaattagttgtttagttattttttagttgttttgagtaagttatgggtggtggaggagttgaagttgttttataattttttgaaaagtattttggataatgttttttagttttttggtagatatttggagattttttggttggataatattaatttggagaaggtgagtttttggttgtgggttttgttttggtttttttttttttttttggaggttttaggagttagggttatagttggtattattttttgtttttaggttttttgtttttttggttatttttaaggtgagtagttttgttattttttttttttgttttgttatatttttattttaatttttgtttgttgttagttttgattattgtttttttaggatttttatatataaaaggagtgggattgttttggttttataaaaggttttttagggttatttttagtgtttttaaatttttaattgtgagtagtagttatttttttttgttgggttttttattttttttttgttgttttttttgtttttagtaaatttattattttataaaggaaggtttgtttattgaggagttttttagaggagttgggtagattaggtttataaagagattttgtttttggtgggggttgtgtatgtgtgttaagggggagtgggggattggggagtgaggggaagtaaatgtttgaggaagatattttttatgttttatagaggttttggtggatggttttgtttaatttatatagatataatttattgtatttttaagtttattgtagtttagtaggtgtgggattaagggtttttttaggatgtaagtattgtgtttatgggttttgtgaaggggtaaaggtaagattattattgttaatttttggtttaagattttaggtgtttttttatagagaagattggtgtgatttattgtttttagattgttaattgttttttgtttttttttgttattagatttattttttgtttgtatttttatttattttttttttttttggggtgtttagtgtttggttaggtggggttattttggattagagtagaattttttttttgggattggaaaaattattttggtataggggttttagttaggaggtttgggtggggaattaataaggtagaggagagtttggttattggagatttttatattttaatgtgggttataggaaagggtgtgggtgtggagatgtgggtagaattttatttgggtagtagttaatttttgtttgggtggaaggagtttgtttaagtttgtttttttttagttttgtttttttttagttgaagttggagttttttgtggtttattagtgttagagtggttttttagtgggtagtagagtagtgaattaggggttggtttggggtaggggaggttagataggaattgtggtgtttgggtaaaggtgtgggtattaatagaatattttttttggagttgtttaatttggttaaaggttttattaaggtggttttataaatagtgtttggttggtagtgggggagtagtgaggatagagttgagggaagttttgggattttgggattgtggggagtttgggtttattgtttattttattaagtatagattaagtttattgtgtattagtttggattgttggggttaaattttggtagttttatagttttagtgtttgtgtagggattgtggtgttaggggaagaggagttgggtgtggttttgtggttattgtttatttattgttgtgatttagggtaaaggattgtgttttttttgtttttttatttgtatattgaaaataatattatttggttgggtgtggtggtttatgtttgtaattttagtattttgggaggttgaggtgggtagattatgaggttaggagattgagattattttggttaatatggtgaaattgtgtttttattaaaaaaatataaaaaaattagttgggtatggtggtgggtatttgtagttttagttatttaggaggttgaggttggagaatggtgtgaatttgggaggtggagtttgtagtgagttgagattgtgttattgtgttttagtttgggtaatatagtgagattttattttaaaaaaaaaaaaaggaaaaaaaaaaaaaaaagaaaataatattatttgttttaaagggggttgtgtagattggattatttgagattatttggttatattgttttgaaaattgggaaattttttaaagtgttatggtttaggtttagggaaggattttgtttttttggtatttgggtgtttatttatttatttatgattattttgtttttattttgtttttattttgttttttagtttttagatggtgtttttttgggtgtaattatgttgaaatatgtttatttggagaataattgtttgaattagttattttttaattttttttttgatagtttggagatttttgtttttattaataatttttggaagtgtatttgttagttttggggtttttggtggtaagaatatttttatgttatttttagagtttatttttatgtgatagaggtatattagttttgtattaagatatgttggatatgtattttagatttgttatttaataagtatgggattttgggagttttagtttttttatttgtaaaatgaagatgatagttttagattattttgtggttaagttaattttggttttatagtttattgtttttttttttagtatttttatttttttttttagttttagtaagtttttgtttttttaggtggttggaagttaaggttttttgtttagatgttatttgtgttttatttgttaagtttaagggttagtatatttgtgatatggatgttttttgtagttgtaagttttttattaagaggtttaagaaagttggttgttattaaataggtgggggttaggtaaataggttttttatgtttttttttggtgattttagtaagtgagttggtattttttaggatattttttggttttggagggttaggtagattttttatttttatagagagaggaggggatgattgggttttttgttgaagggaggaaaaggttttgtttaggatttttattattttttttaagtattatttgtgttgttggagtattgatattgatttttgtttttttgtaggttttgatttagttagttttggtgattggtttttgttttttattggagagattattgatttttttatttttatttatattttttttttatagtttttgttgatgtatagagttgtttatatttagatatgttttggtagggggttttgggtattttattattaatttagttttatttagtagtgttttggggagaaggaaggttgagtttttttttagtttttatgttttttttattttttagttttttttggagaagttgttgttgagattttttttttaagttaattagaattataataggttggttattaggatggttatttttttaggattattttttttttgtttttttttttttgttatgtggaaataattattagatttttgttttattttttgtttttagaaagggttttaaagtttatgttttaattttgttagtttttatttgttaggatgttttagtaggatattggtgttttgttgtttatttttttatgttgtaatttttttttgagatttttataaatataaatgtatgtatgtattatatttatttttttgttatttattttttttatttattaggtgttgatgaggttagattatttttttttatatttgttttttggaaggagggttggttgagagggttttttttgaatatttggtttggatttatttttatgtttgtttatttgttgttattttaggtttggtttgtttatagtttgggttgtagttatta

SEQ ID NO: 36 - DNA, 57423 bp, Homo sapiens
ttttttgttttagcgttggattataattgttggtttttttgtttgttttttttgttttttagagtacgaagaagtttgttttcgtaatttattatttgtgtgattttggtttaggaattggattgggttttttttttgaaagtgggtaaataatgttatcgatttaatgaggttgttgaggtatggaatttgattaggtagataaagtgtttttggtaaattttaattttttgttttttaataaagttttggcgatttataagaatttgcgggaaagtgtttagaattcggagttaggagttttgatttttagttttgaagggtcgcgtgattttggttaaagtttttaattttttttagttttagattcgggggttggaaattgaggaggttttttcggtaagtttttcgggttagtgatattttaagattttaagagttaaggagttagaggggtggggtggaggagggaggcgggcgcgtcggattggtttttgcgcgttacgtgttcggttcggagtttacggttgttttttcggttcgtttcgcgttgcggttgttgttgggttaacgggtttcgatttagcgagcgttgcgttttcgagtttttgcgttcgtgcgttcgtttgcgattcgaggttttcgttgcgcggtgagtgggttgaggttggagaggggagtcgttttgggaattttttttcgggggttgtagggatataagaaataagcgtttagttatcggttgatgggtatttttcgttaggagtagggacgggagggcgcggtaattcgagagtgtcgtagattgggtgtgtttggggagcgtagcggagtaaatttggggtcggggcggagaggcgcgggcggagggcgttttggttagggggaggggagggagtttcgttgttgtagagggtttggttgagggttttgggcgtcggagttgagttaggggttggttttgtcggttttaatttgggggggtttaagagattttgaaggttcggggttggggttagttggacgttagttaaaggattcgtagagaagggtgtggttgaggtttaagattgagagtaagagcgttggattttttagttgtttataaaatggtttgtgtgtggtgtcgggggagggttgtttgcgtgtagagagttgaacgttcggtcgtatatattttagggttttattggattttattttttttgggttattgtttgtttatgaatgtagttttttaacggggtttcgaggttttttatggtgaggtaggggtattatttttttttttgtattttttaagcggtttaggtttttttaaagtttgggggttttaaataattttttatatattagtatgggagtaaaatattttgaatcggaattttagtttttgttgtagtgtgattttgggcggtggttttttttttttgagtttggatttttttttttaagtttatagttgagaaatttagttttttttaaaggaaataatggttttgaaaattgatttatttgttagttgtatggaatgattgtaggtttgggagttttgattatagatttgggaagtttggtataatttttgtaggttttataaggggaaagggtaggaggttttttgggataattaatttggttacggttttttgtttttttttttttttttttagattttagtgggttttttttgataattttaaatttggatatatggttttcgggtttgtgaaaggattttggtttttttttaagagttcgtttttttttttttattatttttttttttttgtttaaaatatgtttgggattgtttttattgatttagatggtatattttgatttgcgtagttttttatggtgaagtgaatgatcgttttagttttagtttttgtggattttgattttttagtaggtaggttttgagttacgtcgagggtattggtttggggttagaggaaagttcggttatagttcggatgtgttgggattttttgagtaagttttttttttaaggttttgtgttttatttggagtaaagtttgttgaattggttgttattgttagtgtagatattttaggatttaattgttttaagatttaggattttgggagttggatgggattggggagggtaggaggtagaggtttttatttttttttgtagttgtgataattatttatttatttttttttgttttatttattttttgtttttaaggtagtatttgttgagatatagaaaatatttgtagtttttggataagggttatagttgttgttggggtaaaatgtagatgtgagtgtgtagaggaggggttagggaagtttaaggtttggttttttgagattgatttttgggatgaagtgggggagattgtagtgttggatagttgttagtgattggtatattcgtattgtagtatttagagggagttttgggttattaggatttagtttcggatttagtttttgttttgttattaattagttaggcgttttgggtatatttattatttttttggggtttagtttttttttttttatagggataggatatatatttaggatattttattggtattaataaaatgggttgggtttgaatggtttttgttttattattttaggattttttggggaggtttagtggaattattagttttattttatttagttttttcgatatattttttgggtggcgataaagtataggatgtggtttttatcgtgatttttgagtatgtatgtatttttttttttgttaatagaggggaggaagtcggaggggtgtttttatgtttataaatttgttttggaatttagttttattttttttttttttggagttgagaagtttttatagagattggttatgggggagtgattgtttataggttttttggatgttttgtttatttgtaaaatgagaatgagatcgatatttttatgaggttgtaagatggtagatataaaagtgttgtgttattttaaaagggtgtggtgtttgagaaggtaggcgatttgagttttaagttttttttttgaaaaatttatgttttggtggtttttaaataatagtaataaaatggtaattattattatttttcgaatttttaaatttgttaggtttcggttgaagttttgttatgttagacgttgttattaatgtttattttgtagatatggaaattttagtttttaatagtttaaggaagaaataataatgataaatgtttataaaatatagtgttttttgtgtgttaggtttttttttaagttttagatttgttttaattttttttatttttattataatttttatgagggaggtgttatttttattttttttttttttttttaatatgaaataggtatagagaggtttaatatttgtataatattatatagttattaaatattatttttaggttttaattttaggtagtttggttttagtatttatattgtgagatattattttgttgttttttataaaagtgatttaagttggggtttaaatttaggttagattagttttaattttgaggtagagagatgattttttgaggttttgtttagttttaggattaatggttttgggttaggagaggaaaagatattgttttttaagaaattttagtcgttaagttggggggtgtgtttacgtatagagttagggaaggtatttattttagttttattagaattaaggtttttggagggttatggagcgggttttgggtgtttttttgtagatcgggggagaagttagtaagaaagggtaaagagggaaggatttagattttataggttaggggttttttaagtgggatggatatattttaggacgtattgaagatgattttttgggggtataggaagaaattattggattttttattaaatgtatttttaatgttatattttaaaggtatatttttgtttattatggtaaatatttaatttttttttggttatgggttgtgtatgggattaatatatatatatatatatatatatatatatatatatattgtaaattgttatatgatattattttattattagttttgtggggttaggagttttgtttgttttattttttgtttaatttttaatttttattagtgggtttggtttgtaggaggtgtttaaataaatgtttatggaaaaatacgtttttgtttgatgattgatttttttttgatgttgggtaagtgatttaatttttttagtttattttttggttatagaaagaggagtaaagtatagtttgaaaattaatagtagatggttttatttgttgaggttattaaagaaagtatgaaagttatttagtgtattttatttttaattatttataggagttacgttttatgggagggggtgtaggaaagaggtatatgtagtaattttttaaaaagtgtaaaattatgatttatgtagatataaaaatgattatgtgttgttttatttattaattaatgattatattaggtcgatgttataattagtttaaaagatatatttgtattgaaagaaatgtgtaattagagataaaattttttttttatttgagggggtgggaaattaattggatttttataaaatagggtaaggagtatgtattagaattattttgtgttattattaattatttgtaatttattgatttgtaaaattatttaaagataatgaaagtttcgagttagataatttggagggtttttttttgaagtatagatttttttttataatattttggaggttggtagtttttatttaatggagaaatgataaatttatagtggttgattaaagttagttaaattaaggtggttttagagtattttagcgggggaatattttttggtttgttagaaaaggcggtatttgaatttagtagataatagtggtttttagtttttttggttgttattaaaattatttaggaaagtttttagaaattattaaaggttaggttttattttagtagttgagttagaatttttaagggttgattttaaatttttggtagttttgaaaaattttttaggttttgttagtgaagttagaattgaaaagtattggtatagattttggaaagttggattaaaaatgttggtggaaggcgtttttggtttagtagggaagatagggtaaagaggaaagtggtgatggtaaagaagttagtaaggagaattaatggtttcgattgttgagtttagaggtttagtattaaggggtattattggagatttgtgagtagaggagtgttgtggtttaggttgtagttttttaggtatttttttgaggtagaggtttgggtgggtttttttgtatgattttttatattatttttttttttttaaattatttttttattatatttggttttatttttttacgtttaatatttttttttttttaaaagtgtattttgtttttttatagtttaagttatttttcgatgatagaaatgtttttttttattttggtgttattattttttttggtatgtttttgtttttattttattgaatttagattttgattgtgtatttttattagtttgtatttttaatattttttttaattttatatatgtataataaataaaaatgggatataaaagggtaagattaaaatatttggaaagtggtgatatttttgttttgtattttagtggattgttatatttattatttttttttggagattattgttgtaataatgatgattgtggtaatagaagttatcgtttgttaaatatttaatttgtatttggttatgttaagtgttttatttgttttattttattgaatttttataaaaattttataagagggttattttaggatgaagaaattgaggtagagaaattttataatttgtttaagttattgagttcggaatttgtatggttaggatttgaatttgggtatcgattataaattttgtattgattttaatgttatattgtttttattgtaaatgtttgggtttattataataaaagttattatttattgagtttttattgtgtgttacgtattgtgttaagtgtttttttttcgttattttatttattttttagtatttataggtatttttatttgtattttgcggatgtggaaattgagatttagtttaagtaatttatttatattataaattgttgggtaatatttgtgtttgaaggtttatgtttttatatgatttggataaaattttttttttatttatatttttgtggttgggtagtggtgagtcgttttttttagagttagtttggaattttcgaaggggaaggaggaaaacgtgattgattgtaggtaaaaggatgaggtaaggggtggttatagtagtataaagttatttaggttatttattttgtttttgtgtgggttttacgaatgattagttatgataagtcgttatagtatattttatttagatttgagagaattagggtttttgggaggaaagaggtataggtttggaatgattttgtttattagttttgaatagtttttttaattaaggtgatgaatgttgtatattggcgggtggagatggggaggaattttgtggtttgggagatgatttttttaggattgatattttgttgtgaaaattttgagttgaagtttttaaaagtttttaattatagattttattaaagagggagtgatgtattgttttattttagagatgaagaaattaaggttgagagagggatttggtttgtttgaggttatatgggggtagattgggaattagaattagggttttattttttggattttttttggtgttttattgtagttaagatttatagttgtgtggggatttgttatgatcgagggttgttaggtagagatgttggttgttttttgggttttggtaagttattttttttttttgagatgtttttatttcgtttagaaaatgagggatttggagttatggattattaagggtttttgtgggatttagaaatattagatgtaaaatatttagttaatttgagtagtatggtttaggttgttttgggagggattagaagttattttaaagttagggtaaatggtgtgtttatgattagtttaggagttttttagaatttttagaggcggggttgtggaattagtagggggattggtttttagaattgtagtttgaatatttagttttggaaggagtttgttttttatatatgaattgtgtatttatataaggtatatagaaattgtttttagagttgagaatatttttttaaatagtaagaggtttttttttgaagttatttttttttggaaaggggagtttttttagatgggtttgggttgtagttagtagttgaaattgttagtaataagtttagaggaaagtgttttaaggttggagatgtaggtgataggttttagttttttttttgtttgtgttaattaattttttgggttttatttagtttttggttttttgttagttttgggttttttttattgtttttttttattattttttaggttagaggaaatcgagagttggtttttagttttatttcggggtagatgtgggtttttttttttttttattatatattggaaagggggtatagtttttattttttggtgagagttgtatagttgtattaaggggtttttggttgttagggaaatagtaaggttttttgaagttgagttgagttgagttgtatttgtaggtagattcgttttttgttttttatttttaattttatatgatgattgtttttagttgattgtagtttggggaatttataattagttagtgaagatatagaggtaaatacgatagaggttttgtttttaattttttattagtatagtaaatattattatttattaagaataggttttgtgtttggttttttatgtgttgtttttgatataatttaggttttattttttaataattttataaagtagaaaagggaaagttttagttttgtgtttgagattattttgaatttaaaaatgagtaataagtttacggttatatggttaagattttttttaagttttgggggaatagggaatatgtggagaattggaaggtattgagttgaaatgtttttatgatttttatttttttagttttgttttttttaggttttattgggtaaatttgattgattttgttatgtttatttttttttttttttttgagttagagttttattttgttgtttagtttggagtgtagtggtgttatttttgtttattgtaatttttgttttttagtttaagcgatttatttgtttcggttttttgattagttgggattataggtatatattattatatttggttaatttttgtattttttcgtagagacggggtttcgtatgttggttaggttggttttaaatttttggttttaggtggtttttgtcgtttggttttttaaagtgttgggattataggtatgagttattgtttttggtttttgttatgtttatttttaaaaagtaatatatagatattgttaaaagagattaggttaggtttggtggtttacgtttataattttagtattttgagagattgaggagggtagattataagggtaggagttcgagattagtttggttaatatggtgaaatttatttttattaaaaatacgaaaattagttaggtgtggtgtcgtgtatttgtaattttagttatttaggaggttgaggtaggagaatcgtttgaattcgggaggtggaggttgtagggagttgagattgcgttattgtattttagtttgggtaatagagcgagattttattttaaaaaaaagagattaaattgtttagatttgtttaaagtggaaagtagtggttttttgtttttttttttttttttttaagaagattgttaaatttttatttgttgtttttttgagtgtttattagttagttttttatttgttttttttatattttttaaattagttatatttttttttgtatttatttttacgtattatatttttgtttttttattgtagattttgttttttgatattttttattcgtattttttatttatttttaatgagatatgtgttttgtttttttgtgtgtttttgtttttttttttttttttttttttttgagatagggtttgttttgttatttaggttggagtgtagtggtgtaattttggtttattgtagtttttattttttgagtttaagtaattttttcgttttagttttttaagtagttgggattataggtatgtgttattatgtttagttattttttttttatttttttttaatagagatcgggttttattatgttatttaggttggtttcgaatttttgggtttaaattatttttttattttagttttttaaagtgttagaattataggtatgagttattacgattagtttgaaaaatttagtttttatagtggttttaggtatcggttttagattttatattttattatattattttttgttattatattagttatattgagttcgtggtggttttttatttgtattatttcgcggtgtgttttagttatattcgtgagattttttgatttttttatttgggattatattttttgttatttttttgattaagttttgttttttttttgtagtttttattttagtttgatgagtgtatttgttatttatttttattatagtataagttttagagaaatagaatttaaaaaattgtttatatttttgtatgtatagtgtttagagtaatgtttgattaggataggcgttaaatgagtgtatatttatttgtttaggaatgatagttttttagatattgtagtaggtggttggaagtattttgagttttatttgtaggcggttaagttttgggttttgaagttatttttgttgatttgaaaagggggtatgtatggtgtagatagtatagattttgggatttagaaattgttgaatttagttttaagttgtgtgattttggtttatttattgcgatgttttagttttagttttttttttataaaaaaggagaatttgatgtgtggaaggatttttgagagtagtaattgagacggtgttgagataggtattttgtttagtgtggaggagttaaggggttagtggtgggttagtgttatgttcgtttttttttggggattcgcgttttttttttatattgttgtgaatgtttggatattatttagtttgtttattgttttttgaaaaaaatgtgattggttttgagttgggttattgggtttgatttaatttgaagggttgggggtagttggaaaatagtagagggaggaaatgtaagggaaagaaaggggatggttagagttggggggaattttatatgttgttttttttttttatagtggattttgttgcgaatcggagattatggttaaattagtataggtaaggggttttttttttttgaaggtggtatttagttttttttgggtttgggatttttttggagttattaggtttgttatagagatttttggtatttttagtttgaaaaaaggaggaaaggtttttaggttttgtttgtttttgttataagttatggttttttagatgtaggttattataatgtaatataatttataatattttaagtagaaaaggatgtgtattggtttatttgatagagaggtttagggttttaggtttggttgaatttaggggtttttaaatgatagtgttaagattttgtttgtgtgagttgggtttttttcggtggttttatttttgggtaggtttttttttgtattggtatggtagttattagtagttttaggtttttattttgttgttttggtagtttagggagaaaataatataatttatgtttagtgattttaggggaaggtttaggtttggtttttattggttgtgtttgagtaatttgtttttttttggagtaaggaggtggagttggttttatttgaattgtttggtttgacgaagggaaatggatatttgataggtagaaagatatttttgttgatttttttgttttggatatagaaatgttttttgttatatttatttgggattgaatttttttggtttgggagattttaattttagttttttatgtttgattgttttgtcgggtaatagaattggaggtatttgagaatttttatttttatgtggttgagattaggttttggttatggttagaggtaggattttgatttcgattgtgttttgttgaggttgggtacggtgatttttatttataattttagtattttgggaggttgaagtgagtagattatttgagcgtaggatttcgatattagtttggataatatggtagaattttgtttttagaaaaaatataaaggtggtatgtatttgtagttttagttgtttaggaggttaaggtgggaaatttatttgattttaggagattgaggttgtgatgagttgagattatgttattgtattttagtttgggttatagagtaagttttaaaaaataaaaaattttattttattttgttggggtttgtttgagggtgttgtttgttggttggcgttggagaaagttatgtagttagtgtgacgatgggattggtagggagaagaaatttggggattttgaagaaaattatgggattgggtttcgttgttttttattttaatttagaattattggttatagaatgtatagatagaagttgtttgtgaggtttttgggttttatgttttttttacggaatggttgaatttagtaataataaaattttatttatttttgatattatgattgtttttagtgaatttgggtttataggatatttatagtttttgaagagtataggatgttataggattagtatttttagagaagttttagttgtggttttttttatagttattgaggagtatattgtgtgtataagtggtttttttgattaggaggagaaaatgttattgattatgggtaaaaatttaaggtggaatttttattgttttttattttttatgtgtagttatattagagttattttttgaaaggtatttgaattgtaggattttagatgatttaagtggataggttaggttttggaagattagagaggttaggatttagggtgtagatttttggattttggtttagtgtttttgggttatgttttttgtttggttgatttgtggttttttgttgttatggattagggtttagtagattttttgtaagtgagttttagggtggtagggttttagggaattttttttttatgggatgagttggtattttttatgtatagtgttttggtggggtagtaaaggagttttggggtatgtaggagggtattttatttaggttgaggagagaggggaggttgtttagggagagttatttaggggaggaataagggggtttagagtggtttaggtagggataattgggatagaggttagaaggagagtaaatgtagcgtgtttaggggagtaaaagtaatttggtatgtttggggtgtagtggtttgggggagaggtgagggttgtagaagataataatagagaaatgtgaaaaaagtttttttgtcgttgagttgtagttgttttttttagttattagttcggtttttaattattagtttgaatttggtgttttttaaaattttaatatacgtatatatgtatgtatgtatatatacgtgtgtatgtatatagtaaattgtttcgttttttttggtttagatattttttagttttttttattgtggttattgtgttgttttttttatttttttttttggaagaggagaatttgaggtttaaagatatgaagaagtaggatggtgttatggaagatttaggaggtatggcgttgtggtttttattttatagggacgttttgggtttgaatgtaataatgaatataaaaatattttgaggatagggtaggataggtaggtgtttgtgtttgggatttttaggagttgtggaggtgagatttaggttagtatcggttaaggtagtttttagttggagttttggttatgtatttgtttttttggggatattatttttgtttttaagaggttattaggatttttgttttagtagtagtttgggtggggtttagttttatagagttttagggttcggttgtttattagttggtattaggatttgttgaatattttagggtggaaagttttttttttgttgttttttgttttgattttgggttttcgtagtcgggaatttgtttgtcggaggtgtgataggtagttagggtggggtgggtgaggagaagtttgtgtggttgtataggtggcgtttagagatgtagaatttatgaagttggtgtgagaatgatacggtgggaagtttgggtttggatgatttgaggggttgtttttgtatttttaaatgtgattagtgttaagttttttatttttgtttttagtggttatgattttgtggggttttaggataattaatttagtaggttattatttggaaggttttattagtttcgtgtaaagaattgtgtaggagttcgagtttgttgtttaagaagtttgtttttaagtgagcgtttggattaaggtttgtgtaggttattaagtattttttttttagtatggtattttagttttttttttagatattgttgtgattatttatattgtatgagggggagaatagtggagggggaggagtagtaataggaaattggggtttgcgtgttgttttatttttcgttttttattttggggatatgtttttttttttttcgtattttttttcggtagtttataattttatgattttagcgattttgggtatttaattgtgagttttgaagaattagattttattttaagtatttgttatcgtttatatatttttgttttagtagataagttaaaatagtttttagattttatatattaattagataggtatttgtatgaaatatttgttatatgaattatatgaaatttgttgttatttgattgtttttaatttatatataaggtaagttatatggtttaacgtagtaaagaatgttagatattagggatagggttgtgagtggttagttgagtttaatgggtaaggaaaattatattaggatgttagagttttgtttttatttaggttttgatttaggtgttgtgtttaggttagtttagtagggttagagttgtttttataagagtttgaattgtttatttttattattttttttagttttatttttttgtttttttcgtttttagtggatgattttagtgatagttagtatttgttttgagttttgtagattttgggttggttttttcgaatgttttttgtttttttttaggtttttgttatgtgttttttttgtgtgatgtttttttttttttcgtttttttttttttattttattttttggggttagtttgttgtttattttttaggatttagtttagacgttatttttagaaagttttttttgatttgtttggaatatattcgtagttatttatttatttatttatgaaatatatttagtgagtgtttgattgttttaggttttgtatttggtgttagaaatgcgttagtgagtaagagagatatagtttttgttttttcggaatttcgaaaggaaatattttttgggttttatgttgtttttagtatcgtatttgttatattgttttgtagttgaagttgttatgtatttttattagattttgagtttttagtggtttttggttttaagtatttatttagtagatttttagtaaatgttgtttgtttgtttgattgaatgaatgaatggtagggtagttttagttgttttggaattgtgagtatttgaatgtgagaagtatttaggatgttgtggattggatagtattgttgtttttttatagttttgaatatagggtcgaaatggtatagaggtaaatagtatagggtaataatttaaatgttttagtatttaaggagaggggtaggttggtatggttgattaggaggaagtagtgggttatgtggtggttgtttttttttatttttagtttttatttagatggaatttgaggggaagggagagatggtttgttagaaagagttttggattttttttttagttgggtttttgatttgttgtgtggttttgatatgttatttgttttttttgttttgggttttttgggatataagtggtaatagatttattttttttatttagtttttagtttgtggtttttaaagtttttttttttttttattttaagtgagtcgtgggagggatattttatgattgaagtggattggagattggtgttgttgtggattaggataggttggttagataggtggaaggaaaaatagttatgaattatggtaataggttagtttgtagagggttcggatagattttggaggatttgtttttggtggtattttttaaagtttaatatttttatattggttttaggaggttttgatattggagatagtattgttagggatttagtgttagggaggtttttttttattgttttttttttcggcgttttttattttagagtttgggtcgttatgggtgtttttatttatttatttagtttagttatagttatttttagtttgtatgttaagtttgtgttagagttggggttttacggttttttttaggtagaatgatttgttttatttacgatagtttttattttttatggatttaataattgagtgggaagttgaattaaaaggtttttaaggatcgttgtaaagaaataattttgagtttttgaatttttttgttttttttttttttttttgagatagagttagttttattttgtcgtttaggttggaatgtagtgatgcgatttgagtttattataatttttgttttttaggtttaagtgatttttttgatttagttttttgagtagttgagattataggtgtttgttattatgtttggttaatttttgtatttttagttgaaatagggttttattatattggttaggttggtttttgattttttattttaagtggtttttcgtttagttttttaaagtgttgggattataggtatgagttattgtgtttaggtattttttgtttttttatttattttagtagttaatattgtttgttgtgtttttttgatatcgttggattggaggtgtttagaaagaaagagaaaaggatttagaagtgaaatttttggaggattttagttgtttcgtgtttttgtttattttatttatgtggtaaatatttgagtatttggttaatttttgtgtagtgggtagatggatttggtatttgtttttagaggtttttggattaaattgtttatcggggtggagaaggtagtaggaattttttaagtttcggtcgtgaggtttgaagtaaggttaaggggagcgttggtagtaaagtttttattttgcgtttattgagttttttgtaaggcgttttgttttgggtattcggtatgtgttattttttaagtttttgtttaggggcgtgattaggttgtaggggatttttaggtggtaggaagagagttgtgtttttttttggttagaattttaaatagtaattttacgtcgacgtatgtatattttagaggagttagtttttgtagatagagattagagagtatttagaggtttggtcggggttttgtagtgtagacgttgggaggtacggagacggggagagggggaggcggtttaggatttattttgttttatttttgattttttgaaggtaagatttgtgtggtttattttttatttttttttttttggatttttttttgatttttcgtagttggattagtttttgttgtttttttatattattttatttttgttttaatgtatttattataagttttatagtaattgatgtgtttgtttgtttttgttattgggttaggagttcgtgaaagataggaattgggttttttttttttttaattttttagttattagtgtagggtttagtataaatgaagtgttttgttattgtgttgtgtgttcggtgataggttttggtattttttattttgttagtttttagttgtttttttagattttttattttttagtgttatgtaattgatttatatttgatttttttgtgaattagttttattgtgtatttaggtttaggttcgatgtttaagattttttggttttttgtcgtttttttttttttttttaaagattaagttagtttgtttttagatgttagtttatagcgtagtttattgggtttagaggggtagtgttttgttttggtattgaaatgagagtgtttttgggttttttgtgtttaggattttatttttagtagttggtatttgtaaggtttttggagttggagagtagagcggggttggagagtagagggaaaaggtttgagttttgtgtgattttttataagtggtttttttttgggtttggtttttgtgatagaaataattttaagagcgtttataaatggttatattaatgatatttatagaggtgaaagtgtaaatataaaatgttataaaaatatgaggggttggttgggtgtattggtttatgtttgtaattttagtattttgggaggttaatgtgggaggattgtttgaggttaggtatttaaaattagttagggtaatagagtgagattttattttttaaaatatatatatatatatatatatatatatttgatttttgttatttttgtagggattatttttattttttatatttagttaggtttttttatttttttttggatgttttggaaggtggtgtagggttgtaggttttggttaagttttttttttttggggaaatggtattgttttttgggcgggttgtagtaggtggtatgggaaagttatttatatcgttttttagggtgtatgtggttagtattggattttgtagggaaagtagtttagtttggattagggtaggtatttgatttgaggttggggttgggagtttggttttagttcggggttggtagtttattttttatttttttttttatagggtgttaagtatcggggttttatttatgattttttaggttttgattttaattaggatgtcgaggttttgtatattgttatgaagggttttggtgggtgttaggttttatgggagtttgaggggtattttttaaaagtagatatagtttagagtttttttggtggtggtggtagggtttgtgaaatggtgaagtgtatttatttatttttttggttttttttttttattaatttttatgatgttataataaaatgttttagaaaaaaagtataaagaataatagaaattttatttatagatttattattaaatttaagaattagtgttttattagtatagttgaagtttttttggtagattttttttttgataatgtcgttcgttgtttttgtttagaggtagttataattcgaaggtggtgtttatgtttttttttgttttgtggtggaaagaattttgtattgggtgttaggatatttgggttttttaagttaggtttattgtgagattttggataagtttttgtttttttttgggttttaattttttgatttgtgtagtgaggagttggattaggggttttttgagtatagatattgtgtgtgttgtgtttatttttagtcgtgatttaataaatttttatgattttttgttttgatattagtatttgatgagtggaaggtttatgttgaggtttgtagggagttattaggtttgtgtttagggaaggaagtggttttggtgggttttttggaggtagggtgggtaggatgatgattgtttttttttattttaggtagtgataaggaggttatattggatataattattttacggagtaataggtagaggtaggaggtttgttagagttataagtttttttacggtaaggtaattatagtaatcggagggtttatggggtgcgggtggaagaatgattttatttatttgtgtgttcgtttaggttattttttggatatggtattttaggttagtttgtgggttgatattttattttgttttttttttttttattagttgggcgttttttagtttttaatatatttatagtatttgttgtatgttgggttcgtgttaggtgttagggttgtattagtgaataagatgggtgaggtgttaattttgtggattgttagatagtgagagagatatatagtaaacgaggaaatagatagtggtggggaagtggtatagggttgtggatttgattttgtatagtcgtttgttagtagtatgatatggagtaagatttttgttgtttttgagtttgttttttagggttggtaatagtatatatttttaagggtgatgatttaatgagattatttagtttagtatttgttagagtaagtgtttattaagtgtaatttttatcgttgtaattattttttttttttttttttttattttttttttttttttatttgttaggattttattgttgatttaaagtatgaattgacgggtaagtttgaacggttgattgtgggtttgatgaggttatttgtttattgtgatgttaaagaaattaaagatgttatttcggtaagaagtgggggtgtatgtggtgttggggtggggatgtggttaatgggaagattttgggtttttttaaaagtaattggtgagttttatatttatttagtatatgtgttttgttttaaagatatatttaaatttattttagaggagtatttcgattcgtatatagagagatgtagatagatgttaatatgatgtagatttttttattaggagtttgtagtttaaggatataggttatagggatatggagataaattgtgtttaatatttttgaggttaagggtatattaaaggtaattaatatgattttgggttaagggttgtttgagagggtattttaaaggataataggattaagttaagttttaaagtttagagaggatttggtggatagtagtgttaaggttattgtagggtgtaaaaatggtaggagaagttgtggatttgtgtttagggtatgaagagtagtttagttcggttgaggtagaggtagagaattgttttttaggaaaaagagaggtaaagttttttaagtgtatttagtattttatagtttataaagtgttatgatttttgttttttatgagttattaagtatgaatttattttataaattgatgtatttagtaatgtgagattattatttttttaatttttttgtgagtttggtagagtaattaatattatttatattttatagatgagaaaattgaggtttaaaaagatagtttttgaagagaatttataaagttggaggaggtagaattagaatttttgtgttttagtttatttttatatcgttataaagaaatatttgagattgggtaatttataaagaaaagaggttgaattggtttatggttttgtaggttgaataggaagtattgtggtttttgttttcggggaggttttaagaagtttttagttttggtagaaggtaaagagggagtaggtattttatatggtgggagtaggagtaaggcgggaggtggggaagtgttatatatttttaaataattagattttataagaatttacgatcgtgagaatagtagtaaggagatggtgttaattatttatgagaaatcgtttttatgatttaattattttttattaggttttatttttaatatttaggtttacgattcgatatgagatttggtggggaaatatatttaaattatatgattatgttttatgagttttaaggtaggagtttttaattagtgtttaagagttgggtaggaattttttgagttttggggtgttatagttttggttattttttgattttaatttgtgtttagtgattttttatttttgtttttaatttatgcgttttttttttatttttagggtattggtattgatgagaagtgttttattgagattttggtttttcggattaatgagtagatgtattagttggtggtagtatataaagatggtgagatgggtaggaggggtcgtttaggatttttagatataaaatgaggatgattgtaatagtggggatattaagattttagttatttatttttttttttttttttttttgatttatttgtttatttatttatttatttaataagtatttgttttgtgttgggtgatgtgttaggttttcgggataaaattaaaggggttttttttttttaggttaatgagataatgagataatgaaggagatatataataaataggtgaatagataaatatagtgatgatggattttagttaagtgttgtataggaaataaggtaataagaattaaatttttattagtgaggttttgggaggaaatgaggaattaatcgtataaagaatggagagaagatttttttaatagaggttacggtaagtgtaaaggttttgaaatagaaatgagtttggtagtcggtataaggttagataggtagaggatagggtaggattatatagggtttgtaggttaagagagagatggtgttttattttgagtttaatgagaagttggggagtatgatgattagatatgggttttaagatagttatttttgttgtcgtgggttggaaaggaattgagaatagaggaggagagaattatcggaaagttgtagttattgtttaggtgggtcgttatggtataggtgggttagagagaatgaatagattttattttattatattatggttagtacgaagagttgtgaaaatatattttgggttttgttatgatggacgtgtagattgggttttggaatttttaaaaatatttgattattttgggggtagtagggttttttattttagatttttgaggtttttggggatgagattagagtttgcgtttttttttgtagtttacgagcgggatttggaggttgatattatcggcgatatttttggttatttttagaagatgtttgtggttttgttttaggttggtttatagtttattttttttttttggagtttgggatagtttttgtttggtttatttgggtgtagatttgaatgtttagggtttggttagttttttttggtttgtataggtaggtgtatttggttaattttttttttttttggtatatagttttttcgtgtttaggagtgttttttgttgtgattttttttttttttttatattcgtttttttcgtttttttttgggttttttttttgttattgtttttgtagttgtatatgtagtatttttggattttagtatttttgtggttattgtgtggagttttttatattcgagttttattgtttttttatcgttcgtttaaagtatattataaagagattattaggaggttataaattggtgtttgtggttgaatttaatttgttaagttggattttttgtttgtttttttataaaatgtgttttaagaaagaaagtaaaataagtttgagttagttgttaatatttaaaaattgtgagattttgtttaaaaattagatttttggattattttaatgtattgaaagttgcggtagtagtagatttgtattttgtacgattgtagtgggttggagagtatatgcgttttgttcgttttatcgtgaatgttatttatttggttttgtaggtatttttgtgattataggtacgatgggaataggtattgagatgttttaagtttagttttaaggattaaatggttatgaaattttatatataaattaagttattattatgttttttcgtttttttattttttttttatattagttttttttaattttgttttttttattgttataataattttatattaattagttggggaatgattaggagaaattttaggagtgggatagtgtgatttgtgttttatttttaaagttgtttgttttggagaggagtgttttatttttgtattttggagttaagcgttttgtatttttaaggtttgatattaagtagtagcgcggtatatattgtaagtttgttagttttgttttttgtttagttttaaagagaattttgggggtttgagattttggaatgtataatttagggggaagaggggatggttatagatttttttaggttatttgtagatttttgtttacgtaagaaggagttgagtattgttcgttttttttttttttgtgtatttttttatgtgtaagttttttttattagatgaggtaaagggtatgggtagaataatagaagtattattaggatttggtgattttgtagtttgtgagtttagattttgggatttgagttttaaatttttattggtgaattttttaagttaaggtataagagtttttaatagaatgtaaatgtttagattttttgtttttgtggaatcgttgttggaggagtgttatgggttatgtaggatttgtggtagggattttcgagaatttggggttttgtttttagagaggtttttagggtaaggttttgtttatttttgggttggggatatttggaagaattttggttgtttttgggatttttttgtgtggatttagttttgacgaggaagggaaaggttagagggagggttttttttgattggtttataaaatagatattgtggtttttatgtaatagtagttattgtttttggatatatttgggttattagggtttttttgttttttttgtttttattattggtatttaggttttttttttgattttgtagtgtttgaaatatatgttttttgtttttttgtttagggaattagggaggaggatgacgtagtgagcgaggatttggtataataggatgtttaggtaaataagtattattgaaagtttttgaggtatagtagaagagttttgggaggggagaggttggggttttgggaagggttggaggtgaagttatttgtattaaatattagaaataatttagttatagttgttatgtatatcggtgttttgttgaagaaaagatataagttattttttaaaggtatattttatatgtaatattggtatattggtgaggtgtattttggagttttttttatttatttagtttttagatattattgaagtaaaatatttagtatgtgttaggtattttgttaagtatttagaaattattaatgaataaaattaagtggtatcgggagagataggtatatattaattatataaatattttttttattaatatattgtatattgtaggtgttttgagtatttagtatatgttagtagtattataggggttgatatagagaatgttatgatatagtttttgttgttgaggagtttatgtaatagtgtggagatagataggtgaagaaattattattatatatagtagattaaagtgataaagaagtagaaagttatgggagtttaggagagggaggaaaggagggaaatagaattgtgtttgggggtatcgggaagtattttgagaaaaaaatggaatatttaatttgggttttgaaggttgagtaggagtttttttagaaagaaaggaagaaaggtatataggtatagttatgtattatataatggtgttttggttaatgatggattatatatatgatgttagttttataagattatggattagatatgtgatgttagttttataagattataattttatatttttattgtgttttttttatgattatttatgtttggatatataaatttttgttattgtgttgtagttgtttatagtattcggtaagataatacgttgaataggtaggtgtgtcgtttaggagtaataggttatattacggagtttgggtgtgtagtaggttatgttatttaggtgtgtgcgagtgttttatgattatataatggtaaagtcgtttaataatggtagtttttagaatgtatttttattattaaatgatgtatgattgttttatttgtaaaggtttttaggttattaattattcgtgtgtttagggattaggtagtagttttgagtggtttggttagtgtgttttgttttttgaggtttttttttttagttaagtgttatttttttttttttaggatttatacgaggtaggggaattgaaatggggaatagatgaagtttagtttatttatattttgggaaatcgtagtaagtagtattttcggttgggtaagttttagagaagatttgaagttgtttttttgggttgatgttaataatgtttttttttatttttttttttttttttattattaatggaatatgatatttattttatttttaatttaaattttagttttgagtttattaggttggtgtaaaagtaattgcggtttttgtcgtttttaaaggaatggtaaaaatcgtaattatttttgtattaatttaatattagatagtagtttgtatagttttttagtaaagttattaataggatgtttggttttttattttagtgttagttttgtttttatgttaggggatgagatatagttttttattagttatgaagtttatttgtatagcgttggtgatgtgcgtgattttttagtcgtttttattatagtattagttttagttttatggtggatagtcgttttggttattgtgtttttttgtttttgaagtttttattttttttcgggggtatagaggtatttttaaatttttttgtttttttgtttgacgtagtgttcgatgagtatttgaagattatagggaagtcgattgaagttagtattcgaggggagttgtttggggattttgagaagttaatgttggtcgtaggtatgttttgacgttgtatttttgggggttttaggggattttggaatattggtttaggaataaggggttgagaatggaaaggggaattatatggtatagaattgggaaggagaaaattatgtgggtcgtgaattttaaaggtttttttagggtagtatggttgaggttggggacgggaagggggtttgagttttaggtattgattttttttagtttttttttttattattggtagggggataaagagttttgaatttgggttgaggataatgatgattataatagttgatttttgttgagtatttagtgtatgttaggtattgtgttgagtgtgtaatttttaaaaaagatttagtagtggttattgttatgatttttattttatagatgaggaaattgagttttattaggttgattattttttgaggggtagttttgtaatgagttgggggtattgagaacgtgaggatgtgaggaattggttagttagtggtggagttaagatttaaattagggttttttttatatgggtttggagtaagttatttttgtttgttggattttagtttttttatttgttaagtggggtgtagggtgtgggggtaggaaggatggattgttttaattgtttttttagaagtttttttaattttggtattttagtagttagtatgtttgagttagggatatgttgtgtgtttgtattttttgggggaaatttgtagtttttttatcgttttttttagagttattttttgttttttttgtttgaagtagttagttagtgggatttacggtgatttagtgggatttataatgatttagttgttagtatttttttggtgtagtaggtttaaaaaatatttttttttttttcgttttagattttatttttattttagtttaattttttgttaaaattaaaaggattagaaagataaaggcggtttttgtgatggattttaaaaggattattttaataagattattttttgtttattttttgggtgtgcggtaaaagtgggttggtttggggtgatttggggttgtgagttattaggaacggtggttttttttgtattgagttaggtggtttttaaggaatagaaataaagagggagttaggttattttattttttttttgaggtagttagaataattttatttttttttttttttttatagtgaagtgtattcggagtatttcggaatattttgttgaaaggttttttaaggttatgaaggtgcgtggtggggttgatgtgaatggggtttggggagaggattattgggagtttttgataagtttttgggatttagtggttaaagagagttttttagggatggttataggattgattttggtgaaggtgttttgtcgtaggtgagttgtagagttaggaatgttgttggttatatgttttgttatttgtatatttgtttgacgttatgagttaatagatgaatttagggtggtagtttgtatttgatttttttagttaaatgggttggcggttcggattttgaagaagtattaattagaatgtttttatatagcgtatgtaggtaagattattttggttttgtttgttaagatttatgatgtttattttgtgatagttttattttgggtgtgtttttgagaaagttttttaggtttttatatatatgacgtataaagaaattggtatttttgtgatgtattggaggaaatgaatgtagttatttgttgttagaggtttgaggttcgagatataggagtttgggtttttttggttttggttggttatttcgaaaggataaagtagattgtcggttattttttgtttattagtgtgttataatgaggttgggtagtttagttttagagagatgtttgtttgtatgtatgaatttattaagaatgtttattataaggttgagtgtatgtagtggtttatatttatgattttagtattttgggaggttaaagtgggaggattatttgaggtttaaagtttaagattagtttgggtaatatagtaagatttttgtttttataaaaataataaatagaattagttagggattgtggtatatatttgtagttttaattattcgggaggttgaggtaggaggattttttgagtatagggtttttgggtttgaggttttagtgaacgtagtgttatgtgattacgttattgtattttagtttggataatagagtgagattttgtttttttaaaaaaaaaagaaaaagaaaaaaaaaatttataatagtattgtttatattaggaaaaagttagaaataatttagtgattattaggaatagtatagtaaaaatttaaatgtatagtggtatatttgtagagttttaaaatgtgtaaatttaagtgtattgtttagagttataaagttatggtaaaattataaggaaaattaagtgtggaaattatatatgaagagagaagaggtttataatagtgagagggtcgggtatggtggtttatgtgtgtaatcgtagtattttgggaggttaaggtagtttttgaggttagtttaagattagtttggttaatatggtaaaattttatttttattaaaaatataaaaattagttaggcgtagtggtgggtatttgtatttttagttgtttaggaagttgaggtaggagaattgtttgagtttggaaggtagaggttgtagtgagttgagatcgtattattgtattttagtttggataagagtgagatattgttttagaaataaataaataaataaataaataaataaaatagtaagaggagtatagagagagttttaatgggaatggtaatgtttgttttttttgttttaaattttaattttttattatgaaaataggatttttaattaagttgggagttattagtattttagtttttttttaagtttatgttttttaaatttatttgttttgtagggtttggggattcgggataatattttgattcgtattatggtttttcgtagtgagttggatatgttcgatattcgggagatttttcggattaagtatgagaagtttttttatagtatgattaaggttagtagagtttatgggggtagagaagggagtaaagagttttttgttaagatagagggtttggggattatttttaggaaaaggaaatgttttaggaagtgggagttttttggatattttaggagtttttgttttgtggtttatttaaggaatttaaggatatttaatagaaaagtaagtgttaggggtgtttgtgagtggtaaggttatagaaggaggtaggggttgggttatgaaggatacgtaagttgaattaagtgcgaggattttgttttaagggtagtgatagtttagttttttggaagaaggttgggaaatattgaagaatataaatgagggttaaaggggaatttttggtttgggtcgggtgattggtgatgattttgggatattcggtttttgaggttttattaggagatatatgtaaagttaggggttttttttttttttttttttttttggatgattgaaataaaattttatggggtgatagagaaagagatttaagttgtattttttaaagtatgtttttaaagggtaatttttttaggtgttatgtgtaaaatgttttatgggaaaataagtttgtaataaattataataagtaaagataaataagttagtttttttattttagaattttttatagttttttatattttgaagtttattatgaagttttaagagggatatggaatatgtatttatacggatatgtgtatttgtgtaatatatatttgtttgatttttttgtattttttaatatttttgtttatggaattttatttttatgtatattttatgtggaaggattgggttggggattgtttggtggtagtgttgtgttggggtattggtttgaaagggtagcgagtatttttttttaatttcgtatattggtagtaaagttatattggtaatttgaaattgtttattgttagaagtatttatattatagaaataggtaaatgttataaattagggttttttttaatttgttcgttgagaattagttatttaatattaattagtataggagggttagggttgttatgaataagtgtttatttagttttttttttttttaggttgtgtagaatttttatttttttgtttgagaggagtttagggttgggtgagaggtaatttttttttttttttttttagaatgatatttttggcgagtataagaagattttgttgaagttgtttgggggagatgatgagtaagtggttttttggtttttggttggagggtatggttttggggtgttaggcggggatttttttggttcgtattttgatgggtggattggatgagttggggatttttttgagttaggagcgtcgtataagtgaaaggcggtttttgttggtagttgttgtgtttgtgggtttgtgtgtttgagagtgtgggggtttgaacgtgagcgtggttttttgtatatggagatgtttgtttttgtgaatttggaaagttagtttggggttgtggattaggaattagaatatgagtatttaatttttgttattttatagttatttttcggttttattatttgttaaatgggaaaaggatatatttttgttttgtttatttatttatgtagtatatttgtgttaagtgttttttgggtgtagattttgtgaggaagtttttgatgaaggttatagcgtagaagggtatagattagtttttagaagggagtagttttgtgttggggagaattggttgtgttatatagaaagtatatataaaagtatatagagatgttttagtttagattaaggggagattttttggagatatacggtgagatttaaggaggaaggggaagagttaggtgaagagggtttggggatagtgtttgggtggaggaaattatttatagaaaagtcgaggagtgagaaggagtggtttgatttatttatatgttcgaagttatgtatttatggagtattagagagagaaataaggtagagaagtgggagggtttgggggtttttttttagaatgttaaattgggatattatttgattagatttgtgtttgagaaagggaataggttgcgttttgattttttttttttggattttataaagatttaattatagaagggatgtaagaattttttgtgaatttttggtaaggattataggggttgatgtagtttagtagatattattgagtttttgatgtatttaggtattttgtaggaggagatgtagggttggtatggttatagtttgtttaatggtttttttgagaggggagagttggatagaagttatttaaattttaaggaagaaaggggaggttgaaggattggaaaaattttattttgtttggattttgtagttaggaaggttgtttttaaaagttagtattggtcggatatagtggtttagcgtttgtaattttagtattttgggaggttgaggcgggcggattatttgaggttaggagtttaagattagtttggttaatatggcgaaattttatttttattaaaaatataagaattagttaggcgtgatggcgggtgtttgtaattttagttatttgggagattgaggtaggagaatcgtttgaatttgggaggtagaggttgtagtgagttgagatcgagttattgtattttagtttgggtgataagagtaaaatttcgttttaaataaaaataaaaaataaaaaaggtagtattgtagggggttttaagagatggaaggtttttagaaatggagggaggattttggcgaatggaggaggtataggttggagagaaagaaagtttaatgtgtgtgtggtgtgtgtacgtgtgtgtatgtgttggggtgtgtgtgtgtgtgtgtgtgtgtgtgttggtgtgagtgttgtttatgatgatatttttttttgttttttttttaaatttttttattttagtgttgttggttagtttttttcggaggtagcgtaggtggtttattagatgtgggaatttagtgtagtggttcgagtagaggttagatttttttttttttttgtttgattttttgattatagtttttttgtttgtatttttttgttgttttggttggtatttagttgttttttggcggttaattcgatacgttgatttttatatttgaagttttttttttttttttggagtggtgaattggtggaggggcgtatttggtttttgtattagtttttgatacgttggaaagggttttggtttatttattaatagggtttgttgaaatggagatttggttggttttatggaggggtttgtttcgtttggagtcgaaatagttggttttagagatatgaaagttgagaatagatgggtatttttgggtgtattggaggattttaggttgtttttttgagtatttttagattgggggtttataaaggataggaatgaaaggttttattaaagtattttaggtaaattattttagagattgtaatatttggtttatataaaaaagtatgggattttggagttttttgttatttattcgttatgtaatttttggaaggtgttttttttttttgggtttttatgtttttatttttaaagtgaggggttaatatggtaatttcggtgattttttagggtttttgagttttgatgttttaggatagtgttttttaaatgataaggtaagagatttttgtagatgattgtaggtgatgtgagaagtgaatttagtttggtagggttgaataacgttgaattttatagagtgaatgagaaaggtatttttttttaattttattagcgtttttgattacgttaaagaggaagttttggtttggtgtcgtcgtttttgtaatatttgttgattttttttttttataaagagaaagttgagagagttcgttttaagttttagagtttttggtaagtagaggtattatgttaaattttatggtatattattttttttgtttttattatgttgatttttgtggtaaattgttagtttatgatatatggtattaattttttaatttatggtagttatataaaattaattttatttatttttttttttttttttttttttgagatagggttttattttgttatttaggttggagtatagtggtatgattatggtttattgttatttttttaggtttaggtgatttttttatttagttttttaagtagttgggattttaggtggatattattatatttggttaatttgtgtagagatagggttttattatgttgtttgggtttattttgaattaatgggtttaagcgatttttttgttttggttttttaaagtgttgagattataggtatgagttattgtgttaagttttattaatttatttaataattattttttgagtgtgtttattatgttagatattgttgtaggtatttgggatatgtaataggataaaacggatataattttttgttttttgggagtaattttaaatgtattttaaaaattgatgtatttaagtagatagaaaagaagttgaattatataaaattattaagagatggtatagtgtgtgtgttaatttggaatagtgaaagttttttaggagtgattgaaatttgggaaattttgttttggtattttagaatttttttgttgtttttttagggggaatgattttttaagaggtagagggggtttcgggggtagggtaggatttagaagaattggggatgtttcggtggaataagtagttaaggggtattagaatcgaggtagatttcgtggtaggcgggagtttagttaattttttttgattaggatttgttttgtttttagttttgagtttttttttttttttttttatatttttttgttttttttttttttttttttttttttttttttagttttcgtgtagggtttgtttgttgtggttttatttttgtttttttttttatttacgtcgtttggtttgggtttatggggtgagttttttattttcgtatgttgttttttagtttggtttttaggggggtttttagatatttgttgagtttttttttgttttttatagttgaagggaattgtgcgtttagttaatgattttaattttgacgtagatgttaaagcgttgcggaaagttatgaagggattcggtatgggggatgggaagggagtagggttggtttttagggtagtaggtgtggtgggtttggtcgtgggttggtaggggatggagtgaggttttaaattagagtttgtaggatgaggaaggtttgattttaagtttttatttttttagtttttagagtatagagaggaggggtaggagagggtttataaggaatttggtagaagttttttttagggattaaggtgttttttagttttttggaagtagtattttggtattgaagaaagtattaggttataaaattggtatggtgttttggttttgttgttgatttatcgtgtgattttgggtgagttttttcgttattttgggtttgaatttttttatgtgtaaaattagggttgtggattttggaatttaagagtttttttttattttgtggtgggagtgtgttttgttgggtaggttttttagatttatatttggtattagtgggaagagtattgtatttataggtttagattagttgggtttgtgtttagaaagtttagtttgggataggttatttagggtttggttttttttgtttttttgttttatttgtttgatagtaatttttaggaggttttaggttaagtttattatttttttgagttttttttttatgtgttttatgggaatgatgatatttgttaagttcgtttgggattgtaggatgttagaggtaaaaatgttatgaaagatttttgtgttgggtttgtggttgatggtattaatttgagaagtaggaagtgatattttaatgttttttagagttaatttgttgtggttagagggatttagggtttagtttttagagagttgaagagaaaggatatagagttgttaataggatttggattgttagggttggaaggattttttggtgattattttagtttttttatgttatagatgtggaaattaagttttattaagggaaggggatttgtttagggtgggtagttattgttagagttagaattagaatttagaggtattgatttttaatttagtgttttttattttttagttgttttttttttttagcgtgttaaaaggaaagggagggaggagtttagtagaaattagtggtttgagttataggtaagcggattgtagggatttaggagtatatggtcgtttagttaggtttttattttgataaagatcgatgaggggttattagtgggcggtgtatggggaaagtcgagagttataggtttttttttgaggtatgtggttttggtgatttagggattgacgaagatataattatcgatattattacgtatcgtagtaatgtttagcggtagtagattcggtagatttttaagttttattttggtcgggtaaggatttttttttgggttttttgtgtaatatgtatgtattttgtttgattgagtttagtttgtttttatcggttttgtatagttgggtattagggtttttatggtagagggattttgtgtggttatatgattttagagtgtttttagtattgggtttgggtagatatatttttttatgtttttagttttttgtgatgggtaatatttgtgtgagttgtttagtggatttagaggtatagtatggggttaagattagggttatgagttgtttttagtgtgttttgggtattttgtaatttttttgtatagatagagttggttttaaggttttaattgagtgttagggattattgtatattggtggtatttggtttaggttgatgtatttttttttgagtggaaatagtgttttttagttttgttgttttttcgtttttgttttttgtgttaaggagagtgggttttttttttggttgttttttttttattttttttggttttatttaaataataagtataatattagtaaagatagatataagtttttatgattttttatgtggaatttttgttttttttttttattttttttattttgagttatgtgtgggtaagtgttgatgttggtatgattgtggttttgttttttgtaggatttaatgattgatttgaagtttgagatttttggagatttggtaaggttgattttggggtttatgatgttatcggtttattacgatgttaagtagttgaagaaggttatggaggtatagtgtggtattagggggtttagtgtttgcgggtgttaatagggatataggtgatttttataagtttaggtggattagttgtaattttttggtagaattttttttatatttagtttaaattggtataaatataaaaggagatgttggtttttataattgaaaattataggattagttttgagtttagagatttaaatgatgttttgtggatttttggtttatttttgttttggttttgttgtttttttttttggttttatttttaggtagtttttttttttatggtggtatatgtttatttcgttagttagcggttttagtagaaagagttttttttttttaggagttttaataataggtttggtatttattttaagttgatttagtttaagttatatgtttattggtgttagaagggttttatggagtcgttggaggaagtggggtgggtttcgaacgaaagtattagtagttggagtttgtattttagtttagatttgttatttatttatagtgtgattgggttattttttatattttttaattttttgtgtttttatttgggaaatggaaatggttatttttgttttttaaattaggataggttaattaaggttataggtatgaagggtattgttaatttcgaagatttgattttatattaaataagaaagtattatgttttggtttagaagttgttagaattgttttgttttttaaggtattaattgtattaatggttattgtttataaagagtatatggtaatttttttaggttaggtatattagtttaattagttgtttttttaagttataaggtagggtttttattttgtttttattttatagatgaggaaattgagatttggaggttaagttgtttggttatggttatagagttatgaagtagtaaagttgaggtttagattagtttttttgattttagagtttgttttgataatcgtataaaattagtagtgtttttggttttttgcgtattaagaggagggtagtaatggggagttagaggattttataaaaatattgtttaggttaagtagattgagatgattgttttttaaaatatttaagttaaaaagtaaacgatttaaagatatagggtttagaaatagaagagatcgatgaggtaatttaattgaattttttttatttttaaagtttttaagtgggaaatagagaggtttagagagttagtgagttagggggagacgagggttagatttagttttaggatttttttgattgttttattatatatttgtttttaataaagaaatgattgaagattttaattaggatgaattttttaggatttgagaaggtaggattattagagtattaggtagtaatttttttgaggatagagaatatgttttgttttttgtttttttttttttttttttgagacggagtttcgttttttcgtttaggttggagtgtagtggtgtgatttcggtttattgtaatttttattttttaggtttaagcgatttttttgttttagttttttgagtagttgggattataggcgtacgttattacgattagttaatttttttgtttttttagtagagaaggggttttattatgtttgttagcgtggttttgaatttttgattttaagtgatttgttttttttagttttttaaagtgttgggattataggtgtgagttattacgttcggatttttttttttttttttttgtagttgtagttttagtattttgtatagtggttagtatataataggtgttttaataagtatttgaatgagtgaattagttattgatttatttagttaattaattagttaattttgtttgtttttttttttttttgatagtttttttgtttttttgtgtgtagatttttgtatgataggtttttagtttgttttagtttagggtatgtaacgttttagtttataaattattttttaaatttaagagtaaataaatgtaagttagttatgatggtttacgtttgtatttttaaaattttgggtttgagtttaggagttttagattagtttggataatatggtgaagttttgtttttataaaaaatataaaaattagttaagtatggtggtatgtttttgtggttttagttatttgggaggttgaagtaggagaattatttgagtttgggaggcggaggttgtagtgagtcgtaattatgttattgtattttagtttgggcgatagagtaagattttgttttaaaagaaaaaaaatttagtattttattttaagtataaaatttttttttttttaataaaataatatatgtttattgtggagatttgaagaaatagagtaaaaaagaagaaaatagtaattatttgtgattttttatttatatagagattaaattgttagttaatattgtgaggtatgtgcgtgtttttttgtttttttttaatatttataagtagaaatttttatttagatgtttatgtgtatatgtggtgttatatatatacgtttatatattttttttgtttggggggttggaaggtaaagtagtttatatgggaggttttggggattttgagaggttggtatagttagttttggttgtgttaaggttttgggtttgagggttatgtttggaggtgaggagaaaatttaggaatgtttggtttgagttttagtcgttcgggttttatggatttttgtataggaggttagaattatggttgagattatttttgttttgatattttagggagtcggtatagatgaaaaggtttttattgaaattttggttattcggattaatgttgaaattcgggttattaatgaggtttataaggagggtgagtttgggaggtttgggtttagatgttgggagaatagttaggttttttaatttttaattttagtttatagttttgtttaggattttggtttgtttttttttttttagtttttgaggatttgataagttttttgggtgtgtttatttttgtgtttggggaaaagataggtgttttggtaggataaaggtttggaggtagaaaagggtttggttggaagtgggaatagagaatattttggtttgttggagagagggagggcgattttaggggtgtgtagtttatgtagttttatagggttttatagttagaagggttttatatttggttgtaagttatgttgttattgtttagaaattttttatttttaagcgagtggttttatatttttattttgaagaattttgagtattagttaaaaatgtttaaatcggttaggtgtagtggtttatatttgtaattttagtattttgggagttttaggtaggcggattgtttgagtttaggatttcgagattagtttgggcgatatggtaaaatttcgtttttataaaaaatataaaaattggttgggtgcggtggtttatttttgtaattttagtattttgggaggtcgagatggtggattttttgaggttagaagtttaagattaatttggttaatatggtgagatttcgtttttattaaaaatgtaaaaattagttaggcgtggtggtatgcgtttgtagttttagttatttaggaggttgaggtaggaggattatttgaatttgggaagtagaggttgtagtgagtcgatattacgttattgtattttaatttgggagatagaatgagattttattttaaaaaaaataaaaaataaaaaaattagttaagtgtggtggtatgtgtttatagttttagttatttaggagattgaggtgggaggattatttgagtttagggaggtcgaggttgtagtgagttttgattatgttaattgtattttagtttgggtgatagagtgagattttgttttgaaaaaaaaaaaaaaagtttatattttttattttataagtagttttaaaatggtagaatttttgagtataggagtgatatagttagagttttgtttttgggtttagtaattgttatgtaggagggaaggtagaagagagaatgataatagggaggtgatttaagaggttgttaaatattaaaggcgagatgtaatgggattttaattgggatagagttgaggggatggaggggagatgatgggttgatgggaatgtttattgttttataaaattagtaggaggatggttggatgtttttatgagttagttataaatttttttatttttatttttttttgttaatattgttttggtttaagtttgagttttttggattttttttttcgtaattaaattttttttggttagtagttatttatattttttttttttgttttagattattataagtttttggaggatgttttgagtttagatatatttggttattttaggaggatttttatttttttggttacggtgagtgaatttatgggttttaggtcggtttgtttatcgggaggtttgggaggaagggaaggtttattgagtggagggtataggggagttagaagtgtatttttgatggagagggggtgtttttttatttgtttttttagagttttatcgtttatttttgttgtttttttgttaaagttggcgtggtattattttttttagatagttttttttggtggtttttgttttggtttgttgggtttttagtttataggataaagttatatgggtgatttttttttgtgttgttatttgggagtttttgttattattttttgaatttttataattaaaatggtagatttttattgatagttatcgagagtttgttgtgtgttaggtattggtgttaagtgttttgtatatatttttagttaatgattataatagtttattttatagaggtaggattttcgtttttgtgtagttgatgaggaagagtatttagagaggtgaaaatgagtagggtgtgtggtggtatagagatggagatgggtcgatgtttggggattgaatttttttgttgtttttgttgtaggggtatcgtgaggagggaggagaaaatttggattaggtacgggaagatgtttaggtaagatttttagtttattttagttatttttgtcgggtgtttttgagatgtaggtttagtttatgcgtgtttacgtcgggttttgtttgtgagtgaaggtttttggtaggggcgtggttggtttgattggttgatatttagattgtagaaatgaggtttagaagtgtggtgttggtattattggtattttttaggtgaatagtaggatttttagagttggtagggatttgtagattatttaggttaaagtttttatgttatagtgggaaaatggaggtttagaaagggtaaatgatttttgaaagttatatagtaaattagtggttttagtagaattgatttttagagagttggtttgggaatttgttgagaagagggtttgagtgttaaaggtttcggtttattatttgtaaaatgggatcgagattggagggagtgttttgggacgagtttagaaagtaagttttttaagggttggaatttttattttgtttattgatatatttaaagtaatatatgattagtgtttaataaatatttgttgaatgaatagtagggaaaagggttttttaggagttttttggttgttttgttttagttttgttttttagtttagtgagtttgaggtttggaaatggttttttttggaggttggataattttaaatttattttttttgagggttttatggttgggtagtttttattgaggttagtgtattgttttttattgatttgtattttgattttagtatttagtagtttgatttaggtttatgtttttattttttttgattgttttattttttcgtttttaaaagttgtgtttagggatgtggggtatagatattatagatttttatagatatttagttttttttttttatagttggtgagttgaaaagagtattgatggattgagagttagggaattaatttttttgtttttaggttttataatagaagtgtggtttgttataatagtatttgagttagaaaaatttttagttggaatttgatagttatagaattgtaattataatttttagaatgtatattatatattgagaacgatgttaagattattttatacgtttttatgttttttttttttattagaagaaaatgaagttttttaatttttttaatgaaagaatttttaagtggtggtggttttatttgaatttaggtttgtttgatgttagagtttatgtttaattttatttatagtaatattttttaagatttagtagagttaaggttttttgtagtttttatattaaatagttgttgttgtttagttgtttaatttttgttttggaatatggttgttaaaagttgtagggttatatttaaatgtatggtattttagttatattgtgggtatatggatgggggttaggttgagaatttagttagatattagggtggtttgttgaggttatattttatttatttatttaatagacgtttattaagtattattgtgaatagtttcgtgtgttgttgagagttttttaaaaattttagtttttattttaaatttattttttaattttgaattgattttttagggaatgtttttgtttggtgtttggtttgttaatgaggttgtgtttttaattgtcgttagtagggggtagtggtgggttttgttgatagttgtttcgtaaaaggagagaagtggagagagagaattcgggtggaaatagttaagggatttttgagcgagatttttgtttaattcggttgtttttttagatttaggatgttagatttaagtttatttttttataattagtagtatatttttttatagaaattagaaaataaggagaagttaaaaaagattttataatttaatagtaataagtattgttagtattgtggtatatattattttagttgtttttttatgtatatataaaagtggattttttatttttgatagttaaaaattaatattatgtgaatattgttgtatttttaaattaacgatattatttaatggttatatattgttttatatttgaatttattatgttatttaattagttttttttttagtagtaaatttttttattatatttatgaattatttattagaatgaatttttagagatgaaatggaaatgtgggagtaaaatgtatataaaaattaagggtatttgatagggtcgagttaagtttttttttagataacgtatatgagtatttggtagtttgtatttgtttgttttatattgtttttttggcggttttttattttggatgtttagaatatttttaagtttttagaagtttgggattgttattaattagttgaatatatgtttaatttttaattgtggttttatagtgattgttaattgtttttttttttattttgttgtttaattagagtaataaattataaataattattatagatttattatgaaatgaaggattgtggttatttttagataattaatatttagatttttttttttttttttttttttttttttttttaagacggagtttcgttttgttgtttaggttggagtgcggtggcgtaattttggtttattgtaacgtttgttttttgggtttaagtaatttttttgttttagatttttaagtagttgggattataagtttttaatattatgtttagttaatttttttgtatttttagtagagataggattttattatgttggttaggttggttatgaatttttgattttaagtgattcgttcgttttagttttttaaagtgttaggattataggcgtgagttattatgtttggtttaggtttttaaaaatataatagtttttttgaaatagaatttatttattttattattgatttatttaaagtgtataatttggtggtttttagtatttttatagatttaatgtaattattattataattaattttagaatatttttttatttttaaaagaaattttatatatattagttgtgattttttatattttattaattttttagttttaagtaattattaatttattttttgtttttttagatgtgttttttttaaatattttatgttaatatagtgatattaatacgtggttttttggattggtttttttatttaagaaaatattaatttaaatattatgttaaatatttaatagtgtttttacgggttattcgtgttgtagtatgttggtattttttttttattgttaaataatagtttattatttatttattagttgatggatatttgggttatttttattttttggttattatgattaatgttgttttaaatatttgtgtataagtttttgtgtgtatatatgtttttattttttttagatagaattgttgggttatatgagaattttaagtttaattatttgaggaattgtttagattaatttttgtatgaagtagttaggttaataagaataagtttttgtggtgaatattaatttagtgttttattattttttttttatattatagatattattattttaaagatgttttgaaaaatcgagtatgtttagggtattttgattcgcgtaagtgagaataattgggattttggatttttttttgttaaattttttaaatatgtttttttttttttttttttaaaaatgatatcgttttatttagtataagtttttataaatttttgataaaatatatattaattttattatattaattattttatatatttatttattttgagatggagttttttttttgttgtttaggttggagtgtagtgttgtaatttggtttattataatttttatttttcggatttaagtgatttttttgttttatttttttgagtagttgggattataggtatttgttattatattcggttaattttttgtatttttagtagagatagggttttattatgttggttagattggttttaaatttttgattttaggtgattaatttgttttagttttttaaagtgttgagattataggcgtgagttattatgtttggttaattattttaaagtatatagtttagtggtattaagtatatttatattgttgggtagttgttattattagttatttttaaaattgttttcgttatgtaaaattaaaattttggatttatttaatagttattttttattttttttttttttagtttttggtaattattattttttttatgtttgtgaatttgattggggattttatgtaagtgaaattatatagtatttatgtttttatgattggttttttttatttagtatgatgtttttagggtttaattaggtttttgttttgtgatgtttgagatagggttgagatttaggttggagtgtagtggtataattttggtttattgtaatttttattttttaggtttaagtaatttttttattttagttttttaagtagttgggaataacggcgtgcgttattatgtttagttaattttttggtagagtagggtttttttacgttatttcggttggttttaaatttataggtttaagtgatttttttattttggttttttaatgttttgggattataggtgtgagttattgtgtttggtataggttgtttttaatatagaaaaatattttaaaaattagaagtagtttataattttagtagttttgataatttttatttaatatttaaatttaaaatgaaataatatttttgtatttttaagaaatttttaggaagaataaaaaaaatgcgaaagtttttttttatagtttttttttttaaaggtgtttcgatagttttttaagtattttttaggaagtatgagaaagtgagtgtttatttttttttgaatttagataaaagaaatattatattatataaaaatatgttatattttatttttttatttaatttaaatggaaattttttttattagtattgtagataattttattttttgtaaaaattgtatggattgtttttattgattggataagttatagtttgtttaataagttaattttaggatggtttatagtttttttttagtatgaaaaatgttgattaggtgtagtgtttataattttagtattttgggaggttgaggcgggtggattatttaaggttaggagttcgagattagtttggttattatggtaatattttatttttattaaaaatataaaaaaaaaaaaattaattgggttggtggtatgtatatgtaattttagttatttaggaggttgaggtaggagaatcgtttgaatttgggaggtggaggttgtagtgagttgagatcgtattattgtattttttgggaggttaaggtaggaggattgtttgaggttagattggataataaagtgagattttttttttataaaaaataaaaaaattagttggatgtggtggtatatatttgtagttttagttatttaggaggttgaggtaggagaatcgtttgagtttaggaggttaaggttgtagtgagtcgagattgtgttaatgtattttagtttgggtaatagagtaagattttgtttttaaaaattaaaaagaatgttgtagtgaatagttttgtattttatcgtggaaggtttttgttagtatatttgtagggtaaatttttagtaatataattgtttgattaaatggtatatgttttttaatttttaacggatattgttaattatgtaatgaaaagaagaggaaggtttttagagtataggttattgtgaagtttataaagagtttagtttatttaatagaataaagttagtagagtttttgggggaacggcgaaagtaatacgtagtttaggtatatgagtttgggtattttgtttttaggttttttaagttatagttatttgtttaataaaatagtgttttaattatagaattttgtgttttgtatagtgtagtgattaaaagtaatttttgtaaaatgatttttttattattgtttgttgtgtgtttttaggtaggttagttttttttaaggttttagttggttagttttttttgtttgtaatatgaaggttaaaattatatgttttttgttttggaattttgaatatgttaaagggtgtagagaattttgtattgtttatatttatattttagtggttttgtaaggaagtggtagggattatttttatttttagataaagaaataggtttggaattttttttgggttttggggtgcgaagggtagagttttttatttttgtgttttttttttattttttaagtgaatacgtttttagttattgttaggtttattcgtattttgagttttagtttaaaaggttataggaaggtatttttattttgtttttatttttttttttttcgtatttcgggtttttttaggttttttgggattttttttatttttagttaggttttttattttgtattttagggttttagtattagtttttttaattttttttgatttttgttttttttttttttttttttttttttttttttgtttttaggtggttgttgagattttggtgagtgttttgttttttatttgggttttaacggtttttgagtaaagttcgtttttattgggtcgagcggggtagtatcgagtagtgatttgggagtttgttgtgcggttttttttttttttttttcgggttttgtttggtaaaagataggttaggtaagtgttttttaaattttagttaattatttttggtacgatttgtgttgtgtaattattagttattaatattgatttttaaatcgatttatttttaaatttaaaatgagttaaggggaatttattattagtataaatagaattagtagttagttagaagataattatggaaatattaatgtgtagtgtgatcgggtgtgtttgtttttgatttcgtttggggaaatattggttaggttattttttttgtatatgattttatatattttttttagaggggtttgtagaaaggttgagggatggaaggggaatttttagttgttatgtttagagtttatgtgggtttttttaggagttttagttttacggttttgaggttaggatggaagtatttagtgttaaggttatttttgttagtttatagggtttttgtgaattggagaggggagtatagaagttattgtgtttgaggaaggaagaggggattagtttcggtttttttggatggttgggtgagtttagtttttgattgtttttagtttaggtaaagatatgaaagtgaataataattaaggtttttttatgtttttttttttaaatttttgttttaattggggttttgtaggaaatagtagatatatttagtggagataaaatttttttggagatacgttttatgacgattttgtgtattcggagttattcgtattttcggagaggtgaggtttgattttttttttttttagtttagtaggaagattttagaatttgatgagagttttttagttttttgtggtaagaggagttcgttgtttatttattttttttttaatttagtagtagcgtgttatgggtgacggcgattttggagttttgggttttagttttggttttattatttatattttatttttttttttttttttagggaagtaggtgggatgttcgggattaggtatagtaattggattttattttaaaggttaattttgattggtagtagttgtttagagtgttgtgttaaggattttggggtttcgcgttatgatttattggcgatgtttgttaggagtaaggtagcgagaggtggtggtggtataagatttatatagatatttttgaattataggttgtcgtatgtttagggtatatttgtatgtagtggttttggtattcggtaattatgaagtgttttgtattgagatatttatattttaatgtttggtattatattaaatgtttatatttaatgtttggtattttttagtatttaaggtgttttaatatagtggttaaaagaatggatttgggtattggacggttttgatttgaattttttatttaatagttatgtgattttaggtaagttatcgaatttttgcgtttgagtttttttacgtaggaattagggttttagttttattcgagatgattgttgtgaagatataaaaaatataatatatataaagtattggcgtaatgtttgatttagtgagtgttttttgagtgttattattgtgtttttattttaagcggatataggaggaagaggaggtttaggaaggagagggattatttaaggttttttagtgagttggggtagaattatgattaggattcgtgttttttttattattttagtttgggtttttagaatttggtcgaggttttaagattattggttaggtacggggattggcgtgggatagatttggttttgagtttacggtagttttgatgttagagtttttttatcgggatgattttgtttaatgtatttaggtttgggttgtggttatatttgttgtttttttatttttttaggtatagtttgtgggaggtattgggtggggttgaggaggggtttttcgttttttgtattgaagtttatttttatttttggggttttttttgtggttagttttttaggagtttattaagatgattaattatgacgtggagtatattattaagaaggagatgtttggggatgttagggatgtatttgtggttattggtaattggtagggattaagggaagggttgggggtattgggaatttgaatagattttttggaagaatagaattttggtagttttcgaagttattattggaaagtaaatattgttatagttcgtttttaggggtgttgttaaatgtgtgattgtgtaggaatgttatgaggtttgtgcgaggttgtaggagagggtgagaaaataattgttgttagggaagaattaggaagattggggtaggtaggggagggggtacgttgttttgtataattagggtgtatatatatatatattatatatatatttgatatatatatttaatatatataagatatatattatatatatatatatttttatatgtgatatatatttatatataaaatacgttatatatgtatgtgataggtgtatattatatatatatatattatatatagaatatattatatatatatatatatgttatatttttataagatattatatttatatatatattatttatatattatgtatatatgatttatgtatattatatatacgtagtatatatgtatatatatataagatatatatacgttagatgtagatgatatatatatagattttcgtttttttttagtatttggttttttggttacgtttatataatttgagtttttgattttgaaaaggttttttttttttggattttaattttatcgtgtataaatatggatgagtggatatgggttagggttgaagttatttttattaatatttattattagtggtattttgttttatttattataaaatatattgtattaatgtatttttaaaaaattttattaagaggtattcgtggaagatttttatataattgtttttaattataaaatatattttgattttagagatattaaaatgtgggggaaaggtgtgttagatttgggtgaagtagaggtggtggtaggggtgttgtttagtacgtgatgggtttttattatttaggagtaatatttaggaggcgggatagttcgacgaataaaagtatggaatttaggttgaatttttgttttgttatttatttattatatgtttttgggtaggttataaaatttttgtgttttaatttttttttttgtaaagtggagataataatagtgtttagtttatagggtggattttgtgaggttgaaattagttaattatatgtaaagtatttggaacggtgttttttggtatgtaatatttattggataagggttagtttgtatttgtattgttgttttttattaagttttgcgtaaagttagttgtacgtaggtttagttatatttttattaggtgtttttaattagtttattttataaaagaggatattgagtttagagaggtttatagtagtagaattaggatttaaattataggttgtttatttttaaagtttatgtttttaatattagaataattagtttttggagatatttttagatttttatttttttcgtgtattttttttttttttttttttttttattttgaataggtatatacgtgtaaatatatattataatatattattttatatttttttatttaatggtaggtatcggggttttatgtgatagatggataggtttagtttttaggaagatttgtggggttggttatagaggagagaagtttttgtttagcgtgttttttagttagattgataaagttttaggtttgaagttagggaaggttttttggaggtgatgttatgattgggggtatggatattaagtatagttttgaaggatgggatttgatttagagagataatgtagtgaagggtagataggaaatgtatttatttaggaaggatagagagatataggaatttgtagtttgttttgggaatgggggagtaagggttatgaggttgtaaaggaggttaggagttttgatatttaagttaaggagtttgggatttgtttgggaggtagtagggagatatgtaaggagttggagatgggaggtgtgtgatgtgattttttttatagggtttttgagtttgttgtagaggagttttgtttgattttgttattggggtacgtaattttagttttttgtcgtttgtttttattatatttagagttattttagttatagtattggtgtttggttttttttttttaagttgtttgagatatttgtgcgtgggttttggagttttgtagttaagtagttgtgaagggttagagaattttaggttttgagaaagggcggggttggtgaaattaggtaggtattatttgtagttagggtagggagtaggggttgttaattttgtaagattgtttaggttttggggaaatatttagttttagggatttgtatggttttttaaattttattaacggatagttattttttggagtaatatttttttaaattagtaatttttaagtattaggttgtattagagtagggtggttaattattttgatttgcgtaaggtttttagtgttgttaggttggtgtaaaagttattgtagttttgttattgaaagtgatggtaaaaattgtaattattttggtattaatttaataaaatttggagtgttttaggtaaattaggataagttggttatttatttttagagttttagatttagtatttttggaatttggaatttgaggtatgagaatttgttttttttttaagtttttaagtgatgttaatgttgttggttcggaaattatattttgagaattattgtttaaaatttttttaaaatttgaatttttagggtggagtttaaattttgagttttaaataagttttttgggtgattttaatgtatttaaaaatttgaggtttcgtgttttgggtttatgaggagttaattatttttgaatttttttttgattttggttagttgtaagtattttagaaggaagagagttgtaattaattgagagttaggtttaaggatgggttagaggaggaagtatggggaaggggagtaaaggtgtcgtttgagtatgattttggggttgataatgatttgtagatttatgtagggatagacgaggtggggagatgggggaggtcggtttagagtttgggtttatagtttttgattacgtttttcgtatttttttgttttttttattagtttaaagtgttaagaataagttttttttttttgtcgataaattttataaatttatgaaggtaagaaaatatgttggcgtttttttttttttaagtattgatttatatatatatataaatatatagatgtgtattattttttagattaggatttttggtagttgtttttttttatttgatatttattagtatttgtttttgtttggttttaggatggtattttttagttgggggtgatttttttcgttttttttcgtttcggaggatatttggtaatatttagatatatttttggttattataatttggagattgttgttattagtatttggtggggatagaatagggatgttgttaaataattttagtgtaaaggataagtttgcgtaataaagaattatttagttttaaatgttaaggttgagaaatgtgttttggaggtatatagggttgggtaggatatagtttttgtttttttagagtttataatttattcggggatatagggttttttaggataaatagttattaaaggttataagcgtttttttttgagtttagttttgtttttttgggagagtttaagttatattggttatttttttagttattggagttttaattgtagatagtttgggtaggtgggagggtaggaaggaatttgagatttttattttatagtttttaaatgtgatagttatttattgagtatttacgatgtgttaagtttgtgttaagggttttatttttttgattatagttgatttttatggtagttttgtgaaattgtggtagtatttttatttgatagaggaggaaatttaggtttaggtagggtaaaacgttgtttatatttatatagtttttaagaggtagagttgggattcgaatttagttttgatttttaggttggtgtttgtcgttttttgggggtagaggtagttttggttgtttatatattttatgttttgtgtttgttttttgggttcggtggtagttttttagggttggtgtaatatattttagaaattgggtgataaaagaaatttatttttatagttttggaggttaaaagtttaaaattaaggtgtcgtttgggttgggtttttttggaggttttgggggagaagtatttttttgttttttttagtttttggtggttgttagaagtttttggtgttttttggttgtgaatgtattatttcggtttttgtttttgtttttatttagttatttttttgtgtgtatgtttgtgtttttttttttttaaagatattggttattggtttaggttttaatttaatttagtatgtttttattttaattaattatatgtgtaaatattttatttttaaattatattatgttttgagtttttaggtggatatggggatattatttaatttatatatattttttttgcgtgttagtttggttagttttgggtatagagggattttggttaggattgtttgtagaagatagaggtggaatattcgttttgtttttggaaggaataagggagaaaggtagatgggatattattgttttttgtttgattgggttttattttttttttcgtttgtgttttttttttgtttggttttattagggtgttggtatagatgagaagattttgattaggattatggtatttcgtagtgagattgatttgtttaatattcggagggaatttattgagaaatatgataagtttttttattaagttattgaggtaaggggaggggttagaggttagtaggaagcgggtgagtgttagatttttaatataagattagaagtttttatttttatggatttttttttagtgggttatcgtttagaatagttaggatattgaaatgaaagggggtttgtattgtattgtttatatcgaaattaattttaaaagaattaaaggtttataattaaagatttttaaataaaataagagtttattttttgttttttttaaagtaatgttatggaagtataatttatatattatgggtaggtatggtggtttatatttgtaattatagtacgttggaaggttaaggtaggtggattatttgaggttaggagtttaagattagtttggttaatatggtgaaattttgtttttattaaaaatataaaaattagttgggtgtgttggtttatgtttgtaattttagttatttaggaggttgaggtaagagaatcgtttgaatttaggaggtagaggttgtagtgagttgagattacgttattgtattttagtttgggtaatagagtaagattttattttaaaaatagataaataaataaacgaaaaatttatatattataaaatttatttgttttaagggtataatttaatagtttttagtaaatttattgagttgtataattatttttataatgtagttggtttttaaatatttttattattttattaagtttttttatatttgtttatttagttttatttttagttataggtaattattaagttattttgtgtttttgtagatttgttttttttgaatattttatataaatggaattatttaatatgtgattttttgtgtttgattttttgtttgtttgtttgtttttgagacggagttttgttttgtcgtttaggttggagtgtagtagtgttattttattttattgtaacgtttattttttgggtttaagtaatttttttgttttagtttttcgagtagttgggattgtaggtatgtattattatgtttggttaatttttgtatttttagtatagatagggttttattgtgttggttaggttggttgttagtttttgattttaagtgatttatttgttttggttttttaaagtgttgggattataggtgtgagttattatatttggttgcgtttgatttttttgatatatggagtttatatttttgttttttgagattagttaagattttaaagtttgatgtttggttttatttggttaacgagattatgggtattttagaggtagttttttatagatttagtaggaatgtaagtaaattgttggtatattttgatattatattatgttttaaaattatatattaaaaaatataaggataaataaaatttcgaaaattatgttttataataatgataggagttttttagaagggagatttatattatattatgggttaggaagtttggtttttttagtttgaacgtatattagattattgtgatgtgtggtgagcgtgatggtgtttgtatttatttttagtaatggtttggtagttagtatttaatgttgtttgtttaaataagaaattatttaatacgatatgttaagggttatgggggagggtattagtagagtgttaggggaattaagggaggttagagtttattgtgttttttgacgtaagagagtggttagagtgttttttagaggagagggttttgttggtaaatgggattgggggtgtataggggtatgttggataggggagtgataggtggagagaggattgagatgtttttgggggaaaggaataggtgaagttgtagagttttgtataggttagattttaaagggttttgaagttaggtcgggagtttgtatatttttttggggataaataaaagggacgtggttatatttatgtgtttgggagattttagtagtttatatgtggtatgggattttatgttggttatggagagaagtcgagggagatgtttagatagatgggtagtcgggaggagggggtattgagattggaaggattgtttttatttattttgttttttgtttttgttagggtgatattttcggagattttttgaaggttttgttggttttttgtggtggtgaggattagggttatagttttggcgggtatttttgttaagaaatggttattagtattagtcgttatggttaagtttgattgttttagttttagagattaaggaaggggtaggggtggggggaggggttgggttgggtttttatttttagtggagtttaggaaacgtttttatttttacgggttatcgagggtttagtacggttgagcggttgaaaaatcgtagttatagattttgtttatttttatttttttttgatttttaggtttttttagttttttttttttgttatagtttttgttttggtttgggttatgttagatttaaaaatattttgaatttttgtttgtaaaatgagtagtgtttgtattttgaatgagggggttggtggtaggggttagttgaatgtgttgggcggggtggtgggaaggatagtaaatgtgttggggtaaattgataaatttttttatttattttattatttatttttatttaggtcgcgttagagtattggattaggaatttggatgtttgggtttaaatttgtatt

SEQ ID NO: 37 - DNA, 57423 bp, Homo sapiens
ttttttgttttagtgttggattataattgttggtttttttgtttgttttttttgttttttagagtatgaagaagtttgtttttgtaatttattatttgtgtgattttggtttaggaattggattgggttttttttttgaaagtgggtaaataatgttattgatttaatgaggttgttgaggtatggaatttgattaggtagataaagtgtttttggtaaattttaattttttgttttttaataaagttttggtgatttataagaatttgtgggaaagtgtttagaatttggagttaggagttttgatttttagttttgaagggttgtgtgattttggttaaagtttttaattttttttagttttagatttgggggttggaaattgaggaggtttttttggtaagttttttgggttagtgatattttaagattttaagagttaaggagttagaggggtggggtggaggagggaggtgggtgtgttggattggtttttgtgtgttatgtgtttggtttggagtttatggttgtttttttggtttgttttgtgttgtggttgttgttgggttaatgggttttgatttagtgagtgttgtgtttttgagtttttgtgtttgtgtgtttgtttgtgatttgaggtttttgttgtgtggtgagtgggttgaggttggagaggggagttgttttgggaatttttttttgggggttgtagggatataagaaataagtgtttagttattggttgatgggtattttttgttaggagtagggatgggagggtgtggtaatttgagagtgttgtagattgggtgtgtttggggagtgtagtggagtaaatttggggttggggtggagaggtgtgggtggagggtgttttggttagggggaggggagggagttttgttgttgtagagggtttggttgagggttttgggtgttggagttgagttaggggttggttttgttggttttaatttgggggggtttaagagattttgaaggtttggggttggggttagttggatgttagttaaaggatttgtagagaagggtgtggttgaggtttaagattgagagtaagagtgttggattttttagttgtttataaaatggtttgtgtgtggtgttgggggagggttgtttgtgtgtagagagttgaatgtttggttgtatatattttagggttttattggattttattttttttgggttattgtttgtttatgaatgtagttttttaatggggttttgaggttttttatggtgaggtaggggtattatttttttttttgtattttttaagtggtttaggtttttttaaagtttgggggttttaaataattttttatatattagtatgggagtaaaatattttgaattggaattttagtttttgttgtagtgtgattttgggtggtggttttttttttttgagtttggatttttttttttaagtttatagttgagaaatttagttttttttaaaggaaataatggttttgaaaattgatttatttgttagttgtatggaatgattgtaggtttgggagttttgattatagatttgggaagtttggtataatttttgtaggttttataaggggaaagggtaggaggttttttgggataattaatttggttatggttttttgtttttttttttttttttttagattttagtgggttttttttgataattttaaatttggatatatggtttttgggtttgtgaaaggattttggtttttttttaagagtttgtttttttttttttattatttttttttttttgtttaaaatatgtttgggattgtttttattgatttagatggtatattttgatttgtgtagttttttatggtgaagtgaatgattgttttagttttagtttttgtggattttgattttttagtaggtaggttttgagttatgttgagggtattggtttggggttagaggaaagtttggttatagtttggatgtgttgggattttttgagtaagttttttttttaaggttttgtgttttatttggagtaaagtttgttgaattggttgttattgttagtgtagatattttaggatttaattgttttaagatttaggattttgggagttggatgggattggggagggtaggaggtagaggtttttatttttttttgtagttgtgataattatttatttatttttttttgttttatttattttttgtttttaaggtagtatttgttgagatatagaaaatatttgtagtttttggataagggttatagttgttgttggggtaaaatgtagatgtgagtgtgtagaggaggggttagggaagtttaaggtttggttttttgagattgatttttgggatgaagtgggggagattgtagtgttggatagttgttagtgattggtatatttgtattgtagtatttagagggagttttgggttattaggatttagttttggatttagtttttgttttgttattaattagttaggtgttttgggtatatttattatttttttggggtttagtttttttttttttatagggataggatatatatttaggatattttattggtattaataaaatgggttgggtttgaatggtttttgttttattattttaggattttttggggaggtttagtggaattattagttttattttatttagtttttttgatatattttttgggtggtgataaagtataggatgtggtttttattgtgatttttgagtatgtatgtatttttttttttgttaatagaggggaggaagttggaggggtgtttttatgtttataaatttgttttggaatttagttttattttttttttttttggagttgagaagtttttatagagattggttatgggggagtgattgtttataggttttttggatgttttgtttatttgtaaaatgagaatgagattgatatttttatgaggttgtaagatggtagatataaaagtgttgtgttattttaaaagggtgtggtgtttgagaaggtaggtgatttgagttttaagttttttttttgaaaaatttatgttttggtggtttttaaataatagtaataaaatggtaattattattattttttgaatttttaaatttgttaggttttggttgaagttttgttatgttagatgttgttattaatgtttattttgtagatatggaaattttagtttttaatagtttaaggaagaaataataatgataaatgtttataaaatatagtgttttttgtgtgttaggtttttttttaagttttagatttgttttaattttttttatttttattataatttttatgagggaggtgttatttttattttttttttttttttttaatatgaaataggtatagagaggtttaatatttgtataatattatatagttattaaatattatttttaggttttaattttaggtagtttggttttagtatttatattgtgagatattattttgttgttttttataaaagtgatttaagttggggtttaaatttaggttagattagttttaattttgaggtagagagatgattttttgaggttttgtttagttttaggattaatggttttgggttaggagaggaaaagatattgttttttaagaaattttagttgttaagttggggggtgtgtttatgtatagagttagggaaggtatttattttagttttattagaattaaggtttttggagggttatggagtgggttttgggtgtttttttgtagattgggggagaagttagtaagaaagggtaaagagggaaggatttagattttataggttaggggttttttaagtgggatggatatattttaggatgtattgaagatgattttttgggggtataggaagaaattattggattttttattaaatgtatttttaatgttatattttaaaggtatatttttgtttattatggtaaatatttaatttttttttggttatgggttgtgtatgggattaatatatatatatatatatatatatatatatatatatattgtaaattgttatatgatattattttattattagttttgtggggttaggagttttgtttgttttattttttgtttaatttttaatttttattagtgggtttggtttgtaggaggtgtttaaataaatgtttatggaaaaatatgtttttgtttgatgattgatttttttttgatgttgggtaagtgatttaatttttttagtttattttttggttatagaaagaggagtaaagtatagtttgaaaattaatagtagatggttttatttgttgaggttattaaagaaagtatgaaagttatttagtgtattttatttttaattatttataggagttatgttttatgggagggggtgtaggaaagaggtatatgtagtaattttttaaaaagtgtaaaattatgatttatgtagatataaaaatgattatgtgttgttttatttattaattaatgattatattaggttgatgttataattagtttaaaagatatatttgtattgaaagaaatgtgtaattagagataaaattttttttttatttgagggggtgggaaattaattggatttttataaaatagggtaaggagtatgtattagaattattttgtgttattattaattatttgtaatttattgatttgtaaaattatttaaagataatgaaagttttgagttagataatttggagggtttttttttgaagtatagatttttttttataatattttggaggttggtagtttttatttaatggagaaatgataaatttatagtggttgattaaagttagttaaattaaggtggttttagagtattttagtgggggaatattttttggtttgttagaaaaggtggtatttgaatttagtagataatagtggtttttagtttttttggttgttattaaaattatttaggaaagtttttagaaattattaaaggttaggttttattttagtagttgagttagaatttttaagggttgattttaaatttttggtagttttgaaaaattttttaggttttgttagtgaagttagaattgaaaagtattggtatagattttggaaagttggattaaaaatgttggtggaaggtgtttttggtttagtagggaagatagggtaaagaggaaagtggtgatggtaaagaagttagtaaggagaattaatggttttgattgttgagtttagaggtttagtattaaggggtattattggagatttgtgagtagaggagtgttgtggtttaggttgtagttttttaggtatttttttgaggtagaggtttgggtgggtttttttgtatgattttttatattatttttttttttttaaattatttttttattatatttggttttatttttttatgtttaatatttttttttttttaaaagtgtattttgtttttttatagtttaagttattttttgatgatagaaatgtttttttttattttggtgttattattttttttggtatgtttttgtttttattttattgaatttagattttgattgtgtatttttattagtttgtatttttaatattttttttaattttatatatgtataataaataaaaatgggatataaaagggtaagattaaaatatttggaaagtggtgatatttttgttttgtattttagtggattgttatatttattatttttttttggagattattgttgtaataatgatgattgtggtaatagaagttattgtttgttaaatatttaatttgtatttggttatgttaagtgttttatttgttttattttattgaatttttataaaaattttataagagggttattttaggatgaagaaattgaggtagagaaattttataatttgtttaagttattgagtttggaatttgtatggttaggatttgaatttgggtattgattataaattttgtattgattttaatgttatattgtttttattgtaaatgtttgggtttattataataaaagttattatttattgagtttttattgtgtgttatgtattgtgttaagtgttttttttttgttattttatttattttttagtatttataggtatttttatttgtattttgtggatgtggaaattgagatttagtttaagtaatttatttatattataaattgttgggtaatatttgtgtttgaaggtttatgtttttatatgatttggataaaattttttttttatttatatttttgtggttgggtagtggtgagttgttttttttagagttagtttggaatttttgaaggggaaggaggaaaatgtgattgattgtaggtaaaaggatgaggtaaggggtggttatagtagtataaagttatttaggttatttattttgtttttgtgtgggttttatgaatgattagttatgataagttgttatagtatattttatttagatttgagagaattagggtttttgggaggaaagaggtataggtttggaatgattttgtttattagttttgaatagtttttttaattaaggtgatgaatgttgtatattggtgggtggagatggggaggaattttgtggtttgggagatgatttttttaggattgatattttgttgtgaaaattttgagttgaagtttttaaaagtttttaattatagattttattaaagagggagtgatgtattgttttattttagagatgaagaaattaaggttgagagagggatttggtttgtttgaggttatatgggggtagattgggaattagaattagggttttattttttggattttttttggtgttttattgtagttaagatttatagttgtgtggggatttgttatgattgagggttgttaggtagagatgttggttgttttttgggttttggtaagttattttttttttttgagatgtttttattttgtttagaaaatgagggatttggagttatggattattaagggtttttgtgggatttagaaatattagatgtaaaatatttagttaatttgagtagtatggtttaggttgttttgggagggattagaagttattttaaagttagggtaaatggtgtgtttatgattagtttaggagttttttagaatttttagaggtggggttgtggaattagtagggggattggtttttagaattgtagtttgaatatttagttttggaaggagtttgttttttatatatgaattgtgtatttatataaggtatatagaaattgtttttagagttgagaatatttttttaaatagtaagaggtttttttttgaagttatttttttttggaaaggggagtttttttagatgggtttgggttgtagttagtagttgaaattgttagtaataagtttagaggaaagtgttttaaggttggagatgtaggtgataggttttagttttttttttgtttgtgttaattaattttttgggttttatttagtttttggttttttgttagttttgggttttttttattgtttttttttattattttttaggttagaggaaattgagagttggtttttagttttattttggggtagatgtgggtttttttttttttttattatatattggaaagggggtatagtttttattttttggtgagagttgtatagttgtattaaggggtttttggttgttagggaaatagtaaggttttttgaagttgagttgagttgagttgtatttgtaggtagatttgttttttgttttttatttttaattttatatgatgattgtttttagttgattgtagtttggggaatttataattagttagtgaagatatagaggtaaatatgatagaggttttgtttttaattttttattagtatagtaaatattattatttattaagaataggttttgtgtttggttttttatgtgttgtttttgatataatttaggttttattttttaataattttataaagtagaaaagggaaagttttagttttgtgtttgagattattttgaatttaaaaatgagtaataagtttatggttatatggttaagattttttttaagttttgggggaatagggaatatgtggagaattggaaggtattgagttgaaatgtttttatgatttttatttttttagttttgttttttttaggttttattgggtaaatttgattgattttgttatgtttatttttttttttttttttgagttagagttttattttgttgtttagtttggagtgtagtggtgttatttttgtttattgtaatttttgttttttagtttaagtgatttatttgttttggttttttgattagttgggattataggtatatattattatatttggttaatttttgtatttttttgtagagatggggttttgtatgttggttaggttggttttaaatttttggttttaggtggtttttgttgtttggttttttaaagtgttgggattataggtatgagttattgtttttggtttttgttatgtttatttttaaaaagtaatatatagatattgttaaaagagattaggttaggtttggtggtttatgtttataattttagtattttgagagattgaggagggtagattataagggtaggagtttgagattagtttggttaatatggtgaaatttatttttattaaaaatatgaaaattagttaggtgtggtgttgtgtatttgtaattttagttatttaggaggttgaggtaggagaattgtttgaatttgggaggtggaggttgtagggagttgagattgtgttattgtattttagtttgggtaatagagtgagattttattttaaaaaaaagagattaaattgtttagatttgtttaaagtggaaagtagtggttttttgtttttttttttttttttttaagaagattgttaaatttttatttgttgtttttttgagtgtttattagttagttttttatttgttttttttatattttttaaattagttatatttttttttgtatttatttttatgtattatatttttgtttttttattgtagattttgttttttgatattttttatttgtattttttatttatttttaatgagatatgtgttttgtttttttgtgtgtttttgtttttttttttttttttttttttttgagatagggtttgttttgttatttaggttggagtgtagtggtgtaattttggtttattgtagtttttattttttgagtttaagtaatttttttgttttagttttttaagtagttgggattataggtatgtgttattatgtttagttattttttttttatttttttttaatagagattgggttttattatgttatttaggttggttttgaatttttgggtttaaattatttttttattttagttttttaaagtgttagaattataggtatgagttattatgattagtttgaaaaatttagtttttatagtggttttaggtattggttttagattttatattttattatattattttttgttattatattagttatattgagtttgtggtggttttttatttgtattattttgtggtgtgttttagttatatttgtgagattttttgatttttttatttgggattatattttttgttatttttttgattaagttttgttttttttttgtagtttttattttagtttgatgagtgtatttgttatttatttttattatagtataagttttagagaaatagaatttaaaaaattgtttatatttttgtatgtatagtgtttagagtaatgtttgattaggataggtgttaaatgagtgtatatttatttgtttaggaatgatagttttttagatattgtagtaggtggttggaagtattttgagttttatttgtaggtggttaagttttgggttttgaagttatttttgttgatttgaaaagggggtatgtatggtgtagatagtatagattttgggatttagaaattgttgaatttagttttaagttgtgtgattttggtttatttattgtgatgttttagttttagttttttttttataaaaaaggagaatttgatgtgtggaaggatttttgagagtagtaattgagatggtgttgagataggtattttgtttagtgtggaggagttaaggggttagtggtgggttagtgttatgtttgtttttttttggggatttgtgttttttttttatattgttgtgaatgtttggatattatttagtttgtttattgttttttgaaaaaaatgtgattggttttgagttgggttattgggtttgatttaatttgaagggttgggggtagttggaaaatagtagagggaggaaatgtaagggaaagaaaggggatggttagagttggggggaattttatatgttgttttttttttttatagtggattttgttgtgaattggagattatggttaaattagtataggtaaggggttttttttttttgaaggtggtatttagttttttttgggtttgggatttttttggagttattaggtttgttatagagatttttggtatttttagtttgaaaaaaggaggaaaggtttttaggttttgtttgtttttgttataagttatggttttttagatgtaggttattataatgtaatataatttataatattttaagtagaaaaggatgtgtattggtttatttgatagagaggtttagggttttaggtttggttgaatttaggggtttttaaatgatagtgttaagattttgtttgtgtgagttgggttttttttggtggttttatttttgggtaggtttttttttgtattggtatggtagttattagtagttttaggtttttattttgttgttttggtagtttagggagaaaataatataatttatgtttagtgattttaggggaaggtttaggtttggtttttattggttgtgtttgagtaatttgtttttttttggagtaaggaggtggagttggttttatttgaattgtttggtttgatgaagggaaatggatatttgataggtagaaagatatttttgttgatttttttgttttggatatagaaatgttttttgttatatttatttgggattgaatttttttggtttgggagattttaattttagttttttatgtttgattgttttgttgggtaatagaattggaggtatttgagaatttttatttttatgtggttgagattaggttttggttatggttagaggtaggattttgattttgattgtgttttgttgaggttgggtatggtgatttttatttataattttagtattttgggaggttgaagtgagtagattatttgagtgtaggattttgatattagtttggataatatggtagaattttgtttttagaaaaaatataaaggtggtatgtatttgtagttttagttgtttaggaggttaaggtgggaaatttatttgattttaggagattgaggttgtgatgagttgagattatgttattgtattttagtttgggttatagagtaagttttaaaaaataaaaaattttattttattttgttggggtttgtttgagggtgttgtttgttggttggtgttggagaaagttatgtagttagtgtgatgatgggattggtagggagaagaaatttggggattttgaagaaaattatgggattgggttttgttgttttttattttaatttagaattattggttatagaatgtatagatagaagttgtttgtgaggtttttgggttttatgttttttttatggaatggttgaatttagtaataataaaattttatttatttttgatattatgattgtttttagtgaatttgggtttataggatatttatagtttttgaagagtataggatgttataggattagtatttttagagaagttttagttgtggttttttttatagttattgaggagtatattgtgtgtataagtggtttttttgattaggaggagaaaatgttattgattatgggtaaaaatttaaggtggaatttttattgttttttattttttatgtgtagttatattagagttattttttgaaaggtatttgaattgtaggattttagatgatttaagtggataggttaggttttggaagattagagaggttaggatttagggtgtagatttttggattttggtttagtgtttttgggttatgttttttgtttggttgatttgtggttttttgttgttatggattagggtttagtagattttttgtaagtgagttttagggtggtagggttttagggaattttttttttatgggatgagttggtattttttatgtatagtgttttggtggggtagtaaaggagttttggggtatgtaggagggtattttatttaggttgaggagagaggggaggttgtttagggagagttatttaggggaggaataagggggtttagagtggtttaggtagggataattgggatagaggttagaaggagagtaaatgtagtgtgtttaggggagtaaaagtaatttggtatgtttggggtgtagtggtttgggggagaggtgagggttgtagaagataataatagagaaatgtgaaaaaagtttttttgttgttgagttgtagttgttttttttagttattagtttggtttttaattattagtttgaatttggtgttttttaaaattttaatatatgtatatatgtatgtatgtatatatatgtgtgtatgtatatagtaaattgttttgttttttttggtttagatattttttagttttttttattgtggttattgtgttgttttttttatttttttttttggaagaggagaatttgaggtttaaagatatgaagaagtaggatggtgttatggaagatttaggaggtatggtgttgtggtttttattttatagggatgttttgggtttgaatgtaataatgaatataaaaatattttgaggatagggtaggataggtaggtgtttgtgtttgggatttttaggagttgtggaggtgagatttaggttagtattggttaaggtagtttttagttggagttttggttatgtatttgtttttttggggatattatttttgtttttaagaggttattaggatttttgttttagtagtagtttgggtggggtttagttttatagagttttagggtttggttgtttattagttggtattaggatttgttgaatattttagggtggaaagttttttttttgttgttttttgttttgattttgggtttttgtagttgggaatttgtttgttggaggtgtgataggtagttagggtggggtgggtgaggagaagtttgtgtggttgtataggtggtgtttagagatgtagaatttatgaagttggtgtgagaatgatatggtgggaagtttgggtttggatgatttgaggggttgtttttgtatttttaaatgtgattagtgttaagttttttatttttgtttttagtggttatgattttgtggggttttaggataattaatttagtaggttattatttggaaggttttattagttttgtgtaaagaattgtgtaggagtttgagtttgttgtttaagaagtttgtttttaagtgagtgtttggattaaggtttgtgtaggttattaagtattttttttttagtatggtattttagttttttttttagatattgttgtgattatttatattgtatgagggggagaatagtggagggggaggagtagtaataggaaattggggtttgtgtgttgttttattttttgttttttattttggggatatgttttttttttttttgtatttttttttggtagtttataattttatgattttagtgattttgggtatttaattgtgagttttgaagaattagattttattttaagtatttgttattgtttatatatttttgttttagtagataagttaaaatagtttttagattttatatattaattagataggtatttgtatgaaatatttgttatatgaattatatgaaatttgttgttatttgattgtttttaatttatatataaggtaagttatatggtttaatgtagtaaagaatgttagatattagggatagggttgtgagtggttagttgagtttaatgggtaaggaaaattatattaggatgttagagttttgtttttatttaggttttgatttaggtgttgtgtttaggttagtttagtagggttagagttgtttttataagagtttgaattgtttatttttattattttttttagttttatttttttgttttttttgtttttagtggatgattttagtgatagttagtatttgttttgagttttgtagattttgggttggtttttttgaatgttttttgtttttttttaggtttttgttatgtgttttttttgtgtgatgttttttttttttttgtttttttttttttattttattttttggggttagtttgttgtttattttttaggatttagtttagatgttatttttagaaagttttttttgatttgtttggaatatatttgtagttatttatttatttatttatgaaatatatttagtgagtgtttgattgttttaggttttgtatttggtgttagaaatgtgttagtgagtaagagagatatagtttttgtttttttggaattttgaaaggaaatattttttgggttttatgttgtttttagtattgtatttgttatattgttttgtagttgaagttgttatgtatttttattagattttgagtttttagtggtttttggttttaagtatttatttagtagatttttagtaaatgttgtttgtttgtttgattgaatgaatgaatggtagggtagttttagttgttttggaattgtgagtatttgaatgtgagaagtatttaggatgttgtggattggatagtattgttgtttttttatagttttgaatatagggttgaaatggtatagaggtaaatagtatagggtaataatttaaatgttttagtatttaaggagaggggtaggttggtatggttgattaggaggaagtagtgggttatgtggtggttgtttttttttatttttagtttttatttagatggaatttgaggggaagggagagatggtttgttagaaagagttttggattttttttttagttgggtttttgatttgttgtgtggttttgatatgttatttgttttttttgttttgggttttttgggatataagtggtaatagatttattttttttatttagtttttagtttgtggtttttaaagtttttttttttttttattttaagtgagttgtgggagggatattttatgattgaagtggattggagattggtgttgttgtggattaggataggttggttagataggtggaaggaaaaatagttatgaattatggtaataggttagtttgtagagggtttggatagattttggaggatttgtttttggtggtattttttaaagtttaatatttttatattggttttaggaggttttgatattggagatagtattgttagggatttagtgttagggaggtttttttttattgtttttttttttggtgttttttattttagagtttgggttgttatgggtgtttttatttatttatttagtttagttatagttatttttagtttgtatgttaagtttgtgttagagttggggttttatggttttttttaggtagaatgatttgttttatttatgatagtttttattttttatggatttaataattgagtgggaagttgaattaaaaggtttttaaggattgttgtaaagaaataattttgagtttttgaatttttttgttttttttttttttttttgagatagagttagttttattttgttgtttaggttggaatgtagtgatgtgatttgagtttattataatttttgttttttaggtttaagtgatttttttgatttagttttttgagtagttgagattataggtgtttgttattatgtttggttaatttttgtatttttagttgaaatagggttttattatattggttaggttggtttttgattttttattttaagtggttttttgtttagttttttaaagtgttgggattataggtatgagttattgtgtttaggtattttttgtttttttatttattttagtagttaatattgtttgttgtgtttttttgatattgttggattggaggtgtttagaaagaaagagaaaaggatttagaagtgaaatttttggaggattttagttgttttgtgtttttgtttattttatttatgtggtaaatatttgagtatttggttaatttttgtgtagtgggtagatggatttggtatttgtttttagaggtttttggattaaattgtttattggggtggagaaggtagtaggaattttttaagttttggttgtgaggtttgaagtaaggttaaggggagtgttggtagtaaagtttttattttgtgtttattgagttttttgtaaggtgttttgttttgggtatttggtatgtgttattttttaagtttttgtttaggggtgtgattaggttgtaggggatttttaggtggtaggaagagagttgtgtttttttttggttagaattttaaatagtaattttatgttgatgtatgtatattttagaggagttagtttttgtagatagagattagagagtatttagaggtttggttggggttttgtagtgtagatgttgggaggtatggagatggggagagggggaggtggtttaggatttattttgttttatttttgattttttgaaggtaagatttgtgtggtttattttttatttttttttttttggatttttttttgattttttgtagttggattagtttttgttgtttttttatattattttatttttgttttaatgtatttattataagttttatagtaattgatgtgtttgtttgtttttgttattgggttaggagtttgtgaaagataggaattgggttttttttttttttaattttttagttattagtgtagggtttagtataaatgaagtgttttgttattgtgttgtgtgtttggtgataggttttggtattttttattttgttagtttttagttgtttttttagattttttattttttagtgttatgtaattgatttatatttgatttttttgtgaattagttttattgtgtatttaggtttaggtttgatgtttaagattttttggttttttgttgtttttttttttttttttaaagattaagttagtttgtttttagatgttagtttatagtgtagtttattgggtttagaggggtagtgttttgttttggtattgaaatgagagtgtttttgggttttttgtgtttaggattttatttttagtagttggtatttgtaaggtttttggagttggagagtagagtggggttggagagtagagggaaaaggtttgagttttgtgtgattttttataagtggtttttttttgggtttggtttttgtgatagaaataattttaagagtgtttataaatggttatattaatgatatttatagaggtgaaagtgtaaatataaaatgttataaaaatatgaggggttggttgggtgtattggtttatgtttgtaattttagtattttgggaggttaatgtgggaggattgtttgaggttaggtatttaaaattagttagggtaatagagtgagattttattttttaaaatatatatatatatatatatatatatatttgatttttgttatttttgtagggattatttttattttttatatttagttaggtttttttatttttttttggatgttttggaaggtggtgtagggttgtaggttttggttaagttttttttttttggggaaatggtattgttttttgggtgggttgtagtaggtggtatgggaaagttatttatattgttttttagggtgtatgtggttagtattggattttgtagggaaagtagtttagtttggattagggtaggtatttgatttgaggttggggttgggagtttggttttagtttggggttggtagtttattttttatttttttttttatagggtgttaagtattggggttttatttatgattttttaggttttgattttaattaggatgttgaggttttgtatattgttatgaagggttttggtgggtgttaggttttatgggagtttgaggggtattttttaaaagtagatatagtttagagtttttttggtggtggtggtagggtttgtgaaatggtgaagtgtatttatttatttttttggttttttttttttattaatttttatgatgttataataaaatgttttagaaaaaaagtataaagaataatagaaattttatttatagatttattattaaatttaagaattagtgttttattagtatagttgaagtttttttggtagattttttttttgataatgttgtttgttgtttttgtttagaggtagttataatttgaaggtggtgtttatgtttttttttgttttgtggtggaaagaattttgtattgggtgttaggatatttgggttttttaagttaggtttattgtgagattttggataagtttttgtttttttttgggttttaattttttgatttgtgtagtgaggagttggattaggggttttttgagtatagatattgtgtgtgttgtgtttatttttagttgtgatttaataaatttttatgattttttgttttgatattagtatttgatgagtggaaggtttatgttgaggtttgtagggagttattaggtttgtgtttagggaaggaagtggttttggtgggttttttggaggtagggtgggtaggatgatgattgtttttttttattttaggtagtgataaggaggttatattggatataattattttatggagtaataggtagaggtaggaggtttgttagagttataagtttttttatggtaaggtaattatagtaattggagggtttatggggtgtgggtggaagaatgattttatttatttgtgtgtttgtttaggttattttttggatatggtattttaggttagtttgtgggttgatattttattttgttttttttttttttattagttgggtgttttttagtttttaatatatttatagtatttgttgtatgttgggtttgtgttaggtgttagggttgtattagtgaataagatgggtgaggtgttaattttgtggattgttagatagtgagagagatatatagtaaatgaggaaatagatagtggtggggaagtggtatagggttgtggatttgattttgtatagttgtttgttagtagtatgatatggagtaagatttttgttgtttttgagtttgttttttagggttggtaatagtatatatttttaagggtgatgatttaatgagattatttagtttagtatttgttagagtaagtgtttattaagtgtaatttttattgttgtaattattttttttttttttttttttattttttttttttttttatttgttaggattttattgttgatttaaagtatgaattgatgggtaagtttgaatggttgattgtgggtttgatgaggttatttgtttattgtgatgttaaagaaattaaagatgttattttggtaagaagtgggggtgtatgtggtgttggggtggggatgtggttaatgggaagattttgggtttttttaaaagtaattggtgagttttatatttatttagtatatgtgttttgttttaaagatatatttaaatttattttagaggagtattttgatttgtatatagagagatgtagatagatgttaatatgatgtagatttttttattaggagtttgtagtttaaggatataggttatagggatatggagataaattgtgtttaatatttttgaggttaagggtatattaaaggtaattaatatgattttgggttaagggttgtttgagagggtattttaaaggataataggattaagttaagttttaaagtttagagaggatttggtggatagtagtgttaaggttattgtagggtgtaaaaatggtaggagaagttgtggatttgtgtttagggtatgaagagtagtttagtttggttgaggtagaggtagagaattgttttttaggaaaaagagaggtaaagttttttaagtgtatttagtattttatagtttataaagtgttatgatttttgttttttatgagttattaagtatgaatttattttataaattgatgtatttagtaatgtgagattattatttttttaatttttttgtgagtttggtagagtaattaatattatttatattttatagatgagaaaattgaggtttaaaaagatagtttttgaagagaatttataaagttggaggaggtagaattagaatttttgtgttttagtttatttttatattgttataaagaaatatttgagattgggtaatttataaagaaaagaggttgaattggtttatggttttgtaggttgaataggaagtattgtggtttttgtttttggggaggttttaagaagtttttagttttggtagaaggtaaagagggagtaggtattttatatggtgggagtaggagtaaggtgggaggtggggaagtgttatatatttttaaataattagattttataagaatttatgattgtgagaatagtagtaaggagatggtgttaattatttatgagaaattgtttttatgatttaattattttttattaggttttatttttaatatttaggtttatgatttgatatgagatttggtggggaaatatatttaaattatatgattatgttttatgagttttaaggtaggagtttttaattagtgtttaagagttgggtaggaattttttgagttttggggtgttatagttttggttattttttgattttaatttgtgtttagtgattttttatttttgtttttaatttatgtgttttttttttatttttagggtattggtattgatgagaagtgttttattgagattttggttttttggattaatgagtagatgtattagttggtggtagtatataaagatggtgagatgggtaggaggggttgtttaggatttttagatataaaatgaggatgattgtaatagtggggatattaagattttagttatttatttttttttttttttttttttgatttatttgtttatttatttatttatttaataagtatttgttttgtgttgggtgatgtgttaggtttttgggataaaattaaaggggttttttttttttaggttaatgagataatgagataatgaaggagatatataataaataggtgaatagataaatatagtgatgatggattttagttaagtgttgtataggaaataaggtaataagaattaaatttttattagtgaggttttgggaggaaatgaggaattaattgtataaagaatggagagaagatttttttaatagaggttatggtaagtgtaaaggttttgaaatagaaatgagtttggtagttggtataaggttagataggtagaggatagggtaggattatatagggtttgtaggttaagagagagatggtgttttattttgagtttaatgagaagttggggagtatgatgattagatatgggttttaagatagttatttttgttgttgtgggttggaaaggaattgagaatagaggaggagagaattattggaaagttgtagttattgtttaggtgggttgttatggtataggtgggttagagagaatgaatagattttattttattatattatggttagtatgaagagttgtgaaaatatattttgggttttgttatgatggatgtgtagattgggttttggaatttttaaaaatatttgattattttgggggtagtagggttttttattttagatttttgaggtttttggggatgagattagagtttgtgtttttttttgtagtttatgagtgggatttggaggttgatattattggtgatatttttggttatttttagaagatgtttgtggttttgttttaggttggtttatagtttattttttttttttggagtttgggatagtttttgtttggtttatttgggtgtagatttgaatgtttagggtttggttagttttttttggtttgtataggtaggtgtatttggttaattttttttttttttggtatatagtttttttgtgtttaggagtgttttttgttgtgattttttttttttttttatatttgttttttttgtttttttttgggttttttttttgttattgtttttgtagttgtatatgtagtatttttggattttagtatttttgtggttattgtgtggagttttttatatttgagttttattgtttttttattgtttgtttaaagtatattataaagagattattaggaggttataaattggtgtttgtggttgaatttaatttgttaagttggattttttgtttgtttttttataaaatgtgttttaagaaagaaagtaaaataagtttgagttagttgttaatatttaaaaattgtgagattttgtttaaaaattagatttttggattattttaatgtattgaaagttgtggtagtagtagatttgtattttgtatgattgtagtgggttggagagtatatgtgttttgtttgttttattgtgaatgttatttatttggttttgtaggtatttttgtgattataggtatgatgggaataggtattgagatgttttaagtttagttttaaggattaaatggttatgaaattttatatataaattaagttattattatgtttttttgtttttttattttttttttatattagttttttttaattttgttttttttattgttataataattttatattaattagttggggaatgattaggagaaattttaggagtgggatagtgtgatttgtgttttatttttaaagttgtttgttttggagaggagtgttttatttttgtattttggagttaagtgttttgtatttttaaggtttgatattaagtagtagtgtggtatatattgtaagtttgttagttttgttttttgtttagttttaaagagaattttgggggtttgagattttggaatgtataatttagggggaagaggggatggttatagatttttttaggttatttgtagatttttgtttatgtaagaaggagttgagtattgtttgttttttttttttttgtgtatttttttatgtgtaagttttttttattagatgaggtaaagggtatgggtagaataatagaagtattattaggatttggtgattttgtagtttgtgagtttagattttgggatttgagttttaaatttttattggtgaattttttaagttaaggtataagagtttttaatagaatgtaaatgtttagattttttgtttttgtggaattgttgttggaggagtgttatgggttatgtaggatttgtggtagggatttttgagaatttggggttttgtttttagagaggtttttagggtaaggttttgtttatttttgggttggggatatttggaagaattttggttgtttttgggatttttttgtgtggatttagttttgatgaggaagggaaaggttagagggagggttttttttgattggtttataaaatagatattgtggtttttatgtaatagtagttattgtttttggatatatttgggttattagggtttttttgttttttttgtttttattattggtatttaggttttttttttgattttgtagtgtttgaaatatatgttttttgtttttttgtttagggaattagggaggaggatgatgtagtgagtgaggatttggtataataggatgtttaggtaaataagtattattgaaagtttttgaggtatagtagaagagttttgggaggggagaggttggggttttgggaagggttggaggtgaagttatttgtattaaatattagaaataatttagttatagttgttatgtatattggtgttttgttgaagaaaagatataagttattttttaaaggtatattttatatgtaatattggtatattggtgaggtgtattttggagttttttttatttatttagtttttagatattattgaagtaaaatatttagtatgtgttaggtattttgttaagtatttagaaattattaatgaataaaattaagtggtattgggagagataggtatatattaattatataaatattttttttattaatatattgtatattgtaggtgttttgagtatttagtatatgttagtagtattataggggttgatatagagaatgttatgatatagtttttgttgttgaggagtttatgtaatagtgtggagatagataggtgaagaaattattattatatatagtagattaaagtgataaagaagtagaaagttatgggagtttaggagagggaggaaaggagggaaatagaattgtgtttgggggtattgggaagtattttgagaaaaaaatggaatatttaatttgggttttgaaggttgagtaggagtttttttagaaagaaaggaagaaaggtatataggtatagttatgtattatataatggtgttttggttaatgatggattatatatatgatgttagttttataagattatggattagatatgtgatgttagttttataagattataattttatatttttattgtgttttttttatgattatttatgtttggatatataaatttttgttattgtgttgtagttgtttatagtatttggtaagataatatgttgaataggtaggtgtgttgtttaggagtaataggttatattatggagtttgggtgtgtagtaggttatgttatttaggtgtgtgtgagtgttttatgattatataatggtaaagttgtttaataatggtagtttttagaatgtatttttattattaaatgatgtatgattgttttatttgtaaaggtttttaggttattaattatttgtgtgtttagggattaggtagtagttttgagtggtttggttagtgtgttttgttttttgaggtttttttttttagttaagtgttatttttttttttttaggatttatatgaggtaggggaattgaaatggggaatagatgaagtttagtttatttatattttgggaaattgtagtaagtagtatttttggttgggtaagttttagagaagatttgaagttgtttttttgggttgatgttaataatgtttttttttatttttttttttttttttattattaatggaatatgatatttattttatttttaatttaaattttagttttgagtttattaggttggtgtaaaagtaattgtggtttttgttgtttttaaaggaatggtaaaaattgtaattatttttgtattaatttaatattagatagtagtttgtatagttttttagtaaagttattaataggatgtttggttttttattttagtgttagttttgtttttatgttaggggatgagatatagttttttattagttatgaagtttatttgtatagtgttggtgatgtgtgtgattttttagttgtttttattatagtattagttttagttttatggtggatagttgttttggttattgtgtttttttgtttttgaagtttttatttttttttgggggtatagaggtatttttaaatttttttgtttttttgtttgatgtagtgtttgatgagtatttgaagattatagggaagttgattgaagttagtatttgaggggagttgtttggggattttgagaagttaatgttggttgtaggtatgttttgatgttgtatttttgggggttttaggggattttggaatattggtttaggaataaggggttgagaatggaaaggggaattatatggtatagaattgggaaggagaaaattatgtgggttgtgaattttaaaggtttttttagggtagtatggttgaggttggggatgggaagggggtttgagttttaggtattgattttttttagtttttttttttattattggtagggggataaagagttttgaatttgggttgaggataatgatgattataatagttgatttttgttgagtatttagtgtatgttaggtattgtgttgagtgtgtaatttttaaaaaagatttagtagtggttattgttatgatttttattttatagatgaggaaattgagttttattaggttgattattttttgaggggtagttttgtaatgagttgggggtattgagaatgtgaggatgtgaggaattggttagttagtggtggagttaagatttaaattagggttttttttatatgggtttggagtaagttatttttgtttgttggattttagtttttttatttgttaagtggggtgtagggtgtgggggtaggaaggatggattgttttaattgtttttttagaagtttttttaattttggtattttagtagttagtatgtttgagttagggatatgttgtgtgtttgtattttttgggggaaatttgtagtttttttattgttttttttagagttattttttgttttttttgtttgaagtagttagttagtgggatttatggtgatttagtgggatttataatgatttagttgttagtatttttttggtgtagtaggtttaaaaaatattttttttttttttgttttagattttatttttattttagtttaattttttgttaaaattaaaaggattagaaagataaaggtggtttttgtgatggattttaaaaggattattttaataagattattttttgtttattttttgggtgtgtggtaaaagtgggttggtttggggtgatttggggttgtgagttattaggaatggtggttttttttgtattgagttaggtggtttttaaggaatagaaataaagagggagttaggttattttattttttttttgaggtagttagaataattttatttttttttttttttttatagtgaagtgtatttggagtattttggaatattttgttgaaaggttttttaaggttatgaaggtgtgtggtggggttgatgtgaatggggtttggggagaggattattgggagtttttgataagtttttgggatttagtggttaaagagagttttttagggatggttataggattgattttggtgaaggtgttttgttgtaggtgagttgtagagttaggaatgttgttggttatatgttttgttatttgtatatttgtttgatgttatgagttaatagatgaatttagggtggtagtttgtatttgatttttttagttaaatgggttggtggtttggattttgaagaagtattaattagaatgtttttatatagtgtatgtaggtaagattattttggttttgtttgttaagatttatgatgtttattttgtgatagttttattttgggtgtgtttttgagaaagttttttaggtttttatatatatgatgtataaagaaattggtatttttgtgatgtattggaggaaatgaatgtagttatttgttgttagaggtttgaggtttgagatataggagtttgggtttttttggttttggttggttattttgaaaggataaagtagattgttggttattttttgtttattagtgtgttataatgaggttgggtagtttagttttagagagatgtttgtttgtatgtatgaatttattaagaatgtttattataaggttgagtgtatgtagtggtttatatttatgattttagtattttgggaggttaaagtgggaggattatttgaggtttaaagtttaagattagtttgggtaatatagtaagatttttgtttttataaaaataataaatagaattagttagggattgtggtatatatttgtagttttaattatttgggaggttgaggtaggaggattttttgagtatagggtttttgggtttgaggttttagtgaatgtagtgttatgtgattatgttattgtattttagtttggataatagagtgagattttgtttttttaaaaaaaaaagaaaaagaaaaaaaaaatttataatagtattgtttatattaggaaaaagttagaaataatttagtgattattaggaatagtatagtaaaaatttaaatgtatagtggtatatttgtagagttttaaaatgtgtaaatttaagtgtattgtttagagttataaagttatggtaaaattataaggaaaattaagtgtggaaattatatatgaagagagaagaggtttataatagtgagagggttgggtatggtggtttatgtgtgtaattgtagtattttgggaggttaaggtagtttttgaggttagtttaagattagtttggttaatatggtaaaattttatttttattaaaaatataaaaattagttaggtgtagtggtgggtatttgtatttttagttgtttaggaagttgaggtaggagaattgtttgagtttggaaggtagaggttgtagtgagttgagattgtattattgtattttagtttggataagagtgagatattgttttagaaataaataaataaataaataaataaataaaatagtaagaggagtatagagagagttttaatgggaatggtaatgtttgttttttttgttttaaattttaattttttattatgaaaataggatttttaattaagttgggagttattagtattttagtttttttttaagtttatgttttttaaatttatttgttttgtagggtttggggatttgggataatattttgatttgtattatggttttttgtagtgagttggatatgtttgatatttgggagattttttggattaagtatgagaagtttttttatagtatgattaaggttagtagagtttatgggggtagagaagggagtaaagagttttttgttaagatagagggtttggggattatttttaggaaaaggaaatgttttaggaagtgggagttttttggatattttaggagtttttgttttgtggtttatttaaggaatttaaggatatttaatagaaaagtaagtgttaggggtgtttgtgagtggtaaggttatagaaggaggtaggggttgggttatgaaggatatgtaagttgaattaagtgtgaggattttgttttaagggtagtgatagtttagttttttggaagaaggttgggaaatattgaagaatataaatgagggttaaaggggaatttttggtttgggttgggtgattggtgatgattttgggatatttggtttttgaggttttattaggagatatatgtaaagttaggggttttttttttttttttttttttttggatgattgaaataaaattttatggggtgatagagaaagagatttaagttgtattttttaaagtatgtttttaaagggtaatttttttaggtgttatgtgtaaaatgttttatgggaaaataagtttgtaataaattataataagtaaagataaataagttagtttttttattttagaattttttatagttttttatattttgaagtttattatgaagttttaagagggatatggaatatgtatttatatggatatgtgtatttgtgtaatatatatttgtttgatttttttgtattttttaatatttttgtttatggaattttatttttatgtatattttatgtggaaggattgggttggggattgtttggtggtagtgttgtgttggggtattggtttgaaagggtagtgagtatttttttttaattttgtatattggtagtaaagttatattggtaatttgaaattgtttattgttagaagtatttatattatagaaataggtaaatgttataaattagggttttttttaatttgtttgttgagaattagttatttaatattaattagtataggagggttagggttgttatgaataagtgtttatttagttttttttttttttaggttgtgtagaatttttatttttttgtttgagaggagtttagggttgggtgagaggtaatttttttttttttttttttagaatgatatttttggtgagtataagaagattttgttgaagttgtttgggggagatgatgagtaagtggttttttggtttttggttggagggtatggttttggggtgttaggtggggatttttttggtttgtattttgatgggtggattggatgagttggggatttttttgagttaggagtgttgtataagtgaaaggtggtttttgttggtagttgttgtgtttgtgggtttgtgtgtttgagagtgtgggggtttgaatgtgagtgtggttttttgtatatggagatgtttgtttttgtgaatttggaaagttagtttggggttgtggattaggaattagaatatgagtatttaatttttgttattttatagttattttttggttttattatttgttaaatgggaaaaggatatatttttgttttgtttatttatttatgtagtatatttgtgttaagtgttttttgggtgtagattttgtgaggaagtttttgatgaaggttatagtgtagaagggtatagattagtttttagaagggagtagttttgtgttggggagaattggttgtgttatatagaaagtatatataaaagtatatagagatgttttagtttagattaaggggagattttttggagatatatggtgagatttaaggaggaaggggaagagttaggtgaagagggtttggggatagtgtttgggtggaggaaattatttatagaaaagttgaggagtgagaaggagtggtttgatttatttatatgtttgaagttatgtatttatggagtattagagagagaaataaggtagagaagtgggagggtttgggggtttttttttagaatgttaaattgggatattatttgattagatttgtgtttgagaaagggaataggttgtgttttgattttttttttttggattttataaagatttaattatagaagggatgtaagaattttttgtgaatttttggtaaggattataggggttgatgtagtttagtagatattattgagtttttgatgtatttaggtattttgtaggaggagatgtagggttggtatggttatagtttgtttaatggtttttttgagaggggagagttggatagaagttatttaaattttaaggaagaaaggggaggttgaaggattggaaaaattttattttgtttggattttgtagttaggaaggttgtttttaaaagttagtattggttggatatagtggtttagtgtttgtaattttagtattttgggaggttgaggtgggtggattatttgaggttaggagtttaagattagtttggttaatatggtgaaattttatttttattaaaaatataagaattagttaggtgtgatggtgggtgtttgtaattttagttatttgggagattgaggtaggagaattgtttgaatttgggaggtagaggttgtagtgagttgagattgagttattgtattttagtttgggtgataagagtaaaattttgttttaaataaaaataaaaaataaaaaaggtagtattgtagggggttttaagagatggaaggtttttagaaatggagggaggattttggtgaatggaggaggtataggttggagagaaagaaagtttaatgtgtgtgtggtgtgtgtatgtgtgtgtatgtgttggggtgtgtgtgtgtgtgtgtgtgtgtgtgttggtgtgagtgttgtttatgatgatatttttttttgttttttttttaaatttttttattttagtgttgttggttagttttttttggaggtagtgtaggtggtttattagatgtgggaatttagtgtagtggtttgagtagaggttagatttttttttttttttgtttgattttttgattatagtttttttgtttgtatttttttgttgttttggttggtatttagttgttttttggtggttaatttgatatgttgatttttatatttgaagttttttttttttttttggagtggtgaattggtggaggggtgtatttggtttttgtattagtttttgatatgttggaaagggttttggtttatttattaatagggtttgttgaaatggagatttggttggttttatggaggggtttgttttgtttggagttgaaatagttggttttagagatatgaaagttgagaatagatgggtatttttgggtgtattggaggattttaggttgtttttttgagtatttttagattgggggtttataaaggataggaatgaaaggttttattaaagtattttaggtaaattattttagagattgtaatatttggtttatataaaaaagtatgggattttggagttttttgttatttatttgttatgtaatttttggaaggtgttttttttttttgggtttttatgtttttatttttaaagtgaggggttaatatggtaattttggtgattttttagggtttttgagttttgatgttttaggatagtgttttttaaatgataaggtaagagatttttgtagatgattgtaggtgatgtgagaagtgaatttagtttggtagggttgaataatgttgaattttatagagtgaatgagaaaggtatttttttttaattttattagtgtttttgattatgttaaagaggaagttttggtttggtgttgttgtttttgtaatatttgttgattttttttttttataaagagaaagttgagagagtttgttttaagttttagagtttttggtaagtagaggtattatgttaaattttatggtatattattttttttgtttttattatgttgatttttgtggtaaattgttagtttatgatatatggtattaattttttaatttatggtagttatataaaattaattttatttatttttttttttttttttttttttgagatagggttttattttgttatttaggttggagtatagtggtatgattatggtttattgttatttttttaggtttaggtgatttttttatttagttttttaagtagttgggattttaggtggatattattatatttggttaatttgtgtagagatagggttttattatgttgtttgggtttattttgaattaatgggtttaagtgatttttttgttttggttttttaaagtgttgagattataggtatgagttattgtgttaagttttattaatttatttaataattattttttgagtgtgtttattatgttagatattgttgtaggtatttgggatatgtaataggataaaatggatataattttttgttttttgggagtaattttaaatgtattttaaaaattgatgtatttaagtagatagaaaagaagttgaattatataaaattattaagagatggtatagtgtgtgtgttaatttggaatagtgaaagttttttaggagtgattgaaatttgggaaattttgttttggtattttagaatttttttgttgtttttttagggggaatgattttttaagaggtagagggggttttgggggtagggtaggatttagaagaattggggatgttttggtggaataagtagttaaggggtattagaattgaggtagattttgtggtaggtgggagtttagttaattttttttgattaggatttgttttgtttttagttttgagtttttttttttttttttttatatttttttgttttttttttttttttttttttttttttttttagtttttgtgtagggtttgtttgttgtggttttatttttgtttttttttttatttatgttgtttggtttgggtttatggggtgagttttttatttttgtatgttgttttttagtttggtttttaggggggtttttagatatttgttgagtttttttttgttttttatagttgaagggaattgtgtgtttagttaatgattttaattttgatgtagatgttaaagtgttgtggaaagttatgaagggatttggtatgggggatgggaagggagtagggttggtttttagggtagtaggtgtggtgggtttggttgtgggttggtaggggatggagtgaggttttaaattagagtttgtaggatgaggaaggtttgattttaagtttttatttttttagtttttagagtatagagaggaggggtaggagagggtttataaggaatttggtagaagttttttttagggattaaggtgttttttagttttttggaagtagtattttggtattgaagaaagtattaggttataaaattggtatggtgttttggttttgttgttgatttattgtgtgattttgggtgagtttttttgttattttgggtttgaatttttttatgtgtaaaattagggttgtggattttggaatttaagagtttttttttattttgtggtgggagtgtgttttgttgggtaggttttttagatttatatttggtattagtgggaagagtattgtatttataggtttagattagttgggtttgtgtttagaaagtttagtttgggataggttatttagggtttggttttttttgtttttttgttttatttgtttgatagtaatttttaggaggttttaggttaagtttattatttttttgagttttttttttatgtgttttatgggaatgatgatatttgttaagtttgtttgggattgtaggatgttagaggtaaaaatgttatgaaagatttttgtgttgggtttgtggttgatggtattaatttgagaagtaggaagtgatattttaatgttttttagagttaatttgttgtggttagagggatttagggtttagtttttagagagttgaagagaaaggatatagagttgttaataggatttggattgttagggttggaaggattttttggtgattattttagtttttttatgttatagatgtggaaattaagttttattaagggaaggggatttgtttagggtgggtagttattgttagagttagaattagaatttagaggtattgatttttaatttagtgttttttattttttagttgttttttttttttagtgtgttaaaaggaaagggagggaggagtttagtagaaattagtggtttgagttataggtaagtggattgtagggatttaggagtatatggttgtttagttaggtttttattttgataaagattgatgaggggttattagtgggtggtgtatggggaaagttgagagttataggtttttttttgaggtatgtggttttggtgatttagggattgatgaagatataattattgatattattatgtattgtagtaatgtttagtggtagtagatttggtagatttttaagttttattttggttgggtaaggatttttttttgggttttttgtgtaatatgtatgtattttgtttgattgagtttagtttgtttttattggttttgtatagttgggtattagggtttttatggtagagggattttgtgtggttatatgattttagagtgtttttagtattgggtttgggtagatatatttttttatgtttttagttttttgtgatgggtaatatttgtgtgagttgtttagtggatttagaggtatagtatggggttaagattagggttatgagttgtttttagtgtgttttgggtattttgtaatttttttgtatagatagagttggttttaaggttttaattgagtgttagggattattgtatattggtggtatttggtttaggttgatgtatttttttttgagtggaaatagtgttttttagttttgttgtttttttgtttttgttttttgtgttaaggagagtgggttttttttttggttgttttttttttattttttttggttttatttaaataataagtataatattagtaaagatagatataagtttttatgattttttatgtggaatttttgttttttttttttattttttttattttgagttatgtgtgggtaagtgttgatgttggtatgattgtggttttgttttttgtaggatttaatgattgatttgaagtttgagatttttggagatttggtaaggttgattttggggtttatgatgttattggtttattatgatgttaagtagttgaagaaggttatggaggtatagtgtggtattagggggtttagtgtttgtgggtgttaatagggatataggtgatttttataagtttaggtggattagttgtaattttttggtagaattttttttatatttagtttaaattggtataaatataaaaggagatgttggtttttataattgaaaattataggattagttttgagtttagagatttaaatgatgttttgtggatttttggtttatttttgttttggttttgttgtttttttttttggttttatttttaggtagtttttttttttatggtggtatatgtttattttgttagttagtggttttagtagaaagagttttttttttttaggagttttaataataggtttggtatttattttaagttgatttagtttaagttatatgtttattggtgttagaagggttttatggagttgttggaggaagtggggtgggttttgaatgaaagtattagtagttggagtttgtattttagtttagatttgttatttatttatagtgtgattgggttattttttatattttttaattttttgtgtttttatttgggaaatggaaatggttatttttgttttttaaattaggataggttaattaaggttataggtatgaagggtattgttaattttgaagatttgattttatattaaataagaaagtattatgttttggtttagaagttgttagaattgttttgttttttaaggtattaattgtattaatggttattgtttataaagagtatatggtaatttttttaggttaggtatattagtttaattagttgtttttttaagttataaggtagggtttttattttgtttttattttatagatgaggaaattgagatttggaggttaagttgtttggttatggttatagagttatgaagtagtaaagttgaggtttagattagtttttttgattttagagtttgttttgataattgtataaaattagtagtgtttttggttttttgtgtattaagaggagggtagtaatggggagttagaggattttataaaaatattgtttaggttaagtagattgagatgattgttttttaaaatatttaagttaaaaagtaaatgatttaaagatatagggtttagaaatagaagagattgatgaggtaatttaattgaattttttttatttttaaagtttttaagtgggaaatagagaggtttagagagttagtgagttagggggagatgagggttagatttagttttaggatttttttgattgttttattatatatttgtttttaataaagaaatgattgaagattttaattaggatgaattttttaggatttgagaaggtaggattattagagtattaggtagtaatttttttgaggatagagaatatgttttgttttttgtttttttttttttttttttgagatggagttttgtttttttgtttaggttggagtgtagtggtgtgattttggtttattgtaatttttattttttaggtttaagtgatttttttgttttagttttttgagtagttgggattataggtgtatgttattatgattagttaatttttttgtttttttagtagagaaggggttttattatgtttgttagtgtggttttgaatttttgattttaagtgatttgttttttttagttttttaaagtgttgggattataggtgtgagttattatgtttggatttttttttttttttttttgtagttgtagttttagtattttgtatagtggttagtatataataggtgttttaataagtatttgaatgagtgaattagttattgatttatttagttaattaattagttaattttgtttgtttttttttttttttgatagtttttttgtttttttgtgtgtagatttttgtatgataggtttttagtttgttttagtttagggtatgtaatgttttagtttataaattattttttaaatttaagagtaaataaatgtaagttagttatgatggtttatgtttgtatttttaaaattttgggtttgagtttaggagttttagattagtttggataatatggtgaagttttgtttttataaaaaatataaaaattagttaagtatggtggtatgtttttgtggttttagttatttgggaggttgaagtaggagaattatttgagtttgggaggtggaggttgtagtgagttgtaattatgttattgtattttagtttgggtgatagagtaagattttgttttaaaagaaaaaaaatttagtattttattttaagtataaaatttttttttttttaataaaataatatatgtttattgtggagatttgaagaaatagagtaaaaaagaagaaaatagtaattatttgtgattttttatttatatagagattaaattgttagttaatattgtgaggtatgtgtgtgtttttttgtttttttttaatatttataagtagaaatttttatttagatgtttatgtgtatatgtggtgttatatatatatgtttatatattttttttgtttggggggttggaaggtaaagtagtttatatgggaggttttggggattttgagaggttggtatagttagttttggttgtgttaaggttttgggtttgagggttatgtttggaggtgaggagaaaatttaggaatgtttggtttgagttttagttgtttgggttttatggatttttgtataggaggttagaattatggttgagattatttttgttttgatattttagggagttggtatagatgaaaaggtttttattgaaattttggttatttggattaatgttgaaatttgggttattaatgaggtttataaggagggtgagtttgggaggtttgggtttagatgttgggagaatagttaggttttttaatttttaattttagtttatagttttgtttaggattttggtttgtttttttttttttagtttttgaggatttgataagttttttgggtgtgtttatttttgtgtttggggaaaagataggtgttttggtaggataaaggtttggaggtagaaaagggtttggttggaagtgggaatagagaatattttggtttgttggagagagggagggtgattttaggggtgtgtagtttatgtagttttatagggttttatagttagaagggttttatatttggttgtaagttatgttgttattgtttagaaattttttatttttaagtgagtggttttatatttttattttgaagaattttgagtattagttaaaaatgtttaaattggttaggtgtagtggtttatatttgtaattttagtattttgggagttttaggtaggtggattgtttgagtttaggattttgagattagtttgggtgatatggtaaaattttgtttttataaaaaatataaaaattggttgggtgtggtggtttatttttgtaattttagtattttgggaggttgagatggtggattttttgaggttagaagtttaagattaatttggttaatatggtgagattttgtttttattaaaaatgtaaaaattagttaggtgtggtggtatgtgtttgtagttttagttatttaggaggttgaggtaggaggattatttgaatttgggaagtagaggttgtagtgagttgatattatgttattgtattttaatttgggagatagaatgagattttattttaaaaaaaataaaaaataaaaaaattagttaagtgtggtggtatgtgtttatagttttagttatttaggagattgaggtgggaggattatttgagtttagggaggttgaggttgtagtgagttttgattatgttaattgtattttagtttgggtgatagagtgagattttgttttgaaaaaaaaaaaaaaagtttatattttttattttataagtagttttaaaatggtagaatttttgagtataggagtgatatagttagagttttgtttttgggtttagtaattgttatgtaggagggaaggtagaagagagaatgataatagggaggtgatttaagaggttgttaaatattaaaggtgagatgtaatgggattttaattgggatagagttgaggggatggaggggagatgatgggttgatgggaatgtttattgttttataaaattagtaggaggatggttggatgtttttatgagttagttataaatttttttatttttatttttttttgttaatattgttttggtttaagtttgagttttttggatttttttttttgtaattaaattttttttggttagtagttatttatattttttttttttgttttagattattataagtttttggaggatgttttgagtttagatatatttggttattttaggaggatttttatttttttggttatggtgagtgaatttatgggttttaggttggtttgtttattgggaggtttgggaggaagggaaggtttattgagtggagggtataggggagttagaagtgtatttttgatggagagggggtgtttttttatttgtttttttagagttttattgtttatttttgttgtttttttgttaaagttggtgtggtattattttttttagatagttttttttggtggtttttgttttggtttgttgggtttttagtttataggataaagttatatgggtgatttttttttgtgttgttatttgggagtttttgttattattttttgaatttttataattaaaatggtagatttttattgatagttattgagagtttgttgtgtgttaggtattggtgttaagtgttttgtatatatttttagttaatgattataatagtttattttatagaggtaggatttttgtttttgtgtagttgatgaggaagagtatttagagaggtgaaaatgagtagggtgtgtggtggtatagagatggagatgggttgatgtttggggattgaatttttttgttgtttttgttgtaggggtattgtgaggagggaggagaaaatttggattaggtatgggaagatgtttaggtaagatttttagtttattttagttatttttgttgggtgtttttgagatgtaggtttagtttatgtgtgtttatgttgggttttgtttgtgagtgaaggtttttggtaggggtgtggttggtttgattggttgatatttagattgtagaaatgaggtttagaagtgtggtgttggtattattggtattttttaggtgaatagtaggatttttagagttggtagggatttgtagattatttaggttaaagtttttatgttatagtgggaaaatggaggtttagaaagggtaaatgatttttgaaagttatatagtaaattagtggttttagtagaattgatttttagagagttggtttgggaatttgttgagaagagggtttgagtgttaaaggttttggtttattatttgtaaaatgggattgagattggagggagtgttttgggatgagtttagaaagtaagttttttaagggttggaatttttattttgtttattgatatatttaaagtaatatatgattagtgtttaataaatatttgttgaatgaatagtagggaaaagggttttttaggagttttttggttgttttgttttagttttgttttttagtttagtgagtttgaggtttggaaatggttttttttggaggttggataattttaaatttattttttttgagggttttatggttgggtagtttttattgaggttagtgtattgttttttattgatttgtattttgattttagtatttagtagtttgatttaggtttatgtttttattttttttgattgttttatttttttgtttttaaaagttgtgtttagggatgtggggtatagatattatagatttttatagatatttagttttttttttttatagttggtgagttgaaaagagtattgatggattgagagttagggaattaatttttttgtttttaggttttataatagaagtgtggtttgttataatagtatttgagttagaaaaatttttagttggaatttgatagttatagaattgtaattataatttttagaatgtatattatatattgagaatgatgttaagattattttatatgtttttatgttttttttttttattagaagaaaatgaagttttttaatttttttaatgaaagaatttttaagtggtggtggttttatttgaatttaggtttgtttgatgttagagtttatgtttaattttatttatagtaatattttttaagatttagtagagttaaggttttttgtagtttttatattaaatagttgttgttgtttagttgtttaatttttgttttggaatatggttgttaaaagttgtagggttatatttaaatgtatggtattttagttatattgtgggtatatggatgggggttaggttgagaatttagttagatattagggtggtttgttgaggttatattttatttatttatttaatagatgtttattaagtattattgtgaatagttttgtgtgttgttgagagttttttaaaaattttagtttttattttaaatttattttttaattttgaattgattttttagggaatgtttttgtttggtgtttggtttgttaatgaggttgtgtttttaattgttgttagtagggggtagtggtgggttttgttgatagttgttttgtaaaaggagagaagtggagagagagaatttgggtggaaatagttaagggatttttgagtgagatttttgtttaatttggttgtttttttagatttaggatgttagatttaagtttatttttttataattagtagtatatttttttatagaaattagaaaataaggagaagttaaaaaagattttataatttaatagtaataagtattgttagtattgtggtatatattattttagttgtttttttatgtatatataaaagtggattttttatttttgatagttaaaaattaatattatgtgaatattgttgtatttttaaattaatgatattatttaatggttatatattgttttatatttgaatttattatgttatttaattagttttttttttagtagtaaatttttttattatatttatgaattatttattagaatgaatttttagagatgaaatggaaatgtgggagtaaaatgtatataaaaattaagggtatttgatagggttgagttaagtttttttttagataatgtatatgagtatttggtagtttgtatttgtttgttttatattgtttttttggtggttttttattttggatgtttagaatatttttaagtttttagaagtttgggattgttattaattagttgaatatatgtttaatttttaattgtggttttatagtgattgttaattgtttttttttttattttgttgtttaattagagtaataaattataaataattattatagatttattatgaaatgaaggattgtggttatttttagataattaatatttagatttttttttttttttttttttttttttttttttaagatggagttttgttttgttgtttaggttggagtgtggtggtgtaattttggtttattgtaatgtttgttttttgggtttaagtaatttttttgttttagatttttaagtagttgggattataagtttttaatattatgtttagttaatttttttgtatttttagtagagataggattttattatgttggttaggttggttatgaatttttgattttaagtgatttgtttgttttagttttttaaagtgttaggattataggtgtgagttattatgtttggtttaggtttttaaaaatataatagtttttttgaaatagaatttatttattttattattgatttatttaaagtgtataatttggtggtttttagtatttttatagatttaatgtaattattattataattaattttagaatatttttttatttttaaaagaaattttatatatattagttgtgattttttatattttattaattttttagttttaagtaattattaatttattttttgtttttttagatgtgttttttttaaatattttatgttaatatagtgatattaatatgtggttttttggattggtttttttatttaagaaaatattaatttaaatattatgttaaatatttaatagtgtttttatgggttatttgtgttgtagtatgttggtattttttttttattgttaaataatagtttattatttatttattagttgatggatatttgggttatttttattttttggttattatgattaatgttgttttaaatatttgtgtataagtttttgtgtgtatatatgtttttattttttttagatagaattgttgggttatatgagaattttaagtttaattatttgaggaattgtttagattaatttttgtatgaagtagttaggttaataagaataagtttttgtggtgaatattaatttagtgttttattattttttttttatattatagatattattattttaaagatgttttgaaaaattgagtatgtttagggtattttgatttgtgtaagtgagaataattgggattttggatttttttttgttaaattttttaaatatgtttttttttttttttttttaaaaatgatattgttttatttagtataagtttttataaatttttgataaaatatatattaattttattatattaattattttatatatttatttattttgagatggagttttttttttgttgtttaggttggagtgtagtgttgtaatttggtttattataatttttattttttggatttaagtgatttttttgttttatttttttgagtagttgggattataggtatttgttattatatttggttaattttttgtatttttagtagagatagggttttattatgttggttagattggttttaaatttttgattttaggtgattaatttgttttagttttttaaagtgttgagattataggtgtgagttattatgtttggttaattattttaaagtatatagtttagtggtattaagtatatttatattgttgggtagttgttattattagttatttttaaaattgtttttgttatgtaaaattaaaattttggatttatttaatagttattttttattttttttttttttagtttttggtaattattattttttttatgtttgtgaatttgattggggattttatgtaagtgaaattatatagtatttatgtttttatgattggttttttttatttagtatgatgtttttagggtttaattaggtttttgttttgtgatgtttgagatagggttgagatttaggttggagtgtagtggtataattttggtttattgtaatttttattttttaggtttaagtaatttttttattttagttttttaagtagttgggaataatggtgtgtgttattatgtttagttaattttttggtagagtagggtttttttatgttattttggttggttttaaatttataggtttaagtgatttttttattttggttttttaatgttttgggattataggtgtgagttattgtgtttggtataggttgtttttaatatagaaaaatattttaaaaattagaagtagtttataattttagtagttttgataatttttatttaatatttaaatttaaaatgaaataatatttttgtatttttaagaaatttttaggaagaataaaaaaaatgtgaaagtttttttttatagtttttttttttaaaggtgttttgatagttttttaagtattttttaggaagtatgagaaagtgagtgtttatttttttttgaatttagataaaagaaatattatattatataaaaatatgttatattttatttttttatttaatttaaatggaaattttttttattagtattgtagataattttattttttgtaaaaattgtatggattgtttttattgattggataagttatagtttgtttaataagttaattttaggatggtttatagtttttttttagtatgaaaaatgttgattaggtgtagtgtttataattttagtattttgggaggttgaggtgggtggattatttaaggttaggagtttgagattagtttggttattatggtaatattttatttttattaaaaatataaaaaaaaaaaaattaattgggttggtggtatgtatatgtaattttagttatttaggaggttgaggtaggagaattgtttgaatttgggaggtggaggttgtagtgagttgagattgtattattgtattttttgggaggttaaggtaggaggattgtttgaggttagattggataataaagtgagattttttttttataaaaaataaaaaaattagttggatgtggtggtatatatttgtagttttagttatttaggaggttgaggtaggagaattgtttgagtttaggaggttaaggttgtagtgagttgagattgtgttaatgtattttagtttgggtaatagagtaagattttgtttttaaaaattaaaaagaatgttgtagtgaatagttttgtattttattgtggaaggtttttgttagtatatttgtagggtaaatttttagtaatataattgtttgattaaatggtatatgttttttaatttttaatggatattgttaattatgtaatgaaaagaagaggaaggtttttagagtataggttattgtgaagtttataaagagtttagtttatttaatagaataaagttagtagagtttttgggggaatggtgaaagtaatatgtagtttaggtatatgagtttgggtattttgtttttaggttttttaagttatagttatttgtttaataaaatagtgttttaattatagaattttgtgttttgtatagtgtagtgattaaaagtaatttttgtaaaatgatttttttattattgtttgttgtgtgtttttaggtaggttagttttttttaaggttttagttggttagttttttttgtttgtaatatgaaggttaaaattatatgttttttgttttggaattttgaatatgttaaagggtgtagagaattttgtattgtttatatttatattttagtggttttgtaaggaagtggtagggattatttttatttttagataaagaaataggtttggaattttttttgggttttggggtgtgaagggtagagttttttatttttgtgttttttttttattttttaagtgaatatgtttttagttattgttaggtttatttgtattttgagttttagtttaaaaggttataggaaggtatttttattttgtttttattttttttttttttgtattttgggtttttttaggttttttgggattttttttatttttagttaggttttttattttgtattttagggttttagtattagtttttttaattttttttgatttttgttttttttttttttttttttttttttttttttgtttttaggtggttgttgagattttggtgagtgttttgttttttatttgggttttaatggtttttgagtaaagtttgtttttattgggttgagtggggtagtattgagtagtgatttgggagtttgttgtgtggtttttttttttttttttttgggttttgtttggtaaaagataggttaggtaagtgttttttaaattttagttaattatttttggtatgatttgtgttgtgtaattattagttattaatattgatttttaaattgatttatttttaaatttaaaatgagttaaggggaatttattattagtataaatagaattagtagttagttagaagataattatggaaatattaatgtgtagtgtgattgggtgtgtttgtttttgattttgtttggggaaatattggttaggttattttttttgtatatgattttatatattttttttagaggggtttgtagaaaggttgagggatggaaggggaatttttagttgttatgtttagagtttatgtgggtttttttaggagttttagttttatggttttgaggttaggatggaagtatttagtgttaaggttatttttgttagtttatagggtttttgtgaattggagaggggagtatagaagttattgtgtttgaggaaggaagaggggattagttttggtttttttggatggttgggtgagtttagtttttgattgtttttagtttaggtaaagatatgaaagtgaataataattaaggtttttttatgtttttttttttaaatttttgttttaattggggttttgtaggaaatagtagatatatttagtggagataaaatttttttggagatatgttttatgatgattttgtgtatttggagttatttgtatttttggagaggtgaggtttgattttttttttttttagtttagtaggaagattttagaatttgatgagagttttttagttttttgtggtaagaggagtttgttgtttatttattttttttttaatttagtagtagtgtgttatgggtgatggtgattttggagttttgggttttagttttggttttattatttatattttatttttttttttttttttagggaagtaggtgggatgtttgggattaggtatagtaattggattttattttaaaggttaattttgattggtagtagttgtttagagtgttgtgttaaggattttggggttttgtgttatgatttattggtgatgtttgttaggagtaaggtagtgagaggtggtggtggtataagatttatatagatatttttgaattataggttgttgtatgtttagggtatatttgtatgtagtggttttggtatttggtaattatgaagtgttttgtattgagatatttatattttaatgtttggtattatattaaatgtttatatttaatgtttggtattttttagtatttaaggtgttttaatatagtggttaaaagaatggatttgggtattggatggttttgatttgaattttttatttaatagttatgtgattttaggtaagttattgaatttttgtgtttgagtttttttatgtaggaattagggttttagttttatttgagatgattgttgtgaagatataaaaaatataatatatataaagtattggtgtaatgtttgatttagtgagtgttttttgagtgttattattgtgtttttattttaagtggatataggaggaagaggaggtttaggaaggagagggattatttaaggttttttagtgagttggggtagaattatgattaggatttgtgttttttttattattttagtttgggtttttagaatttggttgaggttttaagattattggttaggtatggggattggtgtgggatagatttggttttgagtttatggtagttttgatgttagagtttttttattgggatgattttgtttaatgtatttaggtttgggttgtggttatatttgttgtttttttatttttttaggtatagtttgtgggaggtattgggtggggttgaggaggggttttttgttttttgtattgaagtttatttttatttttggggttttttttgtggttagttttttaggagtttattaagatgattaattatgatgtggagtatattattaagaaggagatgtttggggatgttagggatgtatttgtggttattggtaattggtagggattaagggaagggttgggggtattgggaatttgaatagattttttggaagaatagaattttggtagtttttgaagttattattggaaagtaaatattgttatagtttgtttttaggggtgttgttaaatgtgtgattgtgtaggaatgttatgaggtttgtgtgaggttgtaggagagggtgagaaaataattgttgttagggaagaattaggaagattggggtaggtaggggagggggtatgttgttttgtataattagggtgtatatatatatatattatatatatatttgatatatatatttaatatatataagatatatattatatatatatatatttttatatgtgatatatatttatatataaaatatgttatatatgtatgtgataggtgtatattatatatatatatattatatatagaatatattatatatatatatatatgttatatttttataagatattatatttatatatatattatttatatattatgtatatatgatttatgtatattatatatatgtagtatatatgtatatatatataagatatatatatgttagatgtagatgatatatatatagatttttgtttttttttagtatttggttttttggttatgtttatataatttgagtttttgattttgaaaaggttttttttttttggattttaattttattgtgtataaatatggatgagtggatatgggttagggttgaagttatttttattaatatttattattagtggtattttgttttatttattataaaatatattgtattaatgtatttttaaaaaattttattaagaggtatttgtggaagatttttatataattgtttttaattataaaatatattttgattttagagatattaaaatgtgggggaaaggtgtgttagatttgggtgaagtagaggtggtggtaggggtgttgtttagtatgtgatgggtttttattatttaggagtaatatttaggaggtgggatagtttgatgaataaaagtatggaatttaggttgaatttttgttttgttatttatttattatatgtttttgggtaggttataaaatttttgtgttttaatttttttttttgtaaagtggagataataatagtgtttagtttatagggtggattttgtgaggttgaaattagttaattatatgtaaagtatttggaatggtgttttttggtatgtaatatttattggataagggttagtttgtatttgtattgttgttttttattaagttttgtgtaaagttagttgtatgtaggtttagttatatttttattaggtgtttttaattagtttattttataaaagaggatattgagtttagagaggtttatagtagtagaattaggatttaaattataggttgtttatttttaaagtttatgtttttaatattagaataattagtttttggagatatttttagatttttattttttttgtgtattttttttttttttttttttttttattttgaataggtatatatgtgtaaatatatattataatatattattttatatttttttatttaatggtaggtattggggttttatgtgatagatggataggtttagtttttaggaagatttgtggggttggttatagaggagagaagtttttgtttagtgtgttttttagttagattgataaagttttaggtttgaagttagggaaggttttttggaggtgatgttatgattgggggtatggatattaagtatagttttgaaggatgggatttgatttagagagataatgtagtgaagggtagataggaaatgtatttatttaggaaggatagagagatataggaatttgtagtttgttttgggaatgggggagtaagggttatgaggttgtaaaggaggttaggagttttgatatttaagttaaggagtttgggatttgtttgggaggtagtagggagatatgtaaggagttggagatgggaggtgtgtgatgtgattttttttatagggtttttgagtttgttgtagaggagttttgtttgattttgttattggggtatgtaattttagttttttgttgtttgtttttattatatttagagttattttagttatagtattggtgtttggttttttttttttaagttgtttgagatatttgtgtgtgggttttggagttttgtagttaagtagttgtgaagggttagagaattttaggttttgagaaagggtggggttggtgaaattaggtaggtattatttgtagttagggtagggagtaggggttgttaattttgtaagattgtttaggttttggggaaatatttagttttagggatttgtatggttttttaaattttattaatggatagttattttttggagtaatatttttttaaattagtaatttttaagtattaggttgtattagagtagggtggttaattattttgatttgtgtaaggtttttagtgttgttaggttggtgtaaaagttattgtagttttgttattgaaagtgatggtaaaaattgtaattattttggtattaatttaataaaatttggagtgttttaggtaaattaggataagttggttatttatttttagagttttagatttagtatttttggaatttggaatttgaggtatgagaatttgttttttttttaagtttttaagtgatgttaatgttgttggtttggaaattatattttgagaattattgtttaaaatttttttaaaatttgaatttttagggtggagtttaaattttgagttttaaataagttttttgggtgattttaatgtatttaaaaatttgaggttttgtgttttgggtttatgaggagttaattatttttgaatttttttttgattttggttagttgtaagtattttagaaggaagagagttgtaattaattgagagttaggtttaaggatgggttagaggaggaagtatggggaaggggagtaaaggtgttgtttgagtatgattttggggttgataatgatttgtagatttatgtagggatagatgaggtggggagatgggggaggttggtttagagtttgggtttatagtttttgattatgttttttgtatttttttgttttttttattagtttaaagtgttaagaataagttttttttttttgttgataaattttataaatttatgaaggtaagaaaatatgttggtgtttttttttttttaagtattgatttatatatatatataaatatatagatgtgtattattttttagattaggatttttggtagttgtttttttttatttgatatttattagtatttgtttttgtttggttttaggatggtattttttagttgggggtgattttttttgtttttttttgttttggaggatatttggtaatatttagatatatttttggttattataatttggagattgttgttattagtatttggtggggatagaatagggatgttgttaaataattttagtgtaaaggataagtttgtgtaataaagaattatttagttttaaatgttaaggttgagaaatgtgttttggaggtatatagggttgggtaggatatagtttttgtttttttagagtttataatttatttggggatatagggttttttaggataaatagttattaaaggttataagtgtttttttttgagtttagttttgtttttttgggagagtttaagttatattggttatttttttagttattggagttttaattgtagatagtttgggtaggtgggagggtaggaaggaatttgagatttttattttatagtttttaaatgtgatagttatttattgagtatttatgatgtgttaagtttgtgttaagggttttatttttttgattatagttgatttttatggtagttttgtgaaattgtggtagtatttttatttgatagaggaggaaatttaggtttaggtagggtaaaatgttgtttatatttatatagtttttaagaggtagagttgggatttgaatttagttttgatttttaggttggtgtttgttgttttttgggggtagaggtagttttggttgtttatatattttatgttttgtgtttgttttttgggtttggtggtagttttttagggttggtgtaatatattttagaaattgggtgataaaagaaatttatttttatagttttggaggttaaaagtttaaaattaaggtgttgtttgggttgggtttttttggaggttttgggggagaagtatttttttgttttttttagtttttggtggttgttagaagtttttggtgttttttggttgtgaatgtattattttggtttttgtttttgtttttatttagttatttttttgtgtgtatgtttgtgtttttttttttttaaagatattggttattggtttaggttttaatttaatttagtatgtttttattttaattaattatatgtgtaaatattttatttttaaattatattatgttttgagtttttaggtggatatggggatattatttaatttatatatattttttttgtgtgttagtttggttagttttgggtatagagggattttggttaggattgtttgtagaagatagaggtggaatatttgttttgtttttggaaggaataagggagaaaggtagatgggatattattgttttttgtttgattgggttttatttttttttttgtttgtgttttttttttgtttggttttattagggtgttggtatagatgagaagattttgattaggattatggtattttgtagtgagattgatttgtttaatatttggagggaatttattgagaaatatgataagtttttttattaagttattgaggtaaggggaggggttagaggttagtaggaagtgggtgagtgttagatttttaatataagattagaagtttttatttttatggatttttttttagtgggttattgtttagaatagttaggatattgaaatgaaagggggtttgtattgtattgtttatattgaaattaattttaaaagaattaaaggtttataattaaagatttttaaataaaataagagtttattttttgttttttttaaagtaatgttatggaagtataatttatatattatgggtaggtatggtggtttatatttgtaattatagtatgttggaaggttaaggtaggtggattatttgaggttaggagtttaagattagtttggttaatatggtgaaattttgtttttattaaaaatataaaaattagttgggtgtgttggtttatgtttgtaattttagttatttaggaggttgaggtaagagaattgtttgaatttaggaggtagaggttgtagtgagttgagattatgttattgtattttagtttgggtaatagagtaagattttattttaaaaatagataaataaataaatgaaaaatttatatattataaaatttatttgttttaagggtataatttaatagtttttagtaaatttattgagttgtataattatttttataatgtagttggtttttaaatatttttattattttattaagtttttttatatttgtttatttagttttatttttagttataggtaattattaagttattttgtgtttttgtagatttgttttttttgaatattttatataaatggaattatttaatatgtgattttttgtgtttgattttttgtttgtttgtttgtttttgagatggagttttgttttgttgtttaggttggagtgtagtagtgttattttattttattgtaatgtttattttttgggtttaagtaatttttttgttttagttttttgagtagttgggattgtaggtatgtattattatgtttggttaatttttgtatttttagtatagatagggttttattgtgttggttaggttggttgttagtttttgattttaagtgatttatttgttttggttttttaaagtgttgggattataggtgtgagttattatatttggttgtgtttgatttttttgatatatggagtttatatttttgttttttgagattagttaagattttaaagtttgatgtttggttttatttggttaatgagattatgggtattttagaggtagttttttatagatttagtaggaatgtaagtaaattgttggtatattttgatattatattatgttttaaaattatatattaaaaaatataaggataaataaaattttgaaaattatgttttataataatgataggagttttttagaagggagatttatattatattatgggttaggaagtttggtttttttagtttgaatgtatattagattattgtgatgtgtggtgagtgtgatggtgtttgtatttatttttagtaatggtttggtagttagtatttaatgttgtttgtttaaataagaaattatttaatatgatatgttaagggttatgggggagggtattagtagagtgttaggggaattaagggaggttagagtttattgtgttttttgatgtaagagagtggttagagtgttttttagaggagagggttttgttggtaaatgggattgggggtgtataggggtatgttggataggggagtgataggtggagagaggattgagatgtttttgggggaaaggaataggtgaagttgtagagttttgtataggttagattttaaagggttttgaagttaggttgggagtttgtatatttttttggggataaataaaagggatgtggttatatttatgtgtttgggagattttagtagtttatatgtggtatgggattttatgttggttatggagagaagttgagggagatgtttagatagatgggtagttgggaggagggggtattgagattggaaggattgtttttatttattttgttttttgtttttgttagggtgatatttttggagattttttgaaggttttgttggttttttgtggtggtgaggattagggttatagttttggtgggtatttttgttaagaaatggttattagtattagttgttatggttaagtttgattgttttagttttagagattaaggaaggggtaggggtggggggaggggttgggttgggtttttatttttagtggagtttaggaaatgtttttatttttatgggttattgagggtttagtatggttgagtggttgaaaaattgtagttatagattttgtttatttttatttttttttgatttttaggtttttttagttttttttttttgttatagtttttgttttggtttgggttatgttagatttaaaaatattttgaatttttgtttgtaaaatgagtagtgtttgtattttgaatgagggggttggtggtaggggttagttgaatgtgttgggtggggtggtgggaaggatagtaaatgtgttggggtaaattgataaatttttttatttattttattatttatttttatttaggttgtgttagagtattggattaggaatttggatgtttgggtttaaatttgtatt

SEQ ID NO: 38 - DNA, 8497 bp, Homo sapiens
gtttgagaggatatttagatatttaatttttgtttagggttttgtgggaggtaattgtgtttttttggggttagtgggttagtgtgtgtttttgaggtcgtatgggatattttgagggagggaatgtttttttttagtcgaggttggttaatatgatttaataaggtggtttgaggattagtttatatgttagttgaatgtgtaggtgaggatttgtgagtgtgtgtgtgtgtgtgagatggtgggtagaaaggttagtatgtgaaagtattgtgtgtgtgagtgtgtatgtgaaagagagagggggggttgtgagtaggaaggttagtatgtgagtgtattgtgtgtgagtttgtgtgtgtatgtgtgtgtgtattagagagtgggagagagagagagaaaaaaatatgttgataggtatagataagggatttgggagtaggtgtggaggaattgggtttttgagaaggtgattaagttagagattttgtaaacgtgggttttttggggtgtagaaataggttatttagttcggagaaattattaagcgttttttaagttttatattaagggatttttttttttaatatttttggttagttttatgagtatcgcggatagcggtattgattatgttaaatttcgtaggatagaaagagtagtagtttcgtttttttttttttattttaatttgagttattgtttattttttcgtttaacgttagtttttttaattgtgtattgggaggttgaggtgggtgtgcgggacgtgagttggttttttgaagaagaaaattgtagtttagggtaagagattataatatttggttgtttttgggtattaattaagtatattaagtggggagcgatagtagttaaataatttaagtttataaagttttttaattgtttcgatttacgtggttatagtttttttatttatataaaaggtttatagaggtgtaagtagtgaacgtttgacgtttcgattattgtgttttttattcggacgtttttatttttagaatttttttttttttttaaaaagtattatgatttgtggattttattgtggtggtcgcgtttttagttgtatttcggtttgcgggtttcggttcggtcgttgttgtattatcgtcgttttttatcgtggtattttttgttatcgcggttttatcgggggtttcggtagttatagcgtgtgcggaggttttcgggtcggtttttgcggacgtagtttcggttatcgtttcgggggcgtgtgcgggtttagttttttatgtattattatcgtgtcggttaacgagagtttttttacgttttttaatttggagatcgattttaacgcgtagtgcgtgaagtaggaggagaaggagtagattaagttttttaatagtaggttcgcggtttttatcgataaggtgggtgttttggattatattttttttgaatttttattatttatatagttagggtcgggtattaaggatggagttagaggtataaagatttttgtttgtttgagattttagtttgatgggcgaggtatatagatatatagatagatagatatatgtatagatatatatatataggtatttaagatgtagatttagttgatagtttagatagagggagtttgtgaaggaaaagtgtggttaggttgttttggggtataagttagatattagggagttgggggaggggggtatgtgattattgttgttgaatttagaggggtttgggtagttttagggtgagagagtagggtgtattgatttttagatgatataggggaagggttgggatagttgagtttttttttagatggtttgtgatattttttttttggtattatttttagaaattttatttgtgatttgaatttgagtattttgtttgtgtgggttgttgattatttagttttatagtgagggattgagtttttatttttgtttatttgtttgggtggggggtggggggggggttatttaattttttagggagtaggtattgatattatttagtttttgttttatttttgagtgggaaatttagatatagattatgattaggaaatttagaaattgtttgttttttattgtttatttttatttaattttagataagttttagatttgggggtttttattaaagtattttttttgcgagtttttagagttggttttggggtattagatattatttgttttatttttttatatcgaatggtaggtgcgttttttggagtagtagaataaattgttggagataaagttgtagttttattagaatcgcgagtgttgttagagtaatttggagtttttgtttgagggttatatcgagattttgcggcgggaggtcgagtgcgtggaggtcgatagcgggaggttggttttagagtttaattacgtgtaggaggtgttggagggttataagaagaagtgagtgcgggtaagagggatgttgggtataggaatggggtttaggttaaatatattggattagataataagaatttttaggtagggtgagtggttatgattattagattgatcgagggtggcggggtttttttttttgtggaatttttgtttagatatttgtgtaagaggagggttgtgatttttatgatttgtttttgttttattttagttttttttttttgaattatattatttagtagtttttttttgcgttgggtggggaggaagtttttgtagggtttaggtttttttttttgatttttagtttttatatttgtagtatttgttagatgtgagtttagggttttttatgagtgataggttttgggttttgggtgtcgtattgttttaggttttaagttttgagggtttgcgggtttaggaggttttatatttgagttgggattgatattagtgaggggaggttagggttataggttttgagagtttacgttgtttatttttaggatggggttgggggttgagttttatttgttttttgggggattttagagtttttttgggaataggattgggaggttttagatgagtattttttatttttagtttaaagtggatagagaattttagatatattttatatttaattagaaagtattaagttaggttgttaggtcggggttgtgtggaggtgtttttagtattgtttttatggttgtgatgaagtgtgatgtgatggtggttttgtagagatttgttttgttttgatttttttttttttttttttgttttgttttaggtatgaggaggaggtttttttgagagtaatagttgagaacgagtttgtggttttgaagaaggtaagtgatataggattgagaagtatagatttgtgggattttagaatgatagattttttttggggatatatagggggttttaattttagcgtggggtataatgatttttttatagtaggttaggattgtttagatgtaggtttttgtattgagtatttagggttttgataaagggtaatgatttgggaatatttattagtatttattttgggtaaggggatggttgtattgttttttgtgtgttttgttttgttttagaggttgtggtttattgttgaggtttttggagttatagtagatataatgtttttgttgagagatagtgtagtttgtttagtattttggggagtttgattttgaggtagagatataattttaggttttaaggggggatggagaagaattaggagtagtttttgggtttttggagtattgttgggggataggaaagggttagggtgtgagagttggggggttagtttgggtaggttttttggagtaggagaggggagaaaggagagataagagggtaaggagtagtgaaaggttggtgagtcgtgtttaagataaatagggtttgtttttagaatggtagaggatgttaggttatttcgggaagggttagaagggaaggagagggtatgggaatgagatattggggatttttttttttaggttttatggaatgggtgggaagagagaggaatttagaggttggattattagggtttttgagttttaatattttttatttttttaggatgtggattgcgtttattttcgtaaattagatttggaggttaatgtggaggttttgatttaggagatcgattttttgaggcggttgtatgaggaggtgcgggtttaggggttaggtagagatttggtagttagtagagaggagagatgggggtgggagtgttggataggatgtgggtagaggttgtagtttttgaggttgtgtgagggggtagggttggggattagagaaagtttgaggaggtggagttaggatatggtgggtggggttgtgtttttaattaaagttattgtttttattttttgtaggagattcgcgttttttagttttatattttagatattttcgtggttgttaagttggataatagtcgggatttgaatatggattgtattattgtcgagattaaggtatagtacgatgatattgttattcgtagtcgggttgaggtcgagttttggtatcgtagtaaggtgagtggtataggatatttgtttgttagatatggtagtgggagggatttgagattatttattaaataggtttttttttttggggatgtattagggatgagaagagatggttgttattttgatgttggggtggtagggtaggattgttatgtgtggttgtataggttgagtattgtataatttgtaaaattatttgttatgttttgaatgggtgggaggttttattttgaattttatgagtatttttattttttttagtgtgaggagatgaaggttacggtgattaggtacggggagattttgcgtcgtattaaggaggagattaacgagttgaatcgtatgatttagaggttgacggttgaggtggagaatgttaagtgttaggtatggggtatttgtgtttaaggttagagagatcgagggtttaattatggttatatagtttatgtgtgttttatttggattttagtatttattttttagtttttttgtttatgtagagtttttggttgtggtttttgtgagttttaggtgatgaaggtaagaggttttgttttggggtgtttttagtttggtggggagtatggttttatcgaggtaagtattagagagatttagggattttaatttattttgttttttttgttttttttagaattttaagttggaggttgcggtggtttagtttgagtagtagggtgaggcggtttttagcgatgttcgttgtaagttggtcgagttggagggtgttttgtagaaggttaagtaggatatggtttgtttgattagggagtattaggaggtgatgaattttaagttgggtttggatatcgagatcgttatttataggcgtttgttggagggcgaggagtagaggtgggttttatagattttttttttttttagttttgttagggtttttagtgtgttttgtttttatatttttggtagtatttaagttttgttttttaatttttttattttgtaattagataggtaatttgtgtaagttttttaagtatgatttagtttcgtttgagttttttatgtttatttaggtattgatttgagattgtagttttgtttattttagttgagatttagtaatttggtagtaggtatttttgttattgagaagtttaattaaggtttggggttagtttgtttgggtagtgtttttttttttttagttgtagttgtatgtgttttttaggatttttttttttttttttagtttggttttggttttatttagatttgggagtttagatgtattttataaggatagttttagatagatgatattattaatttatgtttttttattatagtgttaatgagtattttaaagtggtattttattgtggtaggtgggaatgagttaggtagagagtaaggatttattttttggggtagttatgttttgtttttaggatttttgtttgtttgtttgttttagaggtggggggagtggagaagatttattggttatttagtttttttatggttggaggttagcgatatagttggagggtagttatatagtttttgtttttagaaggataatatttttagaatgtgagtttattttttgtttttggttttttttttttagttggttagttggttttattcgaagtttttttttttttgtggatagttaggtttttggttttggggagaggagggtgaaggttggggatgtagagggagtattttgtttatttgggaaatggggaatataggtttgggatttagaaattaaagtgattatatgacgagatttttattaaattcgagttgttttattggaaagtttagaggtaggggtttgtttggttgggtttggggaattttataagtgaagaattttgggaggaggagttttttaagtttgaatttggaagttggagaaatatatggagatggtattggaatttgagtggtttatttttttattatacggggtttttggagtgaatttaggagttttggtatgtgttatttagggaatttgggtatggaatgatttgatggtggttatggttttttttatttgaagttgatttaattaatttttggttagtgtgtttttaggggaattttattttttttttttaggggaagttattgggagggaaatgtggggtgggtagaaatgagtgtttggggtgatagttttgttttgttattggatatgttttttttttgggttttagtttttttatttgtcggatgagaggattgtggtgggtagtttttgagtttgttttaaaattttatttgtttatttaatagttttgtattgagttaggtattgtttttaggtggtgtaggaaggaatagataaaaatgtttatttttttgatgtttataatttaatgatattaattagattggattttagaagttaaatttgttttttttaaatgtatttgtaatttagttagaattaatttcgaggtagtggtagttaatagtttttaagggttatgagttaggtattaagtattggacgttttttatttgatttagttttcgtaagagatttacgaagtaggtttttttgatgaggaagtttaggttgaggttggtttaagttggggttgtatagtttagaagtagtggagagcgaggtatttataggttttttgtttttagatttttacggtgattcgagtttatattggtttttggtcgagagtattttttgtttttttttttgggtaagtgtttagatggagggttatagatgtttttttttattttagttacgggggttcggcgtttttttcgcggtattgatttttcgttttttttttttgtaggttgtgcgagggcgtcggttcggtgaatgtttgtaagtagtggggttcgtttttttttttcgttgggcgggtttgggagtttttgggtaaagggcgcgtgggttcgtagtaaagttatttatttaggtcgcggttgcgtttgacgcgcgttttcgttttttttttttgtaggcgttagtagttttcgcggtggcgttgtttgtggcgatttttgcgtttttattattgtttttgttgtttttattagagttagtagcgtttttagtaatagtaacgtggtggtgggtattattaacgtttgcgtttttttcgttcgggttggcgtttgcggcggtagttgtaagaggtgttaggaggttgtcgttttcgttagcgtttgtcgtcgttattttttatttagttagtatttcgcgttattagaacgcgtcgttcgcgtcggttttttaatagtcgtcgttcgttgtttgtattttaagcgttttttttatcgtttcgtttcgggagttattttcggtcgtaggagttcggggagggtcgggaggcgttatggtttttttttgtagttttttttggtagttaatttgttgtttcgaggatttatttttttttttcgtttgttttttgttttttttgttgtatatattggttttgtttgagtttttttttaaagtttggaggaacgggggaggttcgggaatgtttttgtttgtacgatttgggattttgtttatgtgtttttgtttgtggaatggagacgcggattttggatagtggttttatgattttgcgagggataggtttacgcgtgtggggagaatatttttttttcggggttgtttttaagagtttttgaaaaattaatgattttgttgtttttttttttgtttttgttttattttgtgtttttaataaatttattgtagcgaattaagtttagtgttttagagttttgaaaatgttagggtttttttgtgataggggtttttgttagagcgttttaggatttgtttatttattattttttagtagttaaaaatgattatagtaggtgttgtttatttgtatttgagtagtttaggttttggggaaaacgagagaagatttacggagttagggaattttatggggt

SEQ ID NO: 39 - DNA, 8497 bp, Homo sapiens
gtttgagaggatatttagatatttaatttttgtttagggttttgtgggaggtaattgtgtttttttggggttagtgggttagtgtgtgtttttgaggttgtatgggatattttgagggagggaatgtttttttttagttgaggttggttaatatgatttaataaggtggtttgaggattagtttatatgttagttgaatgtgtaggtgaggatttgtgagtgtgtgtgtgtgtgtgagatggtgggtagaaaggttagtatgtgaaagtattgtgtgtgtgagtgtgtatgtgaaagagagagggggggttgtgagtaggaaggttagtatgtgagtgtattgtgtgtgagtttgtgtgtgtatgtgtgtgtgtattagagagtgggagagagagagagaaaaaaatatgttgataggtatagataagggatttgggagtaggtgtggaggaattgggtttttgagaaggtgattaagttagagattttgtaaatgtgggttttttggggtgtagaaataggttatttagtttggagaaattattaagtgttttttaagttttatattaagggatttttttttttaatatttttggttagttttatgagtattgtggatagtggtattgattatgttaaattttgtaggatagaaagagtagtagttttgtttttttttttttattttaatttgagttattgtttatttttttgtttaatgttagtttttttaattgtgtattgggaggttgaggtgggtgtgtgggatgtgagttggttttttgaagaagaaaattgtagtttagggtaagagattataatatttggttgtttttgggtattaattaagtatattaagtggggagtgatagtagttaaataatttaagtttataaagttttttaattgttttgatttatgtggttatagtttttttatttatataaaaggtttatagaggtgtaagtagtgaatgtttgatgttttgattattgtgttttttatttggatgtttttatttttagaatttttttttttttttaaaaagtattatgatttgtggattttattgtggtggttgtgtttttagttgtattttggtttgtgggttttggtttggttgttgttgtattattgttgttttttattgtggtattttttgttattgtggttttattgggggttttggtagttatagtgtgtgtggaggtttttgggttggtttttgtggatgtagttttggttattgttttgggggtgtgtgtgggtttagttttttatgtattattattgtgttggttaatgagagtttttttatgttttttaatttggagattgattttaatgtgtagtgtgtgaagtaggaggagaaggagtagattaagttttttaatagtaggtttgtggtttttattgataaggtgggtgttttggattatattttttttgaatttttattatttatatagttagggttgggtattaaggatggagttagaggtataaagatttttgtttgtttgagattttagtttgatgggtgaggtatatagatatatagatagatagatatatgtatagatatatatatataggtatttaagatgtagatttagttgatagtttagatagagggagtttgtgaaggaaaagtgtggttaggttgttttggggtataagttagatattagggagttgggggaggggggtatgtgattattgttgttgaatttagaggggtttgggtagttttagggtgagagagtagggtgtattgatttttagatgatataggggaagggttgggatagttgagtttttttttagatggtttgtgatattttttttttggtattatttttagaaattttatttgtgatttgaatttgagtattttgtttgtgtgggttgttgattatttagttttatagtgagggattgagtttttatttttgtttatttgtttgggtggggggtggggggggggttatttaattttttagggagtaggtattgatattatttagtttttgttttatttttgagtgggaaatttagatatagattatgattaggaaatttagaaattgtttgttttttattgtttatttttatttaattttagataagttttagatttgggggtttttattaaagtattttttttgtgagtttttagagttggttttggggtattagatattatttgttttatttttttatattgaatggtaggtgtgttttttggagtagtagaataaattgttggagataaagttgtagttttattagaattgtgagtgttgttagagtaatttggagtttttgtttgagggttatattgagattttgtggtgggaggttgagtgtgtggaggttgatagtgggaggttggttttagagtttaattatgtgtaggaggtgttggagggttataagaagaagtgagtgtgggtaagagggatgttgggtataggaatggggtttaggttaaatatattggattagataataagaatttttaggtagggtgagtggttatgattattagattgattgagggtggtggggtttttttttttgtggaatttttgtttagatatttgtgtaagaggagggttgtgatttttatgatttgtttttgttttattttagttttttttttttgaattatattatttagtagtttttttttgtgttgggtggggaggaagtttttgtagggtttaggtttttttttttgatttttagtttttatatttgtagtatttgttagatgtgagtttagggttttttatgagtgataggttttgggttttgggtgttgtattgttttaggttttaagttttgagggtttgtgggtttaggaggttttatatttgagttgggattgatattagtgaggggaggttagggttataggttttgagagtttatgttgtttatttttaggatggggttgggggttgagttttatttgttttttgggggattttagagtttttttgggaataggattgggaggttttagatgagtattttttatttttagtttaaagtggatagagaattttagatatattttatatttaattagaaagtattaagttaggttgttaggttggggttgtgtggaggtgtttttagtattgtttttatggttgtgatgaagtgtgatgtgatggtggttttgtagagatttgttttgttttgatttttttttttttttttttgttttgttttaggtatgaggaggaggtttttttgagagtaatagttgagaatgagtttgtggttttgaagaaggtaagtgatataggattgagaagtatagatttgtgggattttagaatgatagattttttttggggatatatagggggttttaattttagtgtggggtataatgatttttttatagtaggttaggattgtttagatgtaggtttttgtattgagtatttagggttttgataaagggtaatgatttgggaatatttattagtatttattttgggtaaggggatggttgtattgttttttgtgtgttttgttttgttttagaggttgtggtttattgttgaggtttttggagttatagtagatataatgtttttgttgagagatagtgtagtttgtttagtattttggggagtttgattttgaggtagagatataattttaggttttaaggggggatggagaagaattaggagtagtttttgggtttttggagtattgttgggggataggaaagggttagggtgtgagagttggggggttagtttgggtaggttttttggagtaggagaggggagaaaggagagataagagggtaaggagtagtgaaaggttggtgagttgtgtttaagataaatagggtttgtttttagaatggtagaggatgttaggttattttgggaagggttagaagggaaggagagggtatgggaatgagatattggggatttttttttttaggttttatggaatgggtgggaagagagaggaatttagaggttggattattagggtttttgagttttaatattttttatttttttaggatgtggattgtgtttatttttgtaaattagatttggaggttaatgtggaggttttgatttaggagattgattttttgaggtggttgtatgaggaggtgtgggtttaggggttaggtagagatttggtagttagtagagaggagagatgggggtgggagtgttggataggatgtgggtagaggttgtagtttttgaggttgtgtgagggggtagggttggggattagagaaagtttgaggaggtggagttaggatatggtgggtggggttgtgtttttaattaaagttattgtttttattttttgtaggagatttgtgttttttagttttatattttagatatttttgtggttgttaagttggataatagttgggatttgaatatggattgtattattgttgagattaaggtatagtatgatgatattgttatttgtagttgggttgaggttgagttttggtattgtagtaaggtgagtggtataggatatttgtttgttagatatggtagtgggagggatttgagattatttattaaataggtttttttttttggggatgtattagggatgagaagagatggttgttattttgatgttggggtggtagggtaggattgttatgtgtggttgtataggttgagtattgtataatttgtaaaattatttgttatgttttgaatgggtgggaggttttattttgaattttatgagtatttttattttttttagtgtgaggagatgaaggttatggtgattaggtatggggagattttgtgttgtattaaggaggagattaatgagttgaattgtatgatttagaggttgatggttgaggtggagaatgttaagtgttaggtatggggtatttgtgtttaaggttagagagattgagggtttaattatggttatatagtttatgtgtgttttatttggattttagtatttattttttagtttttttgtttatgtagagtttttggttgtggtttttgtgagttttaggtgatgaaggtaagaggttttgttttggggtgtttttagtttggtggggagtatggttttattgaggtaagtattagagagatttagggattttaatttattttgttttttttgttttttttagaattttaagttggaggttgtggtggtttagtttgagtagtagggtgaggtggtttttagtgatgtttgttgtaagttggttgagttggagggtgttttgtagaaggttaagtaggatatggtttgtttgattagggagtattaggaggtgatgaattttaagttgggtttggatattgagattgttatttataggtgtttgttggagggtgaggagtagaggtgggttttatagattttttttttttttagttttgttagggtttttagtgtgttttgtttttatatttttggtagtatttaagttttgttttttaatttttttattttgtaattagataggtaatttgtgtaagttttttaagtatgatttagttttgtttgagttttttatgtttatttaggtattgatttgagattgtagttttgtttattttagttgagatttagtaatttggtagtaggtatttttgttattgagaagtttaattaaggtttggggttagtttgtttgggtagtgtttttttttttttagttgtagttgtatgtgttttttaggatttttttttttttttttagtttggttttggttttatttagatttgggagtttagatgtattttataaggatagttttagatagatgatattattaatttatgtttttttattatagtgttaatgagtattttaaagtggtattttattgtggtaggtgggaatgagttaggtagagagtaaggatttattttttggggtagttatgttttgtttttaggatttttgtttgtttgtttgttttagaggtggggggagtggagaagatttattggttatttagtttttttatggttggaggttagtgatatagttggagggtagttatatagtttttgtttttagaaggataatatttttagaatgtgagtttattttttgtttttggttttttttttttagttggttagttggttttatttgaagtttttttttttttgtggatagttaggtttttggttttggggagaggagggtgaaggttggggatgtagagggagtattttgtttatttgggaaatggggaatataggtttgggatttagaaattaaagtgattatatgatgagatttttattaaatttgagttgttttattggaaagtttagaggtaggggtttgtttggttgggtttggggaattttataagtgaagaattttgggaggaggagttttttaagtttgaatttggaagttggagaaatatatggagatggtattggaatttgagtggtttatttttttattatatggggtttttggagtgaatttaggagttttggtatgtgttatttagggaatttgggtatggaatgatttgatggtggttatggttttttttatttgaagttgatttaattaatttttggttagtgtgtttttaggggaattttattttttttttttaggggaagttattgggagggaaatgtggggtgggtagaaatgagtgtttggggtgatagttttgttttgttattggatatgttttttttttgggttttagtttttttatttgttggatgagaggattgtggtgggtagtttttgagtttgttttaaaattttatttgtttatttaatagttttgtattgagttaggtattgtttttaggtggtgtaggaaggaatagataaaaatgtttatttttttgatgtttataatttaatgatattaattagattggattttagaagttaaatttgttttttttaaatgtatttgtaatttagttagaattaattttgaggtagtggtagttaatagtttttaagggttatgagttaggtattaagtattggatgttttttatttgatttagtttttgtaagagatttatgaagtaggtttttttgatgaggaagtttaggttgaggttggtttaagttggggttgtatagtttagaagtagtggagagtgaggtatttataggttttttgtttttagatttttatggtgatttgagtttatattggtttttggttgagagtattttttgtttttttttttgggtaagtgtttagatggagggttatagatgtttttttttattttagttatgggggtttggtgttttttttgtggtattgattttttgttttttttttttgtaggttgtgtgagggtgttggtttggtgaatgtttgtaagtagtggggtttgttttttttttttgttgggtgggtttgggagtttttgggtaaagggtgtgtgggtttgtagtaaagttatttatttaggttgtggttgtgtttgatgtgtgtttttgttttttttttttgtaggtgttagtagtttttgtggtggtgttgtttgtggtgatttttgtgtttttattattgtttttgttgtttttattagagttagtagtgtttttagtaatagtaatgtggtggtgggtattattaatgtttgtgttttttttgtttgggttggtgtttgtggtggtagttgtaagaggtgttaggaggttgttgtttttgttagtgtttgttgttgttattttttatttagttagtattttgtgttattagaatgtgttgtttgtgttggttttttaatagttgttgtttgttgtttgtattttaagtgttttttttattgttttgttttgggagttatttttggttgtaggagtttggggagggttgggaggtgttatggtttttttttgtagttttttttggtagttaatttgttgttttgaggatttattttttttttttgtttgttttttgttttttttgttgtatatattggttttgtttgagtttttttttaaagtttggaggaatgggggaggtttgggaatgtttttgtttgtatgatttgggattttgtttatgtgtttttgtttgtggaatggagatgtggattttggatagtggttttatgattttgtgagggataggtttatgtgtgtggggagaatattttttttttggggttgtttttaagagtttttgaaaaattaatgattttgttgtttttttttttgtttttgttttattttgtgtttttaataaatttattgtagtgaattaagtttagtgttttagagttttgaaaatgttagggtttttttgtgataggggtttttgttagagtgttttaggatttgtttatttattattttttagtagttaaaaatgattatagtaggtgttgtttatttgtatttgagtagtttaggttttggggaaaatgagagaagatttatggagttagggaattttatggggt

SEQ ID NO: 40 - DNA, 15294 bp, Homo sapiens
gaaatttataatagttatttttttgattttggagaaattatttttttgtttaggtttaagtaggtttttggtaggtttaggattaaattttaggggttatttatgggtttagtagtttaaggtcgtttttttttcgttttttttttattttttttttttttgtttggcgagatgttagttagtattttagtgtttttatttgggtagtggaaagtttgattttttgggtttttgtttgagtgagtgcgagtgtgttcgtttttttgttgtttgttttaggcgggggagggggggggaggtggtgggggcgagggggcgggggtttagttagtttagtcgtttataagaaaattgttttttttgaagttgttaggggggtcgggaagtttgtttttttttgttcgttcgtttttttcgttttattagtttttttttttttttttttttttttcgtttttttttcgttgtttttttttcgtcggttcgtttgtttagtttttagtttttcgttcgtcgtttttgtttttttttttttataaattgtttaggagtgagtagttgttttcggttcgtcggatatatcggatagatagacgtgcggacggtttattattttagttcgttaattagttagtttgcgtttggcgttttttttttttaggtagggttggttttaagttgtttttttagtaatttagagatgtttttggttttgttgttttcgttgttttaagttttggttttgttgtttttagtgtcgcgagggtgtttatagattttttcggtgttttttgtaggttgttgatttacgtttttttatcgttattttgcggtttttttggtttttgttaggtttttgtttcgtttcgtcgttttttaggtattttttttttattttttttttttttttttttttttgattttgttttgttttatttattttttgtttttttgtttttcgttcggggttcgtttttttggttattattttagagcgtggttgggtgattggtattttagttttgttaatggttttgttttattattgtaagttttaggcgtatgttttatttttttagtttcgttttgtttaggcgtttttttgttttagggtttggcgtttggttcgggttgggtcggatcggggaggatcgtttagcgtttatcgagtttagtatttaggagtagtttttcgttgtattgtttgaggttagtttttggtatgggttgaaagatttagttttttaggtatattttaggtattttgtttagatgtttttcgttcgtttatttttaggttaatgttttgtttttatattttttgtgagaagtttgggttttgggagttttggttgtaagggttttgattgggggtgtttgggtggtttagttttgtttgtttttaggatttttttggattgggatttagaatgggtgtggaggggaaggagagaaaattaggtaattgtgttatgttttttagggcggatttggtttggggttttagaggggtttgttaagggatttaggagagggagcgagagagtgttttggaaggtttacggaggggagcgtttttttattgttttatgggcggggttgggtgtttgagcgtttgttgagtagagtagggggtttagggatttgtagggtatagggtatattagtttttagtggtttgttttggtgggtaggttttttttttgttgttttggttgttagattgtttaggttttatttttagggggttttgtttttgggttttcgtttttttttggtttgttagttttttgttttatagtaattaattggaattgagataagttggagatgtttagtttttttgttttcgtgttagaaaggttttcggggattagcgtttaggggtgcgggtgagtattttttggtgatatttagtcgtcggtgttagtcgtattttaggagagttggtgtatgagtatggatgttttggtgcggagtatgtttatgtatggttattgtgggttagtatggtgagtttttgagggtaagttcgtgtgggtatattgaaaggaagatgtagggttgtttttaagttattagggttgggcggtgggagtaggttgcgagttagggagtagagagggtttttatggtaagttggttagttgtgggtggtagttttggtttttttggtttatttttaagttttaaggattcgtacggtagtgggtattaattttattaacgtatagatggggagtttgggaaaggaaggggggtgtttttaaggtaagaatgagttttttgtttttagtaatattttagagttatttaaataaagttatagcgtgttttttttagtgatagcgttaagtttttagaggaggggtttgtaatgagtttatatttgatagttagtatttagagtttttagtaagggtttttgagtttttgttatttcgtatagaggtgggatgaggatttttttatttgtcgttttttgtgtttttcgggtttattttttattttttattttttagtatttttagtttgttcgggagttatatgttttcggtttatagaatttttagtatacgttttatttataggtttagttttagttttggggtttttggtattttatttgttagggttttttttttgttttgtttattttttaatatttttgtttgtcggaaatgtttttttatgtttattacgatttttttttatttatttgtgggtcggagagtttggtttttgtcgtacgttgtttttttagtatttaggtttattatcgagttttcgataggtttgggagttttattggtgggtggggatttattagttgggggttttgtttatatcgaggggttgggggtggcggtggtttttttagggtattttgttttgggttgtaggtcgttgggtgggtatcggttttttcggaaggtagcgtaattcgggattttgtcggttttggtttttattttgtcgatcgggtttggggcgattagtgttttagtttttgtttttttttgtttagatgttgggttgggagattaggggttatagttcggttatttagagtttttttcgtaagttttagagggattagttgtggggtgtgtgtagaggggttgcgttgtggggagggcgtatggtttagtttttttggtttgaggttcgtttagtttaagtggtttttaggatttatggttaggtttttttgtagttttttagaaagaattagttttttagggttttttggggaaggtttggggttattttttttggaggggtggggtttgtgttttatttttttttttttaggtttttttttaggttagaagattttttttattatttgaattttatagttagaagttttttttgggattttagatttttgggaattattttagttgtttttttcgttgtttcgttgtttgttttttttttttgtttcgttatggttttaggttagagtagtttttggggtggttatggaggggttattagttttggttttttcgaggattgtagaatttttttatttttagttttttatttgcgtagttttgattttagttagtttaaggggtagggttaggtttcggttttttggtaggtttggtgaaggtgttgtttatttttatgaggtttatttttgaggtttaggggtttggggttttagttagtttttttgtatggaatttttttggtttattgtattttaagtttgagttttatttaaatattggtttgagataagttggaggattaggggtttaacggattttgtgggttttttgaatttgtttttgttggttattttagttttgtttggtttttgaggtgtttagatgggttaaggggagtatggcgggtagatttttgggtggttagaagattagaaggtagttttgtttttggaggtaggggaagtttgggaagttagtgtgatttttattttttggaagtttgagtttttgtttggttttgattgttattttatggtttttggaggttgtttttatgtaaagagatatatatttatgggagtttagtagttttaggagtttgaagttaagtaggttgtgggttattttggttggttgaaggaggttaattttagtttagtttgagttttcggtagagagcgggttgcggtagggaggggttgtaggaaatttttttttttttttttggttttggtgggtttgtattagggagggagggaggtagggttttaggttttggggggtaggtcgggaatattttttttggggttttgaagtgttcgtttggggagacgatggtttttttaggagattttttgtagatagaggtagaggtgagaggttgggcgggggttgttttgttggttgtgttggggttgaggaggggtttttggatttgtgggttatagggagttattgatggtttttagaagggttatgtttttaggggagttttttgtatagtttcgagagtgtgaagcgtgttagttttggggtttgtggtattgtgtgtattgggagagggtgggtttagatatgggggtaaggatatagacggatagatagatagtgtgtgtagttttagttttgttgtttttttatcgtgtggttttgggtaagagtttggggttaattttttgagttttagtttatttttttattaagttttaagagtattgttttttttttatagttaacgggggacggtaggatgttaagtaaagaaattatatgagttttttgttttgtttttgagaggtgatagtatttttttttttttttggagattttagtaggaggtttcggattttttcggagagtgggagggggtagtagtagttcgtgtgtagaggattaggagcgtatagtgggaagggttgagtttcgtatttcgtcgattgtggggataggttggattttgatatgggcgttataggttgtaaagggttggtatagagaggtgggaggtggttgggcgtattaagggagaattttatttttgtcgttattttgttagaaaatttttggaaaggatttgagtagtagatgagtcggggttttttagtttttttatacgtggttgtaaggggagtagacgtttaagcgtggttgtttgaagggtatgtttcggtaacggtaggggtttggaatgtggtataaggtttatttttttttattttagtttttagttttttaggtagttatttttatagatgaacgtatacgtcgggttttggtaaggttagggagggtatatattttttttttggttgatgtttaagtataggttggagttatcggcggggagggattggtggattggggtttgggagagtggtagggggtaggtcgggtgttagcgggggtataagtattaggttgttggttgaaattgggtttaaaaggttttggaggttagaggggaggggaggaaggatatagtttcggggatttcgtagggttgcgtggaaggtggtatatgtgttagagtttaggtcgggttgtttaggggggtagacgtttagggttgaggttgcggagatagtattcggcgtttgttatttggtagttgtgagttatattatttgtaggcgagtttttagggttcgttagattttaagttttgttttcgtcgtttttggtttggtttgaatgtttggtacggattttttatgtttttagaggttgttaacgtattttgtttggttgtgatttcgagtaatttagtgtagaggattgcgttagtttttagaggggtagataaggagggttttattggggtggtggcggaggttttaggaagtttagtttttttttttatttatatttgcggtcgttaaatttggggtttatgttattgtcgtttttgttttttgttttaaagagatggtatttagggagtttagggtatattttggtggggtttgaaattttttttgaagtttttgaagatatatttagagaggttaatgaagggaaattgaggtttagaggttttagttgtggtggtggagagttgaggattggagggatttgttgtgggttttataggatttgattatggggtatttttgttttttgggttggggttttcgtttgttttatttatgtgtggatatatgtgtatgtatgtgtatatgtatatatatgtatatgtgaatgtgtgtatgtatgtgtgtatagatgtgtgtatgtatgtgtgtatatatgtgtatgcgtgtatataggtgtatatgtgtaggtatgtatgtatgtatgtgtgtatgtatgtatgtgtgtgtgtgtgtacgtgtgtataaatgtgtatgtgtgcgtgtgtgtgtatgtgtgtgtatgtgtgtatgtgtgtatgtgtgtatgtgtgtatatatgtatgtatgtgcgtatgtggatgtatatgtgtatgtatgtgtatagatgtgtgtatgagtgtgtgtgtatttgtgtatatatgtgtgtatatgtgtattatatgtgtatgtgaatgtgtatatatgggtatgtatgtgtgagtgtttaggtgtgtgtatgtatatgtgtgtatatgtgtgtataggtgtgtgtacgtatatgtgtggatgtgtgtatgtatgtggatgtatgtggatgtgtgtatatatgtgttttgtataggtgtgtgtatgtgtgtgtgtacgtgtgtatatatgtgttttgtataggtgtgtgcgtgtgtacgtgtgtgtatgtgagcgtgtatgtgtgtatttgtgtgtgtgtttgtgtgtgtatgtgtgtacgtgtgtgtgtgtgtatgttttggtaggagggaggggtttggtgtgaggtggtggggagaaggtaggggttaggttttgggaggatagttgagtttatattgttaggattttttaaattgttatttttagttttgggtatttaggtttttataggtttagagatatggttggagttttgtggttgaggagtatagttgagagtttaggcggggtttggaggcgttaaagttgagttttaagttaggttgagtgatttgggagaaattagagtttttttttcggttttagtttttgtgtttataaaatggggatatttattaggttagttttaggggattttatttttttttttaggtttttttggttttttttgattttatgggttttttgttgttttttgtgggtttagatacggagtttgtttttttttcgggagaggttttagttttgtgttagttttttgaggggaaatgagggatgtgtcgggaagtttgttcggttttcgtttttttagtttgtttattgtttgggtatagttatgagttatggaaaattagttaaattttgtttttttgtttttgttacggggttcgggtgtatgggttttttagtttttagttttttttttcgttttgagggaattttttttttttgttttttttttagttttttggagattttttagatattttattgtattaggtagtttgtttttagagttttcgttgttttatagttggtttcgggaattcgtttgagatttcgatggttagttttgtcgtgattggtttgttttgtgtttgtgttttttgttttggtggagggttcgattttttaataggagggtttgtagggaagttttagtttttggggagattttttgtttcggggtaggagtttttgtagagtttttttttaggttaatgcgtgggttttggggggttttaagttggttatggttagatggttttttgttttttcggttttttttagtttttttttatagtttttcgtaggtttagtcggattattttaattttatttgtttaggtggattgtttattttggagtttgttagggttttggcggggtgttttagttttgatttattttttttgggaggtagcggttttggtaggggtatcggtaaggaggggtagggtagtttttttttttttttattttattttgtttttttgtttttattttgttttttttgtttttttttattgtttttttttttttttttttttttgttttcgggtgtttattggtattgggagagggttttatagcggtagtaggtatcggaggttttgttttgttttggaggaagggaaatattatttaggtaggtgagtgttgagttttttttttatttgggggttaagatttttcgggcggtttttttaggttttgttgggtcggtttgaggttggtaggttttgggttgtaattgtgggattttaaggtttaaaagaatgagggaggttcggtgttgttttagtaggggttttttggtgattttaggggttagtatgaagtttagttttatatgagggggaagttgagttaagttttgggtttcgatttttattttgtagtgtggtttagggtttgtgggtttaggagggtttcggggttggttgcggaaaggttattttataggtttggtagtcgttatagttatagttttattataggtttttttgtttataggtgtgggagggcgtatgggtggtttttaggggggatgttaatgtaggggggacgcgtgttagtagatgttttttggagtattcgaggagttgtatgggggcgataggataggtttttattttaatttttttttgggtttgtgtttagatttaatttggttttgaagtggttttaggttttcggttcgttggtagtaaggattttaaagcggtagtttcgggtagttagtttagtttttagggtaattggggaagtatcgggtagggcggggttgtttatagggtgttggtttgggggtagagtttttatttttttacggtttttttagatttttgtaattagtagttgggtttagggggtttatttcgttttgttggagttttagatagtttttttttagttagtattggttttaagtgagggttttttgggcgtgcgattgttttaggtttgttagaggtttttgttgtttagttgggttttttatttttagatgtatcgagggttattttaggttgggtggtaagtagggtaggtatgtttatttttatttaatagatggggaaggtgaggttgggatgagatttgggtttttgttggagagttagggtggatgaagtggtgagagaggtagggttttagtttttttttgtagggtatattttcggttgtttttggacgggagatcgtgtttgatgaggagggaggaggtaagtagaggtgggtgttgggggtaggttcgggtagggttgtttcgtttttatttttattcgtcgtttcggtttggggggttttaggtaagtttgattttgttttgttattttggcggtagtttgtttttttggggggtttttttgggttgtcgaggttgtgggtagggaggaagggtgcgagtagatttgggagttttagggttgtttgggttaaggcggtgtgggcggggggttggggcgggtggtttagaggaggaagttaaggtttaggggtagtgttgggggcgttacggtttttatttcgggggtttttatttagtgttgttttagttaattttatttacggtttttaaggatatttttttttttttcgttttgtttttttattttggttttagagggtttttgagaaacgtgggtagggtggagggaggaagtaatttagagtcgtcgtatttaattaattttatttacgttgttttgagtttagaatttaaaggaaggatcggttcgggtaggaggttatagtgatgtttttaaaagtgaattttttaaagtttttgagggttaatggttaggattttttttttattttttttacgtagttttatggacgttttcgttttaaagtaggtttttggtagatttagaggcgtgggggtttgtagatttgttgatgaggagatattttatcgtttgattaagttaagttttgttcgggatggggaggggggtagtggaagtagtgaagggagtggagtggagggggtattttttttgttagtagtatttattttttttttgtttggagttttttgtttatatttcgtttttttcgtttttcgttttagggtttggtcgtttttggtgagggatgggaacgtagtgttattatatacgcggaatattagtttttggtatggagaagataggtgggtgttggtgttgatgattttttcgtttttttttttaggtttattcgttatgtggtttttgtggcgtttcgtgtttttgttggttttgagttaggttttgttttttgagtagagaggtttttgggattttattttggacgatgggttatttatgatgaacgatgaggaagtttcgggcgttgatatttcgggcgttttggattcggattttgttatatttatttatagcgttatgtgttttttcggttgttattgttatttgcgggtggtttagtgtttcgatttgggtttgtttttgagtgatggggagcggggtatgtagggaggtttaggtgtagtttgagagttttttttgaaggggatatatgttggttttgtgggacggtggcgagtatgatgtaagtgtaggaggggtttagtcgtttggttgtgagttgtgtagtttgtgtttatttgtggtggtattttcgtgtgttcgttagtgtttttgtgtgtgtgttttcggttttttttattagtggggttagtcggttggatggttttaagtttatgttggtgatggtggtggggtttttaggtttcgagtttatgttggtggtgggggtggggtttttaggttttaagtttatgttggtgatgggggtggggtttttaggtttgaagtttgtgtttaaagagattttttttgatattacgttgttggatttgtagaataacgatattttcgagtttcgtaaggatgattttaagggtttttagtatttttacgtaaggagttgggaggaattagtaggtttatagtagagggtaggggttcgggtgggtgtatgtgcgtggacgtgtggggtatgagaggggttcggggattcgtggggttttagggtgaagtttggagttagtcgtgatgggagttttcgggtttgcggtttatttatgtgggtttgagtaattatagttgtaggatcggatcgtttagttcggtttttttcgtggttgaaaacgttttattacgtttattttttttagtaatagaggagaacggattttattgtagttagtgtgcgtgtgaggaaattgaggtttggagcggtaaggtagtggtggtattgttggggtttaggatcgggtttgggtgttgttttttgttttgtattttgtttataagtatggattgaattttttcgaggtttagtgggttggggaggtataggaaggtaggagagaggggcgggtggggtggggagtttgtgtttttatttttttcgtttattttgttttaggttttcgttttggtgaataataagatttttaagatttatgagaaggtttttagtttattgcggaagttgtagaagttttatatttttaagaattatttggtggagatttcgtttaatttatttagttttttggtggagtttcgtatttacgataatcgtattcgtaaggtgtttaagggagtgtttagcgggtttcggaatatgaattgtatcggtgagttgagggttttttagaatattttagagttttgtttcgaggtatggggaagggagattaagggatatttttagaggtttagtttaagaaagagtatggtgagaacggttaaaagaaaatttatggattttttggtaaattttttatgtaggcgattattacggttaaagagaagattgggttagaggggtcgggtggttttcgggagttttatttttatttttggtatttttttttttttttttgttgtttttggagttagtagttttggggttagtagttttgaatagttaggagtttgtaattagttcggtaaattagtagaattgtttttaggagacgggagtagtcggtaggtagtagggtttattatattggttcggaagtgataggatttagggttgtgtagggattattaggttttcgggttaatgaggttttttttttagagatgggcgggaatttattggagaatagtggttttgaatttggagttttcgatggtttgaagtttaattatttgcgtattttagaggttaagttgattggtatttttaaaggtaggaagtttattttttttgtacgtttgtttgttttatttttaatagtatagatggttagggtgggggttttggatgggttcgatttatttagggaaaggtttaatagttttttttcgttatttggggtagagttagggtttttgtttttagtatttgtatttttttttgtgttttttttttttggtagatttttttgagattttgaatgaattttatttagattataataaaatttaggttatcgaattggaggatttgtttcgttattttaagttgtataggtgaggttagtagggtatcgtttaagggtgatgttagagttttttagtgttgtgtggtttttcgcgtttagttttttatttttatttttagtttttgagttcgtgttattttttcgtttataggttgggtttaggttataattagattaggatgatcgagaacgggagtttgagttttttgtttatttttcgggagttttatttggataataataagttggttagggtgtttttagggtttttagattttaagtttttttaggtgagagttgggtatgtatagttaggttttttaaggttgggttgggggaggcgtgtgtgttttcgggtagttttttagttttttggttttttttttcgatcggttttgggtatttgtaagggagcggttttgatgtttttagttggtgttgaggaggtagggagtaggggttttatggtggatatcgagtaaggtagtttggtagtttttggattcgagggtttttaggtgggtcggatattagaaagatgtggtagagtttagggagtcgagaaattgtgggcgtgggagtgtatagatttgtgttaagatagtgatcgtttagggtaggaagtaggttgacgagggggagtagggttttgtttgggattttatcgggagtttttatttttggtttggttcgtaattaggtgggtgattttggttttgtttagttttgttttatttataagtgtttggagtatttttattcgtattagttgcgagttagtatcgcgtaggttatgtttatgttgggtcgagtgcgttttttagtggttattgttatgtttattagtattgggtttttagtttaatttagtaggcgtttcgtttgtttattttcgttttttttagagatagtaagacggtggttttagagagttggaggggttgttagagggcgagtttttttgttgattggaagaaagaggagggtattttaagggttttttttttttttatgttttatggagtgtgagggtgttttttcgaggtttaggttattttttttttattttatattattaaatatatttttattttagtttcgtttttatatgtttttaatttgatttatttgagatttttatttttgtttttggttatatttagtgttttaattttggttgatatttatataaataatacgtttatgttttggtttgttttttttaataacggggagtttttggtgtggtttttgaagtagggtgtagaggtaatagtaaaatgttttttggaggtagcgggtttggcgtggagggagggaggtttgtcgtgattcggtttttttgtttttaggtggtttatttgtattttaataatattattaaagtgggtgttaacgatttttgttttatgggtttcggggtgaagcgggtttattataacggtattagtttttttaataatttcgtgttttattgggaggtgtagtcggttatttttcgttgcgttattgatcgtttggttatttagtttggtaattataaaaagtagaggtagttgtagttatcgcggggttttagtgggggtttttggggaatatagttagatattttgatggggaggtagagttaggaagttaagttagggtttagttgcgtttaatttagttttttatttcgggtttttgattttagttcgatgttttattatcgtttttttttggtttttaagggtgtaggtgggcgtaaggttcggtttttattatatgtttttttggttttagagttgtttttgtttttttattatagttatttagaggtattttatgaagtttttttttcgtttatttttaaatttaagtgtttaaggttttagttttaggagaatagtttttgggttagtagttaggaggcggtttataagaatggggatagtgggttttgttagggttgtcgtatttgtttagatatatatgttttgttttttttttttatgtatttttagttttttaatttttttcgattttgcggttttttttagtttttttgtaagtttatggtttgttttttttagatttttgttttattggtttttcgattagtttttttttttgtttttttttttttcgttttttttttttttttttttttttttttttttttttttttgtgtgtgtgtgtgtgtgtgtgtgtgtgtgtgtgtgtgtgtgtgttttgtgtttttttagatttttttcgtttttgagtttggtggtttgttttttttattttttcgaatttggtttcgtttgttttttttattttatattttttggttttttgttttgagttgggattgttttttgtttgttcggtttgtatttagtttttgtttataaaattttagggatagtagtttttttagtttgttttgtttaggttttgtttttaaatttgtattgtttcggaggaggttgggaggtggaggtttagtatttcgcgtagatgatattattaatcgttagagttttagatatcggtttttttagaagttttttatttttattggtttattggtggttaggtttttttttatttttttggtttagcgtaaggaggggttgtttttgaggtcggtggttgtttttttattaaagaaatatcgtgtaacgtggtttcgtgcgttgtttttgtggcggtttggttttttcgtgttttttttggtttttgggttttttgtttttagaagaggggtttcgttatttttagaagaggggtttcgttatttttaggtttgggttagttcggattagggaggtttttttttttttttagatatttttatggttttagttgttttgagacgcggtttta

SEQ ID NO: 41 - DNA, 15294 bp, Homo sapiens
gaaatttataatagttatttttttgattttggagaaattatttttttgtttaggtttaagtaggtttttggtaggtttaggattaaattttaggggttatttatgggtttagtagtttaaggttgttttttttttgttttttttttattttttttttttttgtttggtgagatgttagttagtattttagtgtttttatttgggtagtggaaagtttgattttttgggtttttgtttgagtgagtgtgagtgtgtttgtttttttgttgtttgttttaggtgggggagggggggggaggtggtgggggtgagggggtgggggtttagttagtttagttgtttataagaaaattgttttttttgaagttgttaggggggttgggaagtttgtttttttttgtttgtttgttttttttgttttattagttttttttttttttttttttttttttgttttttttttgttgttttttttttgttggtttgtttgtttagtttttagttttttgtttgttgtttttgtttttttttttttataaattgtttaggagtgagtagttgtttttggtttgttggatatattggatagatagatgtgtggatggtttattattttagtttgttaattagttagtttgtgtttggtgttttttttttttaggtagggttggttttaagttgtttttttagtaatttagagatgtttttggttttgttgtttttgttgttttaagttttggttttgttgtttttagtgttgtgagggtgtttatagatttttttggtgttttttgtaggttgttgatttatgtttttttattgttattttgtggtttttttggtttttgttaggtttttgttttgttttgttgttttttaggtattttttttttattttttttttttttttttttttttgattttgttttgttttatttattttttgtttttttgttttttgtttggggtttgtttttttggttattattttagagtgtggttgggtgattggtattttagttttgttaatggttttgttttattattgtaagttttaggtgtatgttttatttttttagttttgttttgtttaggtgtttttttgttttagggtttggtgtttggtttgggttgggttggattggggaggattgtttagtgtttattgagtttagtatttaggagtagttttttgttgtattgtttgaggttagtttttggtatgggttgaaagatttagttttttaggtatattttaggtattttgtttagatgttttttgtttgtttatttttaggttaatgttttgtttttatattttttgtgagaagtttgggttttgggagttttggttgtaagggttttgattgggggtgtttgggtggtttagttttgtttgtttttaggatttttttggattgggatttagaatgggtgtggaggggaaggagagaaaattaggtaattgtgttatgttttttagggtggatttggtttggggttttagaggggtttgttaagggatttaggagagggagtgagagagtgttttggaaggtttatggaggggagtgtttttttattgttttatgggtggggttgggtgtttgagtgtttgttgagtagagtagggggtttagggatttgtagggtatagggtatattagtttttagtggtttgttttggtgggtaggttttttttttgttgttttggttgttagattgtttaggttttatttttagggggttttgtttttgggtttttgtttttttttggtttgttagttttttgttttatagtaattaattggaattgagataagttggagatgtttagtttttttgtttttgtgttagaaaggtttttggggattagtgtttaggggtgtgggtgagtattttttggtgatatttagttgttggtgttagttgtattttaggagagttggtgtatgagtatggatgttttggtgtggagtatgtttatgtatggttattgtgggttagtatggtgagtttttgagggtaagtttgtgtgggtatattgaaaggaagatgtagggttgtttttaagttattagggttgggtggtgggagtaggttgtgagttagggagtagagagggtttttatggtaagttggttagttgtgggtggtagttttggtttttttggtttatttttaagttttaaggatttgtatggtagtgggtattaattttattaatgtatagatggggagtttgggaaaggaaggggggtgtttttaaggtaagaatgagttttttgtttttagtaatattttagagttatttaaataaagttatagtgtgttttttttagtgatagtgttaagtttttagaggaggggtttgtaatgagtttatatttgatagttagtatttagagtttttagtaagggtttttgagtttttgttattttgtatagaggtgggatgaggatttttttatttgttgttttttgtgttttttgggtttattttttattttttattttttagtatttttagtttgtttgggagttatatgtttttggtttatagaatttttagtatatgttttatttataggtttagttttagttttggggtttttggtattttatttgttagggttttttttttgttttgtttattttttaatatttttgtttgttggaaatgtttttttatgtttattatgatttttttttatttatttgtgggttggagagtttggtttttgttgtatgttgtttttttagtatttaggtttattattgagtttttgataggtttgggagttttattggtgggtggggatttattagttgggggttttgtttatattgaggggttgggggtggtggtggtttttttagggtattttgttttgggttgtaggttgttgggtgggtattggtttttttggaaggtagtgtaatttgggattttgttggttttggtttttattttgttgattgggtttggggtgattagtgttttagtttttgtttttttttgtttagatgttgggttgggagattaggggttatagtttggttatttagagttttttttgtaagttttagagggattagttgtggggtgtgtgtagaggggttgtgttgtggggagggtgtatggtttagtttttttggtttgaggtttgtttagtttaagtggtttttaggatttatggttaggtttttttgtagttttttagaaagaattagttttttagggttttttggggaaggtttggggttattttttttggaggggtggggtttgtgttttatttttttttttttaggtttttttttaggttagaagattttttttattatttgaattttatagttagaagttttttttgggattttagatttttgggaattattttagttgttttttttgttgttttgttgtttgttttttttttttgttttgttatggttttaggttagagtagtttttggggtggttatggaggggttattagttttggtttttttgaggattgtagaatttttttatttttagttttttatttgtgtagttttgattttagttagtttaaggggtagggttaggttttggttttttggtaggtttggtgaaggtgttgtttatttttatgaggtttatttttgaggtttaggggtttggggttttagttagtttttttgtatggaatttttttggtttattgtattttaagtttgagttttatttaaatattggtttgagataagttggaggattaggggtttaatggattttgtgggttttttgaatttgtttttgttggttattttagttttgtttggtttttgaggtgtttagatgggttaaggggagtatggtgggtagatttttgggtggttagaagattagaaggtagttttgtttttggaggtaggggaagtttgggaagttagtgtgatttttattttttggaagtttgagtttttgtttggttttgattgttattttatggtttttggaggttgtttttatgtaaagagatatatatttatgggagtttagtagttttaggagtttgaagttaagtaggttgtgggttattttggttggttgaaggaggttaattttagtttagtttgagtttttggtagagagtgggttgtggtagggaggggttgtaggaaatttttttttttttttttggttttggtgggtttgtattagggagggagggaggtagggttttaggttttggggggtaggttgggaatattttttttggggttttgaagtgtttgtttggggagatgatggtttttttaggagattttttgtagatagaggtagaggtgagaggttgggtgggggttgttttgttggttgtgttggggttgaggaggggtttttggatttgtgggttatagggagttattgatggtttttagaagggttatgtttttaggggagttttttgtatagttttgagagtgtgaagtgtgttagttttggggtttgtggtattgtgtgtattgggagagggtgggtttagatatgggggtaaggatatagatggatagatagatagtgtgtgtagttttagttttgttgtttttttattgtgtggttttgggtaagagtttggggttaattttttgagttttagtttatttttttattaagttttaagagtattgttttttttttatagttaatgggggatggtaggatgttaagtaaagaaattatatgagttttttgttttgtttttgagaggtgatagtatttttttttttttttggagattttagtaggaggttttggatttttttggagagtgggagggggtagtagtagtttgtgtgtagaggattaggagtgtatagtgggaagggttgagttttgtattttgttgattgtggggataggttggattttgatatgggtgttataggttgtaaagggttggtatagagaggtgggaggtggttgggtgtattaagggagaattttatttttgttgttattttgttagaaaatttttggaaaggatttgagtagtagatgagttggggttttttagtttttttatatgtggttgtaaggggagtagatgtttaagtgtggttgtttgaagggtatgttttggtaatggtaggggtttggaatgtggtataaggtttatttttttttattttagtttttagttttttaggtagttatttttatagatgaatgtatatgttgggttttggtaaggttagggagggtatatattttttttttggttgatgtttaagtataggttggagttattggtggggagggattggtggattggggtttgggagagtggtagggggtaggttgggtgttagtgggggtataagtattaggttgttggttgaaattgggtttaaaaggttttggaggttagaggggaggggaggaaggatatagttttggggattttgtagggttgtgtggaaggtggtatatgtgttagagtttaggttgggttgtttaggggggtagatgtttagggttgaggttgtggagatagtatttggtgtttgttatttggtagttgtgagttatattatttgtaggtgagtttttagggtttgttagattttaagttttgtttttgttgtttttggtttggtttgaatgtttggtatggattttttatgtttttagaggttgttaatgtattttgtttggttgtgattttgagtaatttagtgtagaggattgtgttagtttttagaggggtagataaggagggttttattggggtggtggtggaggttttaggaagtttagtttttttttttatttatatttgtggttgttaaatttggggtttatgttattgttgtttttgttttttgttttaaagagatggtatttagggagtttagggtatattttggtggggtttgaaattttttttgaagtttttgaagatatatttagagaggttaatgaagggaaattgaggtttagaggttttagttgtggtggtggagagttgaggattggagggatttgttgtgggttttataggatttgattatggggtatttttgttttttgggttggggtttttgtttgttttatttatgtgtggatatatgtgtatgtatgtgtatatgtatatatatgtatatgtgaatgtgtgtatgtatgtgtgtatagatgtgtgtatgtatgtgtgtatatatgtgtatgtgtgtatataggtgtatatgtgtaggtatgtatgtatgtatgtgtgtatgtatgtatgtgtgtgtgtgtgtatgtgtgtataaatgtgtatgtgtgtgtgtgtgtgtatgtgtgtgtatgtgtgtatgtgtgtatgtgtgtatgtgtgtatatatgtatgtatgtgtgtatgtggatgtatatgtgtatgtatgtgtatagatgtgtgtatgagtgtgtgtgtatttgtgtatatatgtgtgtatatgtgtattatatgtgtatgtgaatgtgtatatatgggtatgtatgtgtgagtgtttaggtgtgtgtatgtatatgtgtgtatatgtgtgtataggtgtgtgtatgtatatgtgtggatgtgtgtatgtatgtggatgtatgtggatgtgtgtatatatgtgttttgtataggtgtgtgtatgtgtgtgtgtatgtgtgtatatatgtgttttgtataggtgtgtgtgtgtgtatgtgtgtgtatgtgagtgtgtatgtgtgtatttgtgtgtgtgtttgtgtgtgtatgtgtgtatgtgtgtgtgtgtgtatgttttggtaggagggaggggtttggtgtgaggtggtggggagaaggtaggggttaggttttgggaggatagttgagtttatattgttaggattttttaaattgttatttttagttttgggtatttaggtttttataggtttagagatatggttggagttttgtggttgaggagtatagttgagagtttaggtggggtttggaggtgttaaagttgagttttaagttaggttgagtgatttgggagaaattagagttttttttttggttttagtttttgtgtttataaaatggggatatttattaggttagttttaggggattttatttttttttttaggtttttttggttttttttgattttatgggttttttgttgttttttgtgggtttagatatggagtttgttttttttttgggagaggttttagttttgtgttagttttttgaggggaaatgagggatgtgttgggaagtttgtttggtttttgtttttttagtttgtttattgtttgggtatagttatgagttatggaaaattagttaaattttgtttttttgtttttgttatggggtttgggtgtatgggttttttagtttttagtttttttttttgttttgagggaattttttttttttgttttttttttagttttttggagattttttagatattttattgtattaggtagtttgtttttagagtttttgttgttttatagttggttttgggaatttgtttgagattttgatggttagttttgttgtgattggtttgttttgtgtttgtgttttttgttttggtggagggtttgattttttaataggagggtttgtagggaagttttagtttttggggagattttttgttttggggtaggagtttttgtagagtttttttttaggttaatgtgtgggttttggggggttttaagttggttatggttagatggttttttgtttttttggttttttttagtttttttttatagttttttgtaggtttagttggattattttaattttatttgtttaggtggattgtttattttggagtttgttagggttttggtggggtgttttagttttgatttattttttttgggaggtagtggttttggtaggggtattggtaaggaggggtagggtagtttttttttttttttattttattttgtttttttgtttttattttgttttttttgtttttttttattgtttttttttttttttttttttttgtttttgggtgtttattggtattgggagagggttttatagtggtagtaggtattggaggttttgttttgttttggaggaagggaaatattatttaggtaggtgagtgttgagttttttttttatttgggggttaagattttttgggtggtttttttaggttttgttgggttggtttgaggttggtaggttttgggttgtaattgtgggattttaaggtttaaaagaatgagggaggtttggtgttgttttagtaggggttttttggtgattttaggggttagtatgaagtttagttttatatgagggggaagttgagttaagttttgggttttgatttttattttgtagtgtggtttagggtttgtgggtttaggagggttttggggttggttgtggaaaggttattttataggtttggtagttgttatagttatagttttattataggtttttttgtttataggtgtgggagggtgtatgggtggtttttaggggggatgttaatgtaggggggatgtgtgttagtagatgttttttggagtatttgaggagttgtatgggggtgataggataggtttttattttaatttttttttgggtttgtgtttagatttaatttggttttgaagtggttttaggtttttggtttgttggtagtaaggattttaaagtggtagttttgggtagttagtttagtttttagggtaattggggaagtattgggtagggtggggttgtttatagggtgttggtttgggggtagagtttttatttttttatggtttttttagatttttgtaattagtagttgggtttagggggtttattttgttttgttggagttttagatagtttttttttagttagtattggttttaagtgagggttttttgggtgtgtgattgttttaggtttgttagaggtttttgttgtttagttgggttttttatttttagatgtattgagggttattttaggttgggtggtaagtagggtaggtatgtttatttttatttaatagatggggaaggtgaggttgggatgagatttgggtttttgttggagagttagggtggatgaagtggtgagagaggtagggttttagtttttttttgtagggtatatttttggttgtttttggatgggagattgtgtttgatgaggagggaggaggtaagtagaggtgggtgttgggggtaggtttgggtagggttgttttgtttttatttttatttgttgttttggtttggggggttttaggtaagtttgattttgttttgttattttggtggtagtttgtttttttggggggtttttttgggttgttgaggttgtgggtagggaggaagggtgtgagtagatttgggagttttagggttgtttgggttaaggtggtgtgggtggggggttggggtgggtggtttagaggaggaagttaaggtttaggggtagtgttgggggtgttatggtttttattttgggggtttttatttagtgttgttttagttaattttatttatggtttttaaggatattttttttttttttgttttgtttttttattttggttttagagggtttttgagaaatgtgggtagggtggagggaggaagtaatttagagttgttgtatttaattaattttatttatgttgttttgagtttagaatttaaaggaaggattggtttgggtaggaggttatagtgatgtttttaaaagtgaattttttaaagtttttgagggttaatggttaggattttttttttattttttttatgtagttttatggatgtttttgttttaaagtaggtttttggtagatttagaggtgtgggggtttgtagatttgttgatgaggagatattttattgtttgattaagttaagttttgtttgggatggggaggggggtagtggaagtagtgaagggagtggagtggagggggtattttttttgttagtagtatttattttttttttgtttggagttttttgtttatattttgttttttttgttttttgttttagggtttggttgtttttggtgagggatgggaatgtagtgttattatatatgtggaatattagtttttggtatggagaagataggtgggtgttggtgttgatgatttttttgtttttttttttaggtttatttgttatgtggtttttgtggtgttttgtgtttttgttggttttgagttaggttttgttttttgagtagagaggtttttgggattttattttggatgatgggttatttatgatgaatgatgaggaagttttgggtgttgatattttgggtgttttggatttggattttgttatatttatttatagtgttatgtgtttttttggttgttattgttatttgtgggtggtttagtgttttgatttgggtttgtttttgagtgatggggagtggggtatgtagggaggtttaggtgtagtttgagagttttttttgaaggggatatatgttggttttgtgggatggtggtgagtatgatgtaagtgtaggaggggtttagttgtttggttgtgagttgtgtagtttgtgtttatttgtggtggtatttttgtgtgtttgttagtgtttttgtgtgtgtgtttttggttttttttattagtggggttagttggttggatggttttaagtttatgttggtgatggtggtggggtttttaggttttgagtttatgttggtggtgggggtggggtttttaggttttaagtttatgttggtgatgggggtggggtttttaggtttgaagtttgtgtttaaagagattttttttgatattatgttgttggatttgtagaataatgatatttttgagttttgtaaggatgattttaagggtttttagtatttttatgtaaggagttgggaggaattagtaggtttatagtagagggtaggggtttgggtgggtgtatgtgtgtggatgtgtggggtatgagaggggtttggggatttgtggggttttagggtgaagtttggagttagttgtgatgggagtttttgggtttgtggtttatttatgtgggtttgagtaattatagttgtaggattggattgtttagtttggttttttttgtggttgaaaatgttttattatgtttattttttttagtaatagaggagaatggattttattgtagttagtgtgtgtgtgaggaaattgaggtttggagtggtaaggtagtggtggtattgttggggtttaggattgggtttgggtgttgttttttgttttgtattttgtttataagtatggattgaatttttttgaggtttagtgggttggggaggtataggaaggtaggagagaggggtgggtggggtggggagtttgtgtttttattttttttgtttattttgttttaggtttttgttttggtgaataataagatttttaagatttatgagaaggtttttagtttattgtggaagttgtagaagttttatatttttaagaattatttggtggagattttgtttaatttatttagttttttggtggagttttgtatttatgataattgtatttgtaaggtgtttaagggagtgtttagtgggttttggaatatgaattgtattggtgagttgagggttttttagaatattttagagttttgttttgaggtatggggaagggagattaagggatatttttagaggtttagtttaagaaagagtatggtgagaatggttaaaagaaaatttatggattttttggtaaattttttatgtaggtgattattatggttaaagagaagattgggttagaggggttgggtggtttttgggagttttatttttatttttggtatttttttttttttttttgttgtttttggagttagtagttttggggttagtagttttgaatagttaggagtttgtaattagtttggtaaattagtagaattgtttttaggagatgggagtagttggtaggtagtagggtttattatattggtttggaagtgataggatttagggttgtgtagggattattaggtttttgggttaatgaggttttttttttagagatgggtgggaatttattggagaatagtggttttgaatttggagtttttgatggtttgaagtttaattatttgtgtattttagaggttaagttgattggtatttttaaaggtaggaagtttattttttttgtatgtttgtttgttttatttttaatagtatagatggttagggtgggggttttggatgggtttgatttatttagggaaaggtttaatagtttttttttgttatttggggtagagttagggtttttgtttttagtatttgtatttttttttgtgttttttttttttggtagatttttttgagattttgaatgaattttatttagattataataaaatttaggttattgaattggaggatttgttttgttattttaagttgtataggtgaggttagtagggtattgtttaagggtgatgttagagttttttagtgttgtgtggttttttgtgtttagttttttatttttatttttagtttttgagtttgtgttatttttttgtttataggttgggtttaggttataattagattaggatgattgagaatgggagtttgagttttttgtttattttttgggagttttatttggataataataagttggttagggtgtttttagggtttttagattttaagtttttttaggtgagagttgggtatgtatagttaggttttttaaggttgggttgggggaggtgtgtgtgtttttgggtagttttttagttttttggtttttttttttgattggttttgggtatttgtaagggagtggttttgatgtttttagttggtgttgaggaggtagggagtaggggttttatggtggatattgagtaaggtagtttggtagtttttggatttgagggtttttaggtgggttggatattagaaagatgtggtagagtttagggagttgagaaattgtgggtgtgggagtgtatagatttgtgttaagatagtgattgtttagggtaggaagtaggttgatgagggggagtagggttttgtttgggattttattgggagtttttatttttggtttggtttgtaattaggtgggtgattttggttttgtttagttttgttttatttataagtgtttggagtatttttatttgtattagttgtgagttagtattgtgtaggttatgtttatgttgggttgagtgtgttttttagtggttattgttatgtttattagtattgggtttttagtttaatttagtaggtgttttgtttgtttatttttgttttttttagagatagtaagatggtggttttagagagttggaggggttgttagagggtgagtttttttgttgattggaagaaagaggagggtattttaagggttttttttttttttatgttttatggagtgtgagggtgtttttttgaggtttaggttattttttttttattttatattattaaatatatttttattttagttttgtttttatatgtttttaatttgatttatttgagatttttatttttgtttttggttatatttagtgttttaattttggttgatatttatataaataatatgtttatgttttggtttgttttttttaataatggggagtttttggtgtggtttttgaagtagggtgtagaggtaatagtaaaatgttttttggaggtagtgggtttggtgtggagggagggaggtttgttgtgatttggtttttttgtttttaggtggtttatttgtattttaataatattattaaagtgggtgttaatgatttttgttttatgggttttggggtgaagtgggtttattataatggtattagtttttttaataattttgtgttttattgggaggtgtagttggttattttttgttgtgttattgattgtttggttatttagtttggtaattataaaaagtagaggtagttgtagttattgtggggttttagtgggggtttttggggaatatagttagatattttgatggggaggtagagttaggaagttaagttagggtttagttgtgtttaatttagttttttattttgggtttttgattttagtttgatgttttattattgtttttttttggtttttaagggtgtaggtgggtgtaaggtttggtttttattatatgtttttttggttttagagttgtttttgtttttttattatagttatttagaggtattttatgaagttttttttttgtttatttttaaatttaagtgtttaaggttttagttttaggagaatagtttttgggttagtagttaggaggtggtttataagaatggggatagtgggttttgttagggttgttgtatttgtttagatatatatgttttgttttttttttttatgtatttttagttttttaattttttttgattttgtggttttttttagtttttttgtaagtttatggtttgttttttttagatttttgttttattggttttttgattagtttttttttttgttttttttttttttgttttttttttttttttttttttttttttttttttttttttgtgtgtgtgtgtgtgtgtgtgtgtgtgtgtgtgtgtgtgtgtgttttgtgtttttttagattttttttgtttttgagtttggtggtttgttttttttatttttttgaatttggttttgtttgttttttttattttatattttttggttttttgttttgagttgggattgttttttgtttgtttggtttgtatttagtttttgtttataaaattttagggatagtagtttttttagtttgttttgtttaggttttgtttttaaatttgtattgttttggaggaggttgggaggtggaggtttagtattttgtgtagatgatattattaattgttagagttttagatattggtttttttagaagttttttatttttattggtttattggtggttaggtttttttttatttttttggtttagtgtaaggaggggttgtttttgaggttggtggttgtttttttattaaagaaatattgtgtaatgtggttttgtgtgttgtttttgtggtggtttggtttttttgtgttttttttggtttttgggttttttgtttttagaagaggggttttgttatttttagaagaggggttttgttatttttaggtttgggttagtttggattagggaggtttttttttttttttagatatttttatggttttagttgttttgagatgtggtttta

SEQ ID NO: 42 - DNA, 2706 bp, Homo sapiens
ggaaagttcgtatattgggataagtatgatttgagttgtttgggataaggataggggtataagagaaggaaatgggtaaagagagaagtttgtatttagttaagggtgtagagatgttatatatgattgttttttagggaatcgggtttttagtttatattttagttgtttaattattttttttttgaattgattgttttttttttggaattttaggtttgattttattttttggtttttttagtttacgatttttttgattcgatttttttttttagaatttagtcgtttgaatttttagtttgtggtttttttttaggttttagttttttttgtttttgattgaaatagtagtattttttaagttttgggggttttttcgggttttagtttcgatttagaattcgttcgttgtttgttacgttgttattgtcgttttttttataaagggatttgagcgttcgggtttaggggtttcgtatagtaggtgaggtttttttgttttatttttttgggttgttcgtgtttcgtgttttggattatcgtttagtagtgttttgttttttgtttgggtttcggttttttttgtatttgttgtttggattttcggtttgtttgggtttgggttttggtgggtttggttttggtttttttttttgtttttgattttttatttgttagttttattgtttttgttatatattttttgtttttgttatgatttttttttgttttttttttgtttttttttgtttttttttgtttattttggggtttttttgattgtattttgtttttttttttgtcgatttttttttcgggggtcggggggtgtttttttttagggcgggaggtttgtttttcgtcgcgtgtttcgtttcgtttattgtttttttttttttttttttttttttgtaggttttttttatgatattatttgaacgttttttttttttaagggtgtgtggtattattttatattttttttttttggggttgttgttggttttgttgtttggggtttaggtgaggtagtaggagaatgggggttgttggggtggtttagttaaattttgagttttagagttttttttaattttgtttttttttaggggttttttggtgttggttttatatttttagttgtttagattgttcgttagtattttaagatgtattttgtttatagtatttttaaatttgttgtttattttattggtaaatatttatttgattttttagatatgtttttattagttttttttttatttttgttttaggaatttaagtatttattttttttttttaattttttttacgttaaaaaaaatagagggagtttatttttatgtttttttttgttattttttaggaatttagttgtttagtgtttatttttttagggattgagatttttgatttagatttttgattttttatttttattttttatggttttttttaggagattttagtaagtagaatttattgttttggagagtaaatacggatcgtgtttttttttaggatggtttttttttgagtaataatttttttttggtttttattagtggtatttatttcgtttatttttaggtggttttttttgggaaagtttatttttttaaggttattttttttttattttatttggtttatgaggtttagtttttttttttttagtattttttttatgtgtttttttttagtttttagaagatggtgtatttagggttgtaggaattttggttgtattcgatgtattacggggttgcgttttagtttatttagggagattagttatttatttatatagatggtattttttatttagtttttagttttagtattgttttttttggagttttcgttttgtagaatttggaaaaatttagaaagaaaaaataattgattttaagattttttttttattttgtttttattttgattattttaggggtcgttattattttttttttggttattttaatagtttaagttttttttgattaagttatcggagtttttaaagaaggaattttaggtattttaggggattatatttttttgaattatttttgatgtttgtttggttgaggattttaagtttgtttaggaatttttagtttaaagttgttggtttgttttattagttaggtggggtttagatttatatatagaggaagagtaggtatatggaggagtttgggggatgattagaggtagggaggggattatttatgaaggtaaaaaaattaaattatttatttatggaggatggagagaggggaataatagaagaatatttaaggagaaatagagataggtttaagagatgaagagtgagagggtatgcgtataaggttgattaagagagaaagaagtaggtatgagggattatagggttttagaaggtagggaaaggttttgaaagttagttgtcgattagagttttatacggaggtatttgtattttcgatgaagtttaataaattttttttttttgaaatgttgtttgtttgtgtgtgtgtgtttgggagtgagaattttttagtttatttaaggaatggagggagggatagagggtttaaagggagtaagagttgtggggagaataaaaggataagggtttagagagttttagggatatgtgatggatttattaggtgaggtcgttagattgttgtaggggaagtaaaggagaag

SEQ ID NO: 43 - DNA, 2706 bp, Homo sapiens
ggaaagtttgtatattgggataagtatgatttgagttgtttgggataaggataggggtataagagaaggaaatgggtaaagagagaagtttgtatttagttaagggtgtagagatgttatatatgattgttttttagggaattgggtttttagtttatattttagttgtttaattattttttttttgaattgattgttttttttttggaattttaggtttgattttattttttggtttttttagtttatgatttttttgatttgatttttttttttagaatttagttgtttgaatttttagtttgtggtttttttttaggttttagttttttttgtttttgattgaaatagtagtattttttaagttttgggggtttttttgggttttagttttgatttagaatttgtttgttgtttgttatgttgttattgttgttttttttataaagggatttgagtgtttgggtttaggggttttgtatagtaggtgaggtttttttgttttatttttttgggttgtttgtgttttgtgttttggattattgtttagtagtgttttgttttttgtttgggttttggttttttttgtatttgttgtttggatttttggtttgtttgggtttgggttttggtgggtttggttttggtttttttttttgtttttgattttttatttgttagttttattgtttttgttatatattttttgtttttgttatgatttttttttgttttttttttgtttttttttgtttttttttgtttattttggggtttttttgattgtattttgtttttttttttgttgattttttttttgggggttggggggtgtttttttttagggtgggaggtttgttttttgttgtgtgttttgttttgtttattgtttttttttttttttttttttttttgtaggttttttttatgatattatttgaatgttttttttttttaagggtgtgtggtattattttatattttttttttttggggttgttgttggttttgttgtttggggtttaggtgaggtagtaggagaatgggggttgttggggtggtttagttaaattttgagttttagagttttttttaattttgtttttttttaggggttttttggtgttggttttatatttttagttgtttagattgtttgttagtattttaagatgtattttgtttatagtatttttaaatttgttgtttattttattggtaaatatttatttgattttttagatatgtttttattagttttttttttatttttgttttaggaatttaagtatttattttttttttttaattttttttatgttaaaaaaaatagagggagtttatttttatgtttttttttgttattttttaggaatttagttgtttagtgtttatttttttagggattgagatttttgatttagatttttgattttttatttttattttttatggttttttttaggagattttagtaagtagaatttattgttttggagagtaaatatggattgtgtttttttttaggatggtttttttttgagtaataatttttttttggtttttattagtggtatttattttgtttatttttaggtggttttttttgggaaagtttatttttttaaggttattttttttttattttatttggtttatgaggtttagtttttttttttttagtattttttttatgtgtttttttttagtttttagaagatggtgtatttagggttgtaggaattttggttgtatttgatgtattatggggttgtgttttagtttatttagggagattagttatttatttatatagatggtattttttatttagtttttagttttagtattgttttttttggagtttttgttttgtagaatttggaaaaatttagaaagaaaaaataattgattttaagattttttttttattttgtttttattttgattattttaggggttgttattattttttttttggttattttaatagtttaagttttttttgattaagttattggagtttttaaagaaggaattttaggtattttaggggattatatttttttgaattatttttgatgtttgtttggttgaggattttaagtttgtttaggaatttttagtttaaagttgttggtttgttttattagttaggtggggtttagatttatatatagaggaagagtaggtatatggaggagtttgggggatgattagaggtagggaggggattatttatgaaggtaaaaaaattaaattatttatttatggaggatggagagaggggaataatagaagaatatttaaggagaaatagagataggtttaagagatgaagagtgagagggtatgtgtataaggttgattaagagagaaagaagtaggtatgagggattatagggttttagaaggtagggaaaggttttgaaagttagttgttgattagagttttatatggaggtatttgtatttttgatgaagtttaataaattttttttttttgaaatgttgtttgtttgtgtgtgtgtgtttgggagtgagaattttttagtttatttaaggaatggagggagggatagagggtttaaagggagtaagagttgtggggagaataaaaggataagggtttagagagttttagggatatgtgatggatttattaggtgaggttgttagattgttgtaggggaagtaaaggagaag

SEQ ID NO: 44 - DNA, 57096 bp, Homo sapiens
gaggaattttttagattaagtgttgtttattttttattttaatggtggttttagtttgggtttatattatacgttttaaggagttttggaaaaaataaaggtttttggtttttttttgggatagcgtgattttttatgtttgagtaggtttatgaatttgtattttttagacgttttttaggattcgtgtttatttggattagggaattattatattatattatttcgcgggaagatttagggggaagtattttagttatttttttgtgttttatagtattggagggtgttttgagtgggttgtgattaatttttaaattaattatacgtttttttttaatttttattgtttattttttgttttttagatatttattgtaggttggagatttttggaagttaatagtatcgttgtagaatttatagggtttagttttcggtggattataaaatttaaattatgtggttggggaaagttgaaatttaagggaagggtttgaggaggggttgattttataataaaatcggtttgtatttattaagtgttaattatgcgttaggttttcgttgacgttttaattttatgtgaaaagtattattattttttatttatagatgggaaaatagagatttagagcgcgaaaattatttttttaaggcgtatagattttaaagtttacgttattaggtataattttaaggttgcggcgtttttttatttgttttttagtttttaaatcgttgttatgtttagggtttgatatttcggcgttttttgggacgtgtttagatgtaggggcgtaaacgttaaaggagattaggttgtaggaagagaagggtagagcgtcggatagttcggttcgtttttcgttttttggggtcgcggttggggaattataaggtttagtaggtagttgtagggggcggaggcggaggagggattagcgcgggtgggagtgagagagcgagttttcgcgtttcgtcggcgtatagcgttcggagcgtttttgcggttataggcgcggcgttttcggcggcgggcggtagttagcgggagtcgggacgtcggtgtagtcgtagcgcgcggaggaattcgggtgtgtcgggagttgggcggttacgttcggacgggatcgagatttttcgtagcgtattgcggcgatttcgtttttttcggtcgcgagcgcgtcgttgtttgaaaagtcgcggaatttaaggattttttttcggttcgagttcggggcgtttcgtagggcgtacggtattcgtgttgtagtcgggtacgtcgcggcgtcggggttttcgtagggcgatggagttcggtttgtaaggaaagtgaggcgtcgtcgttgcgttttggaggaggggggtataaggtttggagatttcgggtggcggacgggagtttttttttcgtttcgttttcggggtattagtttcggttttattgttttcgttcgggttggaggcgtcgagtatcgagcgtcgtcgggagtcgagcgtcggtcgcggagtttttgcgatttcgttaggattcgaatagagttcgggggcggcgggtcggagtcggggacgcgggtatacgttcgttcgtataagttacggcggattttttcgaggcggaatttttacgtcgagcgaggtaagagtcgcggcgttttcggatttggggcgggtttggcgtttcgagcggttttcggcgtcggagtttttcggttgcgcgttttgttcgtcgtagtttagtcggggtcggcgttttttttcgttcgtcgttcgttttttttattttttggttttttttcgggcgattcgcgttttttgggttttttttttttttttttcgttcgcgttttttgcgttttttttttgcgttcgtttcgtcgtttttttcgtcgtttaattttttttttaattcgcgttcgggagttggcgaggcggcggcggttttttagtgagtttcgggagggataggttcggggcgaaggcggcgaggttcgcggttttttggattggggaggagggcgggagtgggcggcgaggtgggatgcgttgtgtgtgttatgtgtgtgtgttgtattttattttatgtttttttggtttttttttggggatttatttttaatttagtaggtagttttgggtttaacgttaaaaattcggggtatttttaagtttttttttattttcgggaaagtttggggtgcgggttggggtcggatggggtgggagatgaattgcggaggacgtggagggttaggttagttttttttggaataggttttaaggaggtgtcgttattaaatggttgaatttgtttgagttgagagcgaaaaacgatttttttttttagaaggggtgattttatgatttggacggtttttgaaagggtcggaagtttggggaacgggaggataatttacggtcgttaagtcgaggtgtgggatgggggcggaaggatcgttcggttttaatttggtttttagaggtgggggaagggatgagggtttttgttcggtgtggtttattcggtagcgatgcgtatgtttttttggtttagatttttttgtatttcgttttttttatcgttatgtttggggttgggagaaaagtgaggttacgatttatgtttgcggaggaattttatggattttgtagatgggggtttatatagaatatatattttttatgaggtagttagatatttttttggtggtggtggggggggggtggggtgtgaagtttgttttttgttttgagtttagaagttattaatttttttgaaaaatattattacggtgttttttttttttagtatttttttatttttaatttttagatgtagtagtcgtatttggtttcgttttattttatacgggtatatcgtagtcgtattattaatttttttttttttttttttttttttttttaaattaaaatttagattttttagtttgttttgattatttttttttttaatatttttggagatttggagatgcggcgttgagattcgggggagaaaagaaagtttttttggatttcgagttatttaagattttattaagttattcgtcgtcgttggtgggtggcggcggttcgggtgttttttggattgcgtagtaaagaggtattttgggagatggggttaaggttttagggggtgttattcgcgaacggtttattcgttagattaggggggttttttggttgtgcgtttggttagaattggttttgacgatggaagtttttggaattaaagcgttgtttttttttttttgtgttatagttggagttgcgggagcgtttgttttgttcggagttcgcggttttttttcggttgtttcgcggtggcgttacgcgtttttttcggagtaagttcggtgcgtagggtcgggggcgtgggcggttgttgttagaggcgttttttgtgtgtttttaaggattgatttgggtcgtatttttcggaaattaaagtggggtgttttatcgtttaaataacggttataggtttgaaagcggggttggattttcgagttgtgtttggtaatagtttttgaggtaggaaagcgttttgtggtttaaagttgtcgggagggtggggagagtcggtgttttattcgtttttttttagttttttttaaattgaaaatatttttttggtttttttttttgggcggtagttttggaggttgtaatgaaatcgtattttttttagacgtggtaattaaggtgattgtttttttcgtagatgtgttttattttttgtattttcggattagcgttttttttggaatattatttagttttgagattgtttagtagaaagtggttattttttttttttggttcgggttttcggttttttttttgaggtttgtttaaaagcgaagtagtagggtttcgtgggacgcgttttggtttgggtaattatttttacgttcgggttatttatttttttttcggtgatcgaggtttagtagtttttgttattgtcggtcgtttttgtcgatggtttgtttttttaatgatttgtttatatattttatttttagtgggttaggagaagtttcggggttgtttcgatttttcgagtgtagggtgtttggggatcgggaggttgttggggtttgattttagttgggagggttatgaattgtattagtgacgagttgtttgaaatatttgttgtatttatttttagttatagttgagtgttagttttttaatgaggtttatttagattgagagttatttggattgcgtattttattgtttgtttttttaaatatgtttgtagaaatgtttattttcgaggtattttttttaatgggaatttaggttagagtgggtattatttgaataattttagggtgttttttttttttggtttttggttatggagggtgttagatagttttattaggtggttttttgatagtaagggaagtaaaggtttaggaagaaatggagaagcgttttttattttttaggggtagaggattagatatatcggtgtattttttaggttgggttagttttatttttggtggattttagagggtaagaaaattgaattgaatattgggtaggtagatttaagttttagagattaaggaaaatttatgggttttgtttttagtggtgtgttttttgtttttagtattgatttgaaataagatttttaaaatgagagatttgttggtatgaatttgggggtttagtagtcggtttttataaaggttttttttttgttttcgtttttaaagtgtttttcgttaaaatggttgttagttatagaatattttagtaaagtttgagtttgttgttgttggaggaaaaggagttagaattgatttaaatgttttattttgaaagggttttatattatttgatagtttaatttttttttgggaaatttgtgttttatatttgttttttttagagttttgtaaaaggtttgaacgtattagggattagtgggagtttagatgtagagttttagagaagattttggtgtttttagagaggatgaaatgttagatttgggttaggatatttgtttttttttttaaggttgtatttattttaaatagaaatttttttttcgttattatttattttttttttgtaatgaaagaaattatgtttagggtttttttttttatttaatagtttttatatggatgaattattttaagaatttggtggggttttatttatagtatattttgtttttaagagtaaggttttttagattatgtgtagtagttcgtgttttatttgttgttttttttttttttttttttttttgagatagtttcgttttgtcgtttaggttggagtgttgtggcgttattttaggttattgtaattttcgtttttcggttgaagcgatttttttgttttagtttttttagtagttgggattgtaagtatgcgttattatgttcggttaattttttgtgtttttaatagagatggtgttttattatgttggttaggttgggtttgaatttttgattttaagtaattcgttggtttcggttttttaaaatgttgggattataggtgtgagttattgtgtttgattatttattgttaattttttatatgttttttatttttaaggatatttagatattttttttttttaaagagatttaaaaaattagtatttttattggattaattaaaatttagtaagttgagttgagtaattttttttatatgtttattaagtatttgttttttgtttttttaatatgtgagtagagaatggttattttggggaagaaataagttttatttttatttgaagggattaatgttttggtgttatttttttaattttgaagaattaagttgtttagaaatttttttagggttttttggattagagtttggttggttaataaggggtattatttaattgtttttttttgatatttttagtttttttttttggaggagtatttttgttagtttttttttattagttttttttttttttttatttatttatttatttatttagttaataaatatgttggtattttttgtgtatatgttaggtgtcgagggtgttagtaaaggttagggaggtatagattttgttttgaaggagtttgtagtttcgtggggagagaagagaatgaagaatataaataataattatataatatgatttaagtgttatgtgagaggggttagtaatgtggtttgtaaatttggaggaatgaaattttttagttagaaggtttaagaaagttttatggaagaaatagttttttaaggtggggtttagagaaaagggaagggttggtttgttgtagaataaggaatggtatgaagaaagttttgtatagaggtatggatgttgtttcgagttgtggcgttttatagaaatagaatatgagtagttggttatagtggtttatgtttgtaattttagtattttgggaggttaaggtaggcggattgtttgagtttatgagatggagatgagtttggataatatggtgagattttgtgtttattaaaaaatatataaattagatgagtatgttcgtgtttattggtagtttcggttatttaggaggttgaggtgggaggattatttgagtttaggaggtagaggttgtaataagttgtgattgtattattgtattttagtttgggggatagaggaagattttgtttaaaaaaaaaaaaaaaaaaaaagttaggtatagtggtttatgtttgtaattttagttttttgggaggttaaggtaggtggattatttgaggttaggagtttaagattagtttggttaatatggtgaaattttatttttattaaaaataaaaaaattagtcgggtttggtggtttatgtttgtaattttagttatttgggaggtaggagaatcgtttgaattcgggaggcggtggttgagttaagattgcgttattgtaattttagtttgagtgatagagtaagattttattttaaagaaaaaaagaaaggaagaaagaaatataatattataatatgagttatgtatatgtttagattttttagaagttatattggaaattaagttaaaagaaagaaataggtaaaaaaaatttttttttttgagacggagttttattttgttgttaggttggagtgtagtggcgtaatttcggtttattgtaatttttgtttttcgggtttaagtaatttttttgttttagttttttgagtagttgggattataggcgcgcgttattgtacgtagttaatttttgtatttttagtagagacggggttttattatgttggttaggatggtgtcgattttttgatttcgtgatttgtttattttagttttttaaagtgttgggattataggcgtgagttatcgcgtttggttaatatttgttttttaattaatttgtttgtttagattttatttaatgtaattatatttttaaaatattattatttgaatatgtaattaatatagaaattattgatgagatattttatattttttttataataagtttttaagatgcggtgtatattttttatttatagtatattcgttagtattagttatattttaagtgtgtagtggttattgtgtgggttataggtttagaatataagatatgaagatggagagtgagaaatgtttttggaaaggttggaagtttttgtttttttgttgttaattattaaattttttgagagtgttattaaggagtgatttaaagtattatataaagagaattataaatattttaatattatatttgaaatttaaatgtataattttttatatttggttggtattttagagaggagagaatgggtatagttatttatattatttatttgagttttataattatttgtgatgtggttttttttaggtgggaaatcgaggtttagaacggttaagtgattattttagggtggtaagattataagtggaagggtgtgaatttatattgtttttagcggataagaataaaaagatttaggttgggtgtggtggtttatgtttgtaattttagtattttgggaggttattgtaggtggattttttgagtttaggagtttattattagtatgggtaatatggtgagattttatttttattaaatatatagaaaattagtttagtttttcgggaggttgaggtgggaggattatttgagtttgggggatggaggttgtagtgagttgagatcgtgttattgtattttagtttgggtgatagagtaatattttgttttagaaagaataaaaagatttggttatgaattcgttagttagttttttttatataatttttggataaggagatttgatatttataggttttttttttagaagtgggagagttttaaggttacgtggttcgtttagtttttgttattttattagatattgtttattttgtatgttggattagtattttagtgagaagatagtaggtatttttatttatgtagtttatttagtttttataattatttgtgatggaggtaaggtaagtattttagttttttttgatgagtgggaaattgagatgtgttttttttttgttttttatcgaggatttttgtatgtaggtatgaattttaggagtttagttgatattggagagacggggcggggggaattagttgtagggttttggaggaagttgttgtgtatatttgtaaggttgtaggttatatttatttgttaagtagtgaaggaaggaagttgtttttaagggattggaaaaatttattaattagtagaatgagaaattgaggtgaagtaggaggtggtagggttttagatagtatgttggattagtggtttgtgttattgtgttttttgtaggcgggtggtatggggtgtatgttgattttttattttaggagttggtgttaggaggttaggtttttttaatatttttgttttatagatgttaaatttgagggttagaggggtaggagaggaagagattttttgtattttttttgggaaagaataagagggaagttggtagatgaatttgaagtgtattgattagggagttgagagagggcggtttgtagttagtttatatttgggaggaggcggtaggtttttttggggatagagtggttaagtcgaagtaagtttaattattttaatatgatattatttttttttattggaatttgagaatttgtttagtattttgatatttagtaagggatttgggtttttttggttaggtgtgcgtttttgggtgataggtttgtattaggtgtattttcgggatgtagtaagttgtggaatatgggtttaggggtattttttggtaagtattgtttttattttagttttgggaatgtgttttatgtagtgttttagatggtttatttgtggtttgtttttaagggttttttttttagttagttagttttgagatagagttttatttcgttatttaggttggagtgtagtgatgtaatttcggtttattgtaatttttattttttaaatttaagtaatttttatgcgttagttttttgagtagttgggattataggcgtgtattattatatttagttaatttttgtatttttagtagacgaggaattttattatgttggttagtttggttttaattttttattttaggtgatattttcgttttagttttttaaagtttcgggattgtaggtatgagttaatatgttttggtataagggtttatttttgattaatggaattgtaaattaagttttttttgttattagagttattttggatttatttttatttatttggtttggataaattgagtttgtattagatggagttaggtttgattaattttttatttatttttttttattttgttttttaatatttaaaaattttgaggtattattatatgttagttatatttttttgagtaaagtatttaatttttttgagttttagtttttttattgtataaaaggaataataaaatttattttttataagtttatagtgaggaatgaattaattttttattatagttttaaattaattttatttagggtatttttggtatatagtgggtgtttagtatttattttatttttttttttttgatttttttcgtaaaagtagaaaaatgaaagagaaatgttgattttttttttgatttgaaattattaaaatattttagtaagttttgggagggagttagtggtgtggtatgtgtatttcgttggttaagtatatgtgaacgaagttaagaatttaggggtttttttgttagttagtattgatttatttgcgaggggttttgtttggttcgggggaggtagggttgaagtattatattagggtatgtttcggggaagtagattttttgaataatttggatggttttttggagtatttaggatagaagttatttggaaaatagagatggttatttttacgtagttttgatagtgtttagaaagttttgttatttggtaaatgttaatagttatgattcgttttttaagattttggggagttttaagttttattttattagatttgagaagggtaaagggttgtagattttgtttttttaattggggttagtgtgagttatttttgatttagtgtttgtaatagattttgattttgtagtgggattttttaggtttttttgtttttcgtaatttttggatttatattcgttagatattatttgttattttttagtattagggagaattggattttttttggttttatatttttaggttttttgtaagtagttggtgagggtttttttttttttgtaagggaggttggtagaattatggatgtgattcgtataattttagagataaaaagaaagtatttaggaggttatttattttagttgttttattgtataggtcggggagttgagtatggagtttagtagttattaattagttatttttgtatttggtttttatttattggtttttagtttgtttcgtgattttttattgttttttattttttattagagggattggttggttttagatggagtggtttttttaaaattttttttttaaattttttgagatagagttttattttgttatttaggttgtagtgtagtgttgcgatttcggtttattgtaattttcgttttttgagtttaagtaatttttttgttttagttttttgagtagttgggattataggtgtgtattattatgtttagttaatttttgtatttttagtagagatgggattttattatattggttaggttggttttgaatttttgattttaaatgatttgtttattttagtttttcgaagtgttgggattgtaggtgtgagttatcgtatttggtttgggtagagtgaagttttatgttggggagttattagtatgtttaaattttttgtaattgtagtatattttgtaaaattgttttttataaaagggtagaattatttgggatttttatgagattatttattttgtagtatatattattttgaagtttatattttggaaaattttatgatggtatttttaggtttgtacgtaatttgtatttaaaatatagttgtagaattgaattaaagtatttttttgtttaattaagatttataatttttttttttgagatagaatttcgttttgttatttaggttggagtgtagtggtgtaattttagtttattgtatttttcgttttttggatttaagcgatttttttgttttagttttcgaagtaattgggattataggtgcgcgttattacgtttgggtaatttttgtatttttagtagagacggggtttcgttatggttaggttggttttaaatttttggttttaagtgattttttcgttttagttttttaaagtgttgggattatagggtgtattattatatttagttaggatttatgatttaatttattgttggggtagttttataatttttttttggacgttttagtaagtttatattttaagtagttattatatggtatattttattttttgttttttttttttttttttttatttagatttttttaatttttggggttttttttttttttttagggttagtttgaaaaggaggatcgagtttattgtggagtatttatggagatgtggagttttgttattaatttttaattgtagaattgggatgtggagttggaagtgtttttttttttgggttgtgttggttatagttatattttgtatcgttaggtcgttttcgattttgtttgaataaggtaaggtgttggttgggggtagtttggatttttgggttttgggaataggatgggttgggagggaggtgatatggttgtaggtgatgtggttaatagggaaggtttttttttaagtggagtaaagaattttttttttgtaggagaaatttttaagatatttgggttggttttggtttggttataaatataattgattttattagaggttggggttatgaaggttggtgatatttatttatttgagatgatatgtttgtggggggtaatttatgtttttttttttttgaggaaagaatatttgatgaggattttagtgttatattttaatataggtgatgtataaaatgtagttggtggtgtaatggggagagaatgattttagaatttgcgtgtagaatttgggttagattataggggatgttgtaggaggtgagagtttgttaaagatttttgatttttagaaaattgttttaaggttatattttcgttaggtatagtgggttatatatgtaattttagtattttgggaggttaaggtaagaggattatttgaggttaggagtttaagattagtttaggtaatatagcgagattttatttttataaaaaaaaaggaaattaattgggtgtgatggtgtacgttgttagttttagttatttgttatttaggaggttgagataggaagattgtatgattttaagagttgaggttgtagtgaattatgattgtattattgcgttttagtttgggtgaaaaaaaggtatattttttataagggttagtagttatggttttacgtttgtatttttttatttttaattgtgttttataggttttgtttgggggtttgttaagcgatttgttttggataggtattgtttgaggggttttgaagtgattgagatttaggaagtataaaggggtatggagatttatggcgtgttggaaatttagagttattatcggtaataggaaggatttattttattatttttgggatttgtgtgagttgtggaaaggttttttgggagattataggtatagaatatcggtggttttcgcgggattttgaaaattaatgtatgagtatttttgttgttagaggatagtgtggttcgtgatttagtggttggttatatagagaaggttgatatatagtgggtgaaaggttggaggtgcgcgtgatggggtggttgtgtgtaaaaggttgttatttagttggttagggattcgtttgaatgatgagtgatgggtgagaatatgtgttttttggatggagttggggatgaatagggaaagttgtgtgagattttatagaaggtgtagtggttagagtaggtatatttatgttgttgttagtaatagaatcgaaggtaaggtttgagttggagtacggtggggatttaaagtgggagagattgtgtttgtttatagggagtttatggttaggagggatgggtaagtatagggataagtaatataagatagattgtgtttaaattatttagtgaagttataattagaggtggtgggaatgtagaggaagaggggagtagagagtatttgagatgggtttgagtttagaaggggaaaaatgaagggttttttaggttgaatagtatgagtgtttagagatagtatgtatatggtttatggagaacggtttgtttggtgagtaggtagttttgggaaataatatttggaaaaattggattgagttagtatatggaaggtttaatgttttgttaagaaaattatatttagggtcgggtacggtggtttacgtttgtaattttagtattttgggaggttgaggcgggtggattataaggttaggagttcgagattattttgtttaatacggtgaaattttatttttattaaaaatataaaaaaattagtcgggcgtagtggtaggcgtttgtagttttagttattttagttttagtttttagttgaggtaggagaatggcgtgaattcgggaggtagagtatgtagtgagttgagatcgcgttattgtattttagtttgggtaatagagtgagatttcgttttaaaaaagaaaaagaaaattatatttaggttaggcgtggattatgttggtaattttaatattttgggaagtcgaggtaggaggattgtttgagttaagaagtttgagattagtttgggtaatatgatgagattttgtgtttataaaaaatagaaaaattagttaggtgtggtggtatatgtttgtagttttaattattagggaggttgaggtgggaggattatttgaatttgggaggtagaggttgtagtgagttatgattatatcgttttattttagtttgggtgatagagtgaaattttgtttaaaaaaaaaaaaaaaaaaaaagtaagaaaagaaaattagatttaaatgggtagatgttgggaaatttgaaaagtttttagtaagtagtgatattattagtttttagaaagttaatttggtagtttagtgtggatggttgggaggaaagagtgaggtgtatttgtgtttgtattttgttttgttatttgatagttgtattatttattttaataaattatttaaatattatacgttatagtttgtttatttgtaaaatagggataaataataaagggttaagtggggtaatttagatgaagtatttttatgtaaggtgttaatagttgttattgttgttattgttgttgttagaaggatgaggtcgtaggttattttgagtgtttggttagaggaagtgtaggtattgattaggatggggattgggagatgatagaggaaggaaaaagtagtaaagatattatagtaatagtatttgtgggtttaagtaggttgggtgttaattgtgggtaattggagattgagatgagagtgtaaagggagtgagttagagtgggaggtttgaggggagtttagatttgaattcgttaattgtagatagcgataaaggagtggaagagtagtaaggagttagttgaggtttgagaatgtgaatttataatggagtttaaagtatttttttttttttgtagtttaagaagggagaagtggatttcgggtttggttgtttgtgagttagttcgacgggatgagtataaggaattttagggttagggtgggggtgttagtagaggagggggttttacggaagttgttggggtagggtggaggttggaatttgggggttgaagattttgatgaggataaagtatcggttttgtgaatagaagaaagggagtaagagaggtggatggggtttttaggagttatgtatttaggaagattgatattaaatgattattttttaaaaattaatttaatttttaaaggtatattggtttttatttataattttagtattgtgggaggtagaggtaggaggattatttgagtttaggagtttaagattagttgggtttgtttgtttgttggttggttggttttaagagatagagttttattttgttgtttaggttggaatgtagtggtatgattttggtttattgtaatttttgttttttaggtttaagcgatttttttgttttagttttttaagtagttggaattataggtgtttattattatgtttggttaatttttatatttttagtagagatgggttttattaggttggttttgaatttttgattttaagtgatttgtttatttcggttttttaaagtgttgggattataggtgtgagttattatatttggttaaattaatttaatttaggtataatagtttgggttattgtaataagattgttgtgaatttttatgtgtaagtttgggtgggtatatattttttttggattgttttggttttgattttggttttatattttattgattgttggtttttggggaagtttttttttgtgtttttttataaaatatattgataatgaatgtgtgtttataaggttattgtgaatattaaataagtatgtttgtagagtttataggatattgtttggttcgtaggttatgagtagttaatggtcgttgtgggtttttttttttgggtttttaggggagacggtatatggcgaggagtatgttgttttatgggatatagtaacggaaagtttttgtatttggagaataagttttaggtttttgtttggtggagtaagttttcgttttagtgtgagtgtggtgtttttatatagtttgttttttatgagttttgtgatagaatagagaattgttgtgtttaggatattttaaggggagatttggttttatgttttgtaagttgtaaggaattttgtaagtgtaaagtatattgtatagttttgggtttgttgattattaaataataatgttgatattttttaattaattaattaatttatttgagacggagttttattttgtcgcgaggttggagtgtagtggcgtgattttggtttattgtaatttttattttttgggtttaagcgatttttttgttttagttttttaagtagttgggattataggcgcgtgttattacgtttagttagtttttttgtatatttagtagagacggggttttattatgttggttaggatggtttcggttttttgattttatgatttgtttatttcggttttttaaagtgttgggattataggtgttagttattatgtttggttaatgttgttgttgttttaaaaaaaaaattatagggcgagtatagtggtttatatttgtaattttagtattataggaggtcgatgtaggaggattgtacgagttcgggagttttagattagtttgggtaatatagtaagattttatttttaaaaattttaaaaattagttgggtaacgtggtatatatcggtagttttagttatttaggaggttgagatgggagaattgtttgagagttgtttgagtttaggagttgaggttatagtgagttataattaagttattgtattttagtttgggtgttagaaggagattttgtttttaaaaaaaagaagaaatatattataatttatgtattaagggttttgtttaaaaggtgagagtaaattatttaaaattttgtttatattgagttttttttatttaaaaggttttgttgtgattttaagtgtgtgtgtgtgtgtgtgtgtgtgtgtgtgtgtgtgtgtgtgtgtttgtgtgtttgtgtgtttgtcgggagtttttttttattgagcgtagtattaacgttttttagtttgtaagtgtttttgagggattggggagggtttggagtttttggttgtttttggaaagttgatttaataagggttttaggaaaattagttttttttttttttttttttttttttttttttttggtttgggattttatagagttttagtttgttttagattaggttttgagagtggtgagggagttgtttggaaagattgaagtcggttttagatgataagttttaatattttgagtttgtagagggtgtatttgtttgttttttgtaataagttaagttttggtgggtaaagttagtgagtgagtataatattgtttgtaaggttattgttggtagttggggtgggggttttgttttttttttagtagtattgtgggttaaatattttagtgtttagaaaatttgtagtttagaagtgatttaatgggttgagttttatagttttttttatttatttagatttgaaggagtttggtggtttgttagaggggggagaggttgtatttaatggaaaaattatatatttttattttggttttaagttttttggatgttttgtgtgtattataaagcggggttttgtttttgtgttttgtagaaatttgtatttatgggggagaggttgtgcgtggtgttagagttattgtttagttttagattatagggtttttgtaggttttttatttttgggcgtttttagttgtttttggtttaaaggggtgtgcgttttagtttggttgtagggagagttttaaataggtattataggtttggtagtgggatattttttgttttattattagatttgtagtttagtatttatattggattgtggttttgtgttttaaggttgttttgggatataggtaagatttttttttatttttattttatttttagtatgattttttatgatgaaaagaatttgtttgttttttatttaatttggatggtaagaggagtttttttattttttgttagaaggcgaatggaattttatggagtaaaaggtgatgttagatgatttttttgagaataagggtggaggatttaggtttttagaaatttgtaaggtgttaagtttataataggtttttttagaggattagttttgttttattttttttggagaagtggttttagtgtttggaaggggtgtttgtaagtgtttagagttggatagggaggatttagttttcggtttgtgagagaatgtgaggacgtttacgtggtttttttgattaagttggggtaagcgtagtaaagttatttcgaggttgtgtttttggtttcggtttttgtattgttatattattagttttattgattttttattttggttttgttaggttcgttttttgaagttagggaggaggaattttttagggaagaataaatggttgtttagagattttgttgttagtgggggaagggagggattttaaataaagattttgttagggtttttattatttggtttttgtgattatttggagtcgggttagtaggaattggagagatagtattagggattttttgggagtttgtggttttagtacggaggggtgtttgtttttggttaggtagaagtagtgagtgatggtttgtgtttgggcggtgatgaatggttttgggagaagtgagttttggggagttattattcgggagggcgaggtttggggttagagagttcgattagtagttggttttatttttataatgtttcgttttttcggggttattgggggttttagtttattttgtagatattatttttgttttttttttttttttttgaggtttggaaatgagataattgtttttttgttgatcggggaagtttagttgtttttatttttttgggtttttgaacggggcggtttaggttttttttttgggtttggtttttttattaatttgtaggtaggtaattttttttttttatttattatattttttagttttattgtattttaaataattaagttgaaagttaattgttttatttggatttgaagggtttgggttaaattttaaattgtttttttttaggagaagtttgttggagtttgggttatttttgattttggggtttgttttgatttatagttggtggtagttaagtagtagggttaattgttttaatttttttttttcggtagtgggtttgttgttttttagtattgttagtgtggtattaagagatattgaatttttatttttagagttttttttttttttttgttttttggtttataatagtttttgtttttttatttgttaaataggtatttattgtttttatgtaaagtatttgtgttttgtaaattaggggttgtggggtgagggtttcgtgtagttggttttaggtattgagaaagatttattttggtagagtttgaaattttacgtttttttttcgtttatatgttgtggcgtggttgagtttttcgggatgggttgtgtaaaaggtggggtgggggttgtgttatttgtgtttttaggttttggatatggagatatagggagtttgaagtgggtgagagggttaaggagtttcgtaaagagtagatttagtggttacgaggttgggtagagaaagaggttagaaatagtaatacggaggtttttaggagttaattaatagtgaatattgaatttagagtttagtttttttttatttttttttaggattaaaaattagtttttggttaatggtttatttattgattgatttttttttatttatttatttatttatttatttagttaagtaagttttttttttttttcgtaaatataatgtatattttatatattgttttattttagttttttagttggaaatatttgtttttgtttttttttttttttttattttttataatttttgtttaaattttagtttaaggtttagtttgggtttagattaaagtttaatttaagggttattttttttttgaagtttttttttatttttaaattaattattttatttttttttttttttttttttttgtgtttttttttttttttgagatttagtttcgttttgttgtttaggttagagtgtagtggagtgattatggtttattgtagtttcgattttttgggattaagcgattttttggttttagttttttaaagtgttaggattataggtatgagttattatgtttttttgagatgtagtttcgtttagttatttaggttggagtgtagtggcgcgatttcggtttattgtaatttttgttttttaggtgttagcgatttttttgttttattttttcgagaagttgggattataggtatttattattatgtttagttaatttttgtattttttgtagagataggttttcgttatgttggttagtttggttttgagtttttgattttaagtgatttattcgttttagttttttaaagtgttgggattataggcgtgagttattatatttggtttttttttaatttttattttaatatttattttattttgttttatattatgtggagtttttaatagatgtttgtttattttattagagtaaagttttttatagttagtaagtatatttttattatttttttaaaaatattagtgtttaggttgggcgcggtggtttatttttgtaattttagtattggttagtttggcgaaattttgtttttattaaaaatataaaaattggttaggtgtggtggtacgtatttataattttatttatttaggtggttgaagtaggagaattatttgaattcgcgaggcggaagttgtagtgagtcgagatcgtattattttattttagtttgggtaaaagagcgaaatttcgttttaaaaaaaaaaaaaaaaaaattggtgttttgttagataatttgggtttattttttaaaatttagaaaatatagatttgtaaagaggaaaaggaagatttttataattttattatttaaaagtaattattgttaattgaatttattgttttagattttttttttgtatttatgtaaatttgattttttagaattaggatttatattgtatacgatgttttgtgattgatattagtatttagagttatatagagaatgttttttattatgtttaagaattatataatgttttattgtgtgggtgtataaagttgatttagttttttatatttgggtatttaggttatttttaatagtttgtatttaatagaatatatttttataaataaaatttgtttatgtatttaaggatagttttatttgttttaagttttgattttattattattatattattatattaaatattttttaaaagattatattagtaaatgttttttaaaatataataataaatattagtcgggtgtagttgtttatatttataattttagtattttgggaggtcgaggtaggtagattatttaaggttaggagtttgagattagttttggtaatatggtaaaatttttttttattaaaaatataaaaattagtcggttatgatggcggttatttgtagttttagttatttaggaggttgaggtaggagaatagtttgaatttaggaggtggaggttgtagtgagttgagattgtattattgtattttattttgggcgatagagtaacgttttgttttaaaagtaataataataaatattatttttatattttgtatgtttgatatttttttatttttataatgattttataggtataggttttatgattataattagatgagtaaattgaggtttgaggggttaagtaatttattttaagtttatatagtgggtgaggggtggaattaggatttaaatttaggtggttttgttatagtattttttttttattgtattatattatttttttatattaaattgggtttttttataaaatttaggtggattaatttttgaatgtaaatattgttggtttagttttttttgttttataggagttaggtattttttttttttgttaggggtgtgtgtgtgtgtgtgtgtgtgtgtgtgtgtgtgtgtgtgtgtgtgtgtgtgtttgtttgtagtaatattttttgtggtattttgtagagaggttatatattagttataggtttgtgaattgttttaatgaataaggttttttagtttagaataattaatggaataaaatttttatggacgttgttatttttattgttgttaaagatttatatggagaaggtttttaaggtgttagattcgatatttgagttttttttataggttatagttagtttagaatgtgtggtatgggtattgtttggacgtataaattagattgtttttaatatggatgtggtttaataatttttgatgaatggaagtaaatatattaaaagttttagaggttgggatattaatatttttttgaggttattagtgttttttataaataatgaagaagggttaggcgtagtggtttatatttgtaattttagtattttgggaggtcgaggtgggtagatagagtgagtttagaagattcgtttgggtaatatggtataaattttatttttataaaaaatataaaaaattatttgggcgtggtggtgggcgtttgtaattttagttattcgggaggttaaggtaggaggattatttaggtttggtgtggtgggttatatttgtaattttagtatttttgggggttaaggtgggttgattgtttgagtttaggagttcgagattagtttgggtaatacggtgaaattttgtttttattaaaatataaaaaattagtcgggtgtggtggcgggcgtttgtaattttaagtattcgggaggttgaggcgggagaatcgtttgaattagggagttagaggttgtaatgagtcgagattgtgttattgtattgtagtttggttatatagtaagattttttttttaaaaaaaaaaaaaaaaaaaaaaaggtgggagagggttgagttagtttgttttggaggtatgggggaggagaaggatgtgaatagggaagtgatttaagagtttttttaggaaggaaggatattttttttttggaatgtttttttgttttgttatagtttttagttaattattattgtttttagaatgtttattagtattttagttttttagaagtgtttttttttttttttggtgttaaattttagagtttatttttggaattaaggtttattttttttaggttttaggaagtagtttttgaattttagaagagttagttttttttattaattattgaatgaagttaggtatttaaaatttgggtagttatgatttgaagtgttatttgcggttaggtatagtggtttatttgtaattttagtattttgggaggttgaggcgggtagattatttgaagttaggagtttaagtttagtttggttaatatagtgtttttattaaaaatattaaaaaaaaaaaaaaataatcgggcgtgatggtaggcgtttgtaattttagttattttggaggttgagataggagaagtatttgaatttaggaggcggaggttgtagtgagttaagattgtattattgtattttagtttgggtaatagagtgagatttcgttttttaaaaaatgaaatgttaattttattgagattgtatgaatgtttgatatgtatttgaaagtgatgtttattttataattttagtttttttttattattttaaatttttagtgtatttaaaaaatttattggtttagttatttttatggggtaatatattatgattattaaaagatgatattaaagtgaattttttatgtatagttgggttttttgttagttttagattttggagaagtattttaggttagggagaacgggtgaagaggagaagtatttattgaaggtgttggtagtcggagttttgagattaatatagaatcgttttttttgaaggataatttaaggatagttgagggttttttattttttttatattagagggagttttgtgtttacgatgggtacggaaagggatgttagtaagcgatgtttttttattattttataagatttaggtgaaataggatattggttagggttgggatagggttagttagtttttttattttatagtggaggaagttgaggtttgagaggggaggtgatttgtttgaggttatatagtaagtgattagttgttatttgagtgatttttttaggtattttttttggttggatttagttagtgataattatttgtggtttaagttgagtttgggattaaatggttttataaggattttaaagtatatttttttttttttagtaggatatggggaatattgattttgttgagagtaagggttttttttttaggattgttttagatttttagattattggaattttgagtatagatattaggttttagttttttggttattatagagttatatatttttaggtagaaaaatttttaaattggttgggtatggtggtttatgttagtaattttagtatttttggaggtttaggtaggtggattatttgacgttaggagtttaagattagtttggttaatatggtaaaattttgtttttataaaaaaaaaaaaaaaatttagttacgcgtggtggtaagtgtttatatttttagttgtttggggggttgaggtggggggattatttgagttagggaggtggaggttgtagtgagttgaaattatggtattgttttttagtttgggttatagaatgagattttgttttaaagaaaaaaaaaaaaaaattcgaattatgtttttaattttttaaaattgagagtattaaatgtttaacgtttatgttgtgtgtataaaagtgagattgaaggatgaatgtgtggggtatggatagatgggatgtgaatgaagtagtttttgggtttaagtttttttggaaattcgtggaatagattagtggttttagatttttagattttataggttagtaaaatttttttttagatttttggaattaataaaggattattaatttttttgttaagtaagaacgtttttaataaattaatgttgtttgttattattattatttgatttttttttttttttttttttttttttttgagatagttttatttttgttgtttaggttggggtgtaatggtgcgattttagtttattgtaatttttattttttgagtttacgtagtttttttgttttagttttttgagtaggtgggattataggtattcgttattatatttggtttattttgtatttttagtagatacggggtttttttatgttggttaggttggtttcgaatttttgattttatgtgattcgtttattttagttttttaaagtgttgggtttataggcgtgagttatcgagtttagcgttatttaatttttttgttgtggtaaaatatatgtaatataaaattaattattttaattatttttatttttttaagttaaattgattatgtaatgtttttgagatagggttatattttgttatttaggttggagtgtagtgttgttattttagtttattgtagtttcgatttttcgggtttaagagatttttttattttagttttttaagtagttgggattataggtgtacgttattatgtttggttaattttgttttttttttttttttttttttgtagagatgaggttttattttgttgtttaggttgatttttaatttttggatttaaataatttttttattttagtttttcgaagtattggagttaagagatgtgagttattgtgttcggttaatttttaaatttgtaattgatgtataatggttatgtataatcgtcgggtacggtatgatgttttgatttacgtatatattatgtaacgattaaattatggtaattgttgtattgtatttattattttaaatatttattatttttttgtggtgtatttttattaattttaagtgtatagttttgtagtataaaatttatttacgttgtgtagttattattattatttattttattttttttgatattttatttgtttaacgttaatttttttttttttttttttttagttttttggtaattattattttatagttttttatttttaaaggatgttttattgtttttagttttatcgtgtgaaattttaagagaatttttttacggtggagaaaaagtaattttatgaagtttatttttttttttattttggagaggttggtgatttagttttattattgtaggaatgagacgggattgcggggatatggtaggtatttggggtgttgagagtttaggtgaattgtgagtttaagtatttatgtcgggtttgggggattagaagatatattttgaaatagttgaagtttttattaatttattagtaagtttagggagcggtaatttttttttgtttagttgttggcgtttttttttttatataatttttgttgagtttgggggaggggaggttgttcgagaggttttagttgggagaggtggggggagggcgatatatttttttttttaaggaatttgatcgaattttaaggttagagtttagtggagagtgggagttgtagggttatttttttgtcgttgatttatttttttatttttttttatttttaatgatttttttattatagaatttagattaggaagtgtatgataggtcgtagttgtagatatatggttgggaggtttgggtttcgggttagtggtgggagagtttgagtttttttttagtagtgggatttttgtatatatatatatatatatatatatatatatattattttaataatttggtggaagatgtttttttttatgtattgttataggtgatgacgagttggattttgttttgagtttaggatgtgatttatattataataaaggtaggagaagatattttttttgtttcggtttaatttgagtgtttagatttttttaatttatagtttatttaagtggtttttattagattttgggagttttttattatcgtgtagatgttttaatttttttttttaaaataggatttatttaatatggttttagaagttttttagggtattcggggtagttgttagttatagttttaatgttttcgaaatagtatgtttttttttttatgtttttattaaaatgttagttttaaaatatgtttttgggtggaggtttaggtgtaatagtatagtttttgtaaatatagatagatttgggtttaagttataatagatgagttgagttttttattttttagtttttattggggatggttttttttatttgtaagttgtttaggaaatgttaattgattttaaattgtgttttagggggtagttgttatataggagtttttgtttttattattagttgtgtttttggtttttttttttgaatttgttaaggttggattttggtgttaaatgtgaaatggtgatataaatttttaggaattgtgagtttggacggtttttttttatagtcgtagggtatttatttttgttttttttggatgagtgaatgaatttttttttttttagagtaatgttttttttttgtttagataggagggagagaagtaaagtgtattgggaataggttgagcgaaagagtgtagtaagagttttttgtatagttttgtttttaatgtattagtaaataatagggtgagaatttttgttggggagagaggaaggagggaaatttttttttagataatttttgggtgtatttttttgttaattatttaattatagttttttttttagtgaggtagtgaattttttattgtgagaggtagggaggaggtgggggatattggtgttgattggagaaaggtggtaaaatttttaggggaaaaaagtatagatttgaaggaggtattagatgaattcgtgtatagaagtttgagttttaaatttagtttttaggttgcgttattttttacgatatttagagtttttttgttttttaagatttatatataattttttaggttaatagtttttggcgtttgcgatttttaagtgggattttatacgtgttttgttgtttagttcggggggatttgtttttggggggtttcggggcgggtgtagggttttggttgtggttttggttagtgtaggcggttcggtattaaattatagtgacgaggtgggacgtataaaaggtcgaaatttttttttaataaaaataaaataaaattttgggttttaagtttttgggttgttgaatggttatggttttttgttaggattagtcgggttgtttgggtttgtgtgttcggtttttttttttaggaaatatttttagtaagtttcggtggggtttttatggtaacgtacggggggatttgttggtagaggttatttagtttgttattgtttttcggtttttttgttgtgagttttattgtcggttttttggtaaatatagtagtttgtatcgttttgttaggttgaatgtggagtttttatattttaatgggtttttttggtagtggtttatttgtatgtaaaatgtttttttttattttttttattttttttaatttaaaaaaaaaaaaaaagtttttttttaaattttttgggtcggggggttggtggacgttattggttttgggtgttaggttttgttaattgatttggtgttttcggttttttttttatatatatttgtgttttttatttttgtagttttttttttatttggggatttcgagagttgagagaaatatatttttggggttttttttatttaaatttttgtaggatggtagttgtgattcgggatttcggtgagatgtttttgtattttggtcgggttttgttagtcgaaggtaagtttttagttttattttaaagttaaaatacgtaataaaaaaatttttgtagagggttttcggagtttcgttgcgttgttttgtgttttttttaagttgtttttaaagttatttcgagttttttttttatttataattgtttttttatttatttttggggagtttatattaagattgtaaatatttttggattattagttttttttatgttgttgaggagtttagttttttttttttaatttttttaatttagaaattaaaaagatggaatagggatgatagaaattgttattttgagatattatgtttatggaggatgtttggattttgttgggggttagttatttaagttttaagttttttggagtgtagaacgtagagtaggtaatataaatatttattgttagtttagtattttagtaatatgagtaagtgtaagatataggtatgaatatttttagttttagggaaaggtatatttatgttggggagaggtggagaatgtagtttggttagttttagaagagtgagttttaaggtttaggaaagtgatggagatgattgtttgttggagagagagaaggagaaaggtatttaggggaagaaaaggaaaatgaaaggagtagtgaggatattggttttattggggaggtggaattggggtagtggtcgaattaggggtgggagaggacgtggttgagaggttttagattagttggggttgttatggagtgttgggggtttggagtagttaggatttgaaagtcgggatttttgtgagttttgtgtagttttgaggatgtggtttaagggggagggcggattagtttttttgtttcgtgtttttaatttttttagtgggttattaggggttattagttgtaagttgtaattaacggtgaggggttcgagaagagaaggtgttaggtgattgttggggattgagttgaggataggagaggtagggtgttgttttttgtggtttaggtagagcggtatagatttggagtgggttattttttattattttatgtgttgcgatagtgttggttggattgaattttggaagagtatttggatatagtggaggggttaggatttagtagatgtagtttttagagtttgtttttgttttgtgattttgggagttatttttttatgtttaaatgggaaggaatataagttatttggttataaggaagtaggttttatgaaatattaagtgtaatgttaaaatagggtattgttattggttttgagtttgttataattataatgaatattttttttatttttttatttgttatatttggatagtcgagtttgttggattcgtaggggtaggagagtgtattttataattaaaagtatttaattgtaaggtaatgattgatatgagttatgggtttgaggaaatgagggaaggaggggaggataaggttaaagtaattaattttagaattttacgggaggaggtaggatgtagggggtgttattagatagaattaaagggttgaattagaagggtttttttatttggggaagttaagatattgtgaagattgaggttgttttgtatagcggtaaagttggattttggatgtatgatgtatgtggattttggagaattaggttatttgtgtttgaattttagttttgttatttaataatttagttgggttattttggattaattttaaatttttttgtgttttagtttttttttttgaagataataatttttttttttttttttttttgagacggagtttgggtttgttatttaggttggagtgtagtggtgtgatttcggtttattgtaatttttgttttttaggtttaagtgatttttttgttttagtttttttagtagttgggattataggcgtgtattattacgtttggttaattttttgtatttttagtagaaatagggttttattatgttggttaggttggttttaaatttttgattttaggtgatttatttatttcggttttttaaagtgttaggattataggtattagttattgtattgggttcgaagataataattttaatttttaaatattttataagattttaagttaatatatgttgagaattatgttggtatgtagtaagttttcgtatttataggatagaaattatagtaggattaattttataagttttttatgaggatgaaatgggagggtttgtgttaaaagttttgtgtagtttatgggatatagtgagcgtgttggaaatattggttagtagtagtattgttgtttatttagatgtttatggatttttagataatatatgggaaggtatatggtaaattataaagtgttatgtaaatgtgttgttattttttattgggtttttgttaagttgtggggtttggggatggataatttttagattagagtggttgttgtgggatcgggttggtgaagcggtattttaaaatatatttttaggtgtgtttgtttatgtggtatgaatgttttgtatttatagtttttgtagagaggtgtgttttttgggatatttttggtggttttgttttattttttaatttataaattgaaattattatttgttattgtttttttttatgaattttttgtttttggttagttgtatagtttggttttattttttattgttttttagattagggtatagttatgtttgtaagtattttatttttttttgttttttttagatattttattttttatttaaatttttttttttttttttttcgttattttgtttaatttttgtttttattgttgatatttttttttatgttttatgacgttagagtttgtgttagatttgtttgtatttggttttgatattttttatttgttttatgttgtagtataaaattttaatttatattaaggtgttgtgtaaatttgagtatttttgttagggtaagatatatgttttttgggtttttgttttatttatttttttttgtatagtgataagggtttttagagttatttaatggtagttatgttgatgaaagttttttgatttttttttggatttttgagaattggggttttattttgttataagaatagtaaggtttgtatgggtttgggtttttgatggtttttatgattggtggaagatatagatttagaattaagaattgggaggtcgaggtgggtggattatttaagtttaggagtttaagattagtttggttaatatggtaaaattttatttttattaaaaatataaaattagtcgggcgtggtggcgtttgtttatagttttagttattcgggattgaggtacgagaattatttgaatttgggaggcggaagttgtagtgagttaagattttagaattgttttttaaatgattgtgggagatttttgtttagttttgttagaagtaaaatgttgtatttgttggtttgttggaagtataagtttgtagtatttggggggaaagtaggaagggaagagggatttagtagggttttattattattaatcgtgtttttgaatttgaaagtattatgggaaaatttttttttatttttgtttttgttttttttagttgtttttttgaggattattaaaaagtgtgggttttcggtgggtttttaatttttttttaggggatagagatattttagagaagtagggtaggtttgatgtatgaatttttgttattcgtattaaaaggagtattggttgtagtttgtataaatttttaaggtttattcgttagttgttttgatttaggaatttgcgtggtaatgagattagtagtttgagttttcgaacgatgtttaaggtaaattttaattttgatttttttatttttgttgatgagaacggtgattttattttattggtattaaagtataaggtttttttttttttataatgtattttttttgttgttgttgagatagtgtttttgttgtttaggttggagtgtagtggtaagattatagtttttgtagttttgagtttttgggtttaagggatttttttttttttgttttttaagtgtttggggattataggtatgtattattatgtttggttaatttttttatttttcgtagagatagggttttattatgttgttagggttggttttgaatttttggttttaagtagtttttttattttggttttttaaagggttgggattataggtatgagttattgtatttagttcgtaatgtattgttaatatatggtatttagagtttgtaatagtgaatagttagttttttttagttttaggttaggttattagggaatttagatattagatgttttttagtttttattttttattttattttttaggaaatagatgtataaagtaagtgttttggtgttgttttttttatagtatttttatgtgtattttgaggataatttttgtatttgattttaattaattaggttttttaggagttggaatgttggttttaagtgattgaataataaagtggttttttttattttttttggttagtttaataaaagtgttaggtagttttttttttgttaatggatatttaacgatattttggtttgttggttttgattagagaaaggttagtttagggtagttggagttgaagaggtaaggatttttttaatgaggatataagtgagggatattggaaagattaaaagagaatggaaagtattgatatggtagttgtagggtgttagtgagtagttatgtttttaaattagttattttatatagaattttttaagtttagggttattggatggggttgtgacgtagttaagtagggtttagaaagtatataagtagttggttttattttttgtaagaaagtggtattatttttgttttgtaaacggagaatttgatatatattaagagtatttttagtcgtggaaaaaagtcgttagaattcgaggttagtttgatttttggtttttttgaaaattagtttttgttggatgttagatttagttttggatttattgagtagtttttgggtttttgatattgttaggtattgtgggaaaattataataggtacgtttgcgttgagttgtttgttaatttttaggagagatttggatattttggataattaagaagtaatataggttaggtacggtggtttacgtttgtaattttagtattttgggaggttgaggcgggtggtttatttgaggttaggagttcgagattagtttgattagtatggtgaaattttatttttattaaaaatataaaattagttaggcgtggtggtatatgtttgtaataattttagttattcgggaggttgaggtaggagaattgtttgaattggggaggtaaaggttgtagtgattcgagattacgttattgtattttagtttgggtaataagagtgaaattttgttttaaaaaaataaataaataaaaagaagtaatatagttttttgagaaagatgtagttataagtggtgtagagttgtagtttgtttatttttgttttttatttatcgttgtttcgaataagttagttaggaagtcgtattgtattaaggtttttaaagatattagaaaatatttgtgaagttggaggtgattatttattaaattcgaatttttttaatgattcgtagcgtaaaatttttggagaaggtgtgtgttgatttgatttagaggaggaaaggaaaagaatgtttaagtgaagggattagtttgaatgtttgttaagattttgagaattattataagaaaatttttttgtggtgaaggtttagagatatgggatcgtttttagatgagaatttataagttatttattgatttgtatagtttttttgagattgttaagtagttgatttttattagtgttgagttaggaattgaggtggaagttattattgtagatgtttaaagttaattattttaataaattgattagcggttgttataaaaaaaaaaaaaaaaagtagtagtaatatgggttgagcgtagcggtttatatttgtaattttaatattttgggaggttaaggtgggtgggttgtttgagtttaggagtttaagattagtttgggtaatatttgaaattttaatttattttttaaaaaagaaagaaatattatatttaatatttgttaattgatgattgtaatgtggtatgtttatataattgaatattattaggttattaaaaggaataaagtgttgattttatgttataatatggaggaagtttgaatatatgttaagtgaaagaagttagttataaaagattatatattgtatgattttattgatatgaaatatttagaatagttaaatttatagatagaaagtagattagtggttgtttagattggggataggggatggaggagtgattattatgggttaggtattttttgaggggcgagggatggtaaaaatgttttaaagtgagattgtggtgaatgattgtataattttgaatatataaaaattattaaatggatgaatattatagtatgtgaattatttgtttgttgtttaaataaaatagaaataatataaaatggaatgtaattgagtgtgaatttgtgtgatttaggcggtaattgttttatagaaaattagagatgagatattgatataaataaggttttttagttttttgttttgttttaagatagggtttggttgggtgcggtggtttatatttgtaattttagtatttgttaattgaagatgtaaggatcgaggcgggtagattatttaaggtttggagtttaaggatagtttggttaatatggtgaaattttatttttattaaaatgtaaaaataagttagttattgtggtatatgtttgtagttttagttgttttagaggttgaagtgggaaaatggtttgaatttgggaggtagaagttgtagtaagttaagattgtgttattgtattttagattgggtaataaagtaattttgttttaaaaaaaaaaaagggtttttgttatttcgtttagtggtatgattatagtttatcgtagtttttaatttttgggtttaagtaattttgttttagtttattgagtagttgggattataggtatgtgttattaagtttggttagtttttaaatttttttgtagagacgaggttttattatgttgtttaggttggttttgaatttttgggtttaaatgagttttttgttttagtttttttaagtgttgggattgtaggtataagttattgtatttagtttttggacgttttggatggtggattttgagtagtttggggtaggaggattttggagtggcgttgatagtttttaggaaggagtaagttttgttatgttagggaggatgtagtcgtgttgaaagtattttaattggggaggggggggggcgcggtggggagggatagtttttggtagagagaatggggttgggtggagagagtggaagttaattgtagggagttttgaaggtgaggtagggatgtggattttattttgtatatagggtagattttgattaggaaaataatgttaagtatatgatagtttggaagtaggagtttgagttgtagttttagggaggttatttaaaagattatttcggttgggcgttatggtttatgttagtattttgggaggtcgaggtaggtagattacgaggttaggagttttagattagtttgattaatattttttttttttattaaaaatataaaaattagttgggtatggtggcgtatgtttgtaattttagtaatttaggaggttgaggtaggagaattatttgaattcgggaggtagaggttgtagtgagtcgagatcgtagtattttattttagtttgggcgaaagagtaaaattttattttaaaaaaaaaaaaaaaaaaaatttatttcgagatggtttcggtaaagggataggatagagtatatttgagttacgtttggaagggaatcggggtttaaatttgtattaggaggaaagcgagttggtttttgaggtttttatagattacgtatagtggagttttgtttgtacgttttggttgggacgggtaggaagttacggatttaagttggtattagttagagcgggttttattagggttagtgtttttttgttgtatttttttggggggaaataaatgtttgggggttttttttgttatatttttgtttttgggagttgtttttttttttgggatcggttgtaataggttttgtgatgttagagggtaagaatttaagtttatttttgattaatgggttgtatagattataagttgtaaaatatttaattatcgaggttatttgagggaaatgagatttgattaatagaagtgtttgttttgttttttaagagttgagtttaaattgtttttttttttattttcgtttggtaaaattatagattattaaaaatggaaagaataattttttttaaggtttataaaagtttatttttaattagttgtgtggtttatttatttttgtggtgttttttttgatcggatttataaaaataaacgtgtgtaagtttagtggtttttgagtttttttaaagtagtatttttgtttttgataatttttatttaagataaagtttatgggttaatgtaggattgggtttgtaattttggtttttttaagagaaattattgttagtttttgttagttgttgattatgatgcgcgggatatttatttttatttttaaggtttttagcggaagtttgttgagtatttgaggaagatcgtgttttaaataagggggagtgaaagagaaaagggagagtagaaaggaaggtagtgaagagttagagtgattgtacgtgtggtatttattgagtaagtattttttgagtaatttttgggcgttaggtatcgtagtaggtgttggggatttaaaggtatcgatgatatattatcgtatttaggtttagaaagaggattgttttttagtgtgataggtgttaggagggggagggtatttaatttagattgggagttagtatcgttttggaggagaagttattagttaggttgagatagaagagtgagtagtgagagttggatagaaaaaaattaggggttttgtggttattggggtagtcgtgagttatagtaggggttgagggagaatatgttgttttagagttttatgtatcggggagcggtagtcgttttattgagttttttagggtgaataaatggtgagaaaagttttttttaaggttgtgggcgggatgtgggtggtaggtgagaggtggaagatgttaggagtatatttgaatattttaaaaggaaatagaaagtttattttttttcgtgagtgtagaggggtgtgtttaggagatgggtaatagtttaggatggtgaatttaggtgtgttcgggttacgggtttttttgaacgcgtgcgggaagaggtattggttaggggagggataggtgtttttggtggtattagattttgtgaggtgtagatatttcggtgggtttagtgtttttatttagggatagagaaggatggggtacggggagggagagtggatggtggggggtttgagggtgtgtttagttagagggttgaggagaaaggatttttgtgtgcgatagtttttgttgttagagtaagtgtgggttttatggtagttgtggtttttcgttttaatatagttaatagttttaaattttttgttttgatatttgttagcgagaggttttttgagttgatttttttttgggttgtttttttagtatgtgtatttgacgcgtcgagggttagatttttatttttttcgaattatacgtattttggttagtttttagttgataaattgttttttttcgatttgggtaggggttgttggggttttgaggggcggggtttgtttagttgttgttagggaagggtgaggttgagttattttaaaggaaatggggtgtttttttggtaagtggtaattttggtaaagaattgagtatttggggagggggtaatttcggatataaagaagttttggggagggtcgatttttttttttaggatgggggaaatgaaatgcgtttaatgttgttatagttgttttttaattttgtttttttttttttttgatttttggaggagtggggtggaaaagagatgggggtttttaggtagttagttgttttttttattgatttatgttttaatttttattgttttggtttagtagtttttagtaagtgatgtttaggatggtgcggtttcgtgtggttagcgtaattttttttgttttttttttttttttttttttttgtttttttttttcgttttttggttttttttttcggtttcgtggtggttgtagtttagttttggggagtttttgtggaagtggagttttttttggtttatttcggtgatttgttgtagtttcgttgtcggttgcgggacgatgtgtagagtattaattggttgcgggacggggtgtagttggcggaaagtaatcgtattcgtattataggggaggaggtggaggtgtaggatttcgtgttcgtagatttcggtttttatgtttgcgtaattagtagtttttcgggtagtgatattatttattttttcgttaatgttttaggttggtagttaagttttgtttttgtttttttttagatttattttttttagttttttttgttagttttagaggaaggtgaatttttttttttttcgtgatttgtttttattttgttttagaaattgttgtttattaatattgttttttgtttgtcgcgtggtttggtttttagagaggtgattaggtggggtgggttttagggtcggagatttggggtttttaggatatatttcggaggtgattgttagggtttttgggatgttaagattttgtgatttttttttattatagtttgtttagatttttaggaggttaagtggtgttcggttagtttttattttattatttttttgttatttggatttggtattcggtttagtgattagaggttttgaataggtggtggtatttttgttttgttggagaggaatttaggtgtatcgtaagggagttgtgcgagggtagttagggagttttggagttttgtgaatttgggaatttgttatttttagaatgtgatttttataaaattaggagttgaggaagtggagttgaaattttttttatgttatttatgtattttagggtgtggatttggtagtagatttttaaaggtgataggaaggattggagaaagatttggtatgaattttgatgggtgattatatgtgtattaagcgtgtttttataagaaataaatatttattggggagaggtgttggtagttgttggggtggtgggtgttttatttgttttgattaaggagggtagtttttaaattttagtagatatatgttagaaaaattttgattgtggggtgtttagtttattttttggaaatagtatttagttatagtgtgtttagatttgtttgggtttttttatagttagtcgtttaaagaagaatataggttgtttggttttagtatatttaggtggtattataagttgagaaagcgtttttgaatgtaggacggaattaagttaaataggaatagttgattttgatggaattatttagtgtgaaggtttttaggtagtgggggtagtgtttcggggaaggaagtaaatacgtataggaattgtttttaaatagtttttattttattaagagattattattaagggagtagtgggattgggatttttatggggagggtgttcgtgtttatttggaattgtattagttttggtgaaatttaggggtttttaggaggaattttagtgtttttttttttttttatagatgttttttttttttcggaggatgatgatgatgatgatgatttttttttagaggagaaagaaatagataatattaaattaaatcgtatgcgtgagatattgttttttattttattgttttttgggtttgggtattgggtttaagaggggaggggaaggttgaaaggggaggaagaggagggtatatggggttacggtgtttgttttgttaagtgttaggtattgtttataggtgttgggtagatgggtaagatatttttaggttttggtttgggttttgtttttgagtttgattagttgtttttttttattttgtttgttttttttggtttttttcgggtagtcgtagttttatattggatatttttagaaaagatggaaaagaaattgtatgtagtgtcggttgttaagatagtgaagtttaaatgtttttttagtgggattttaaattttatattgcgttggttgaaaaatggtaaagaatttaaatttgattatagaattggaggttataaggtacgtgtgtgtgtatgcgaaagttagagtaatgggaataggggaggtcgagttaggaagttttgattatatgttttttatttttttaagtaatattttttatttatataggttatttattaaaatttttaaatataaaaaaatgtaaataaagtttaaatatttttttagttttttttttgtaatatggtttttatatagttgattatattatgtatgtaatttttttgttttgttatttgttaatatgagtttttttttgatatattttaagtatgaatatttgaaatataattttttatgattgtataagattttattattttaaaattttataatttggttgggtatggtggtttacgtttaaaattttattattttgggaggtcgaggtgggcggattgtttgagtttaggagttcgagattagtttgggtaatatggcgaaattttttttgtattaaaaatataaaaaattagttatgtgtggtggtaggtttttgtaattttagttattggggaggttgaagtaggagattgtttgaatttaggagatagaggttgtagtgagttgagattacgttattttattttagtttgggtgatagagtgagattttgtttttaaaaaataatagaaaaagttttataatttaatgaattattttgtgatattaggtattttttggttttttattataataaataatgttgtagtgaatttttgttagtatttttttaagcgtgtttttttaggatagattgttataagtgaaattattaatttaaagggtgtaagtattttttttttttttttagacggagttttattttgttatttaggttggagtgtagtggtgttattttggtttattgtaagttttattttttaggtttatgttatttttttgttttagtttttcgagtatttgggatgtgtagttattatttttagttaatttttgtatttttagtagagacggggtttttttatgttggttaggttggttttgaatttatgattttaagtgatttgttcgtttgggttttttaaagagttgggattataggtttgagttatcgtatttagttagaaatattttaaattaatttattatgtatttattatatgtaagatattatgttttaaatgttgtaagatagcgtttttgtttataaaaattttgtagtttgataggaggtaaatgtttatgagtagttatcgtaaaaagtagattgtgattagtgttttggtaggtagagaggaaagggtgagtatagttttgattagagattggattggaggagatggtttttgaaatgagttgttaaggatagtgggggttggatttttagtgtaataggagaggtgtatagttgggaatatttttggtgtatttgggagtgtttgtagaaggtatatttgttcggattacgaatgattttgaacgttatagtggagatttttggagtttttatattttatttgttagtttgtagagtgtgaacgggttggtaggggggtaatttacgttttgttttagttaattttgtagtttggggttttgtgttattaggttttgatatggagggtaggtgttacggggtgtcgatattgttatggggtttgtatttttttttggatttttaatgtatttttttggtatttttttttaggttcgttatgttatttggagtattataatggattttgtggtgttttttgataagggtaattatatttgtattgtggagaatgagtacggtagtattaattatatatattagttggatgtcgtgggtaagagggtagaggtagtaggaggaatgagtttagtgggaagagttaggtttggagaatatagtcggggtgtttaggttttttaggggtagagttaggatagcgattggtattttttggttttgttattttgagtaggttattttttttttttgagttttattttttttatttgtaaaatagagttaagattagatagtaatacggttaaagttggttgttattgtgaaattgaaggtgttgtttagagtttgttttgaaggaggcgttgttggagaggtgttaaatgtagcgtaataggagttgtcgtttaatgttagtaagatgttaggttttttaaatatttgttttgtaatgtttatggtatatttgtaaggtgggtagtattagtttagttttgtataggagtataggcgtataggtttagagaggttagatattttgttaatgtagaattgtatatttgtgttaattttagggtattataggagattttgggaagaatattgagttttttggagttattatcgtaattttttttttttaggagttttgaaatttattttttagagattattgggtatagaattttttagttagtgttttttttgattatgatgatatggtttaagaaggagattgtggttaggagtagtggtttatgagttttaggtggtatgatgggattatttacgtttgtgattttattattttaggaggttaaggttggaggattgtttgaggttaggagtgtgagattagtttgggtaatatagtgagattttgtttttataaaaaaatttaaaaattagtttagtgtagtgttatgtatttgtagtattagttgagttaattgaggttattgaggtgggaagattatttgagtttaggaattcgaagttgtagtgagttatgatgatatttttgtgttttagtatgggtgatagagtgagattttgtttttaaaaaaaaaaaaggtaaaaaggagattttgatttaagaggttggggtaagatttgagatttcgcgtttttaataagtttttaggggatgttggtagtattgttcgtggattatattttgaatagtaggagttaaagtgattttggttttttaaggaggagtaggttgtgttgaggtttgggggtgtaattgaattagaaggttttttattaaagtatgagcgatttattgtgattgtaaatatgatgattgttttggggaggaggattttgatggtttagggtttgaagagagggtgtttttttttttagttttgttttgagaggtttgggtttagtagaagtgttgggaggtttataatttattattgggaaagttaagtggggcgtaggtgagtttatttttttttagttatggtaaggtttttatgataagtgtttttttttttattttttatagagcggtttttttatcggtttattttgtaagtagggttgttcgttaataaaatagtggttttgggtagtaacgtggagtttatgtgtaaggtgtatagtgattcgtagtcgtatatttagtggttaaagtatatcgaggtgaatgggagtaagattggtttagataatttgttttatgtttagattttgaaggtaattatggtattagttttcgtgggttagtttattgggaaggagattattgtttcgggggtttaagtttttgtgggtaggtttagttgttttcgaatgggattattttttacgttttaggtatatatattttattttagtagggatttagttatattttttaggattagtaatagaggttataaagtggaggtgagttgggaatagagggttgtagggatgggtggtgttggtttgtaataagttttgagagtaacgttattggggttttggggttagttatataaggaaggtatttggatttttgtttttttattgttcgaaattagagtttttttattaagcgttttttagttttagttttgtgttttgagttacgtacgatttttttggtaaatggggtgtatgataagagtattttttacgaagagttggaaaaataaatgttatatataaattttaagttatatgaggacgaggagtaatggtattttttttttttttttttttatttttagatatttattgtttttgaatgttttattaatttagggaaggtaattgtttaaatttttagtggatttcgtaataggaaggaattagaagttgggaaagttgtttatttttttgttttagagttagattttatttttttttagtttagttgttttagagatatattggttttttttttttttttttttgttgttggtgttaaaattgttttgtaggttattggttattgtttttatttataatttttgttttagttttggagggagtgggttaaatataaatagaatattttatttgaagtagtgattttttttttttttttttttttttaattaaatgttttggatttttgaagtttatttgttttgtatttgtaaaagggaaagaaggtcgggcgtagtggtttacgtttgtaattttagtattttagattatttgaggttaggagtttgagattagttcggttaatatggtgaaattttatttttattaaaaatataaaaattagttgtgtatagtggttggtatttgtagttttagttatttaggaggttgaggtaagttaattgtttgaatttagaaggtagaggttgtagtgagttgagattacgttattgtattttagtttgggtgatagagtgagtgagattttgcgttaaaaaaaaaaaaaaaaaaaaaaattaaaagggaaaggtaataaattttatttaatattttttttcgttttttgggtttgtttgaaagttatacgggagtaacgtgcgtggttatattttagttttgtttaattgattggtgtgtcgttggtttgttttagtattcggggattaatagttcggatgcggaggtgttgattttgtttaatgtgatagaggtttagagcggggagtatgtgtgtaaggtttttaattatattggtgaagttaattagtttgcgtggtttattgttattagatttgtggtaaaaggtaatggggagatggatgggattttgtgttggggatttgatgtaggttttaagttgttggggtaggcggggaagttagtattggattgtttttgttattttattgtatttttagtgtttagagttatggaaaaatattcggtttgggaggttggtttggtttggtattgtgttggtgtttgtgggttttttttttgttttttgtgtgttttttggttttgtgtggatttatgtgaggatttacggggatacggttttgttgtgttataaatggtattttagattgaagttgtgagtgagtggtgattaagagaaggggttataggttaggtatagtggtttacgtttgttattttagtattttgggaggttgaggtgggaggatcgtttgaagttaggagtttgagattagtttgggtaatatagtaagattttatttttataaattaaataaattagttaagtatggtggcgtgtgtttgtagttttagttagtttgaaggttgaggtaggaggattgtttgagtttaggtcgaggttgtagtgagttatgtttatgttattgtattttagtttgggttgatagaatggtattttattttttaaaaaagagagagaaggggttaggtatttttttgtatattcgtatttgttggttgtgtatgtatatgtgcgtgtgtgtatgcgtgtgtatgtgtgtgtttgtagttttcgttattttttttgtgtttattttttggttatttttatttgaaattaaatagtttttgttcgtcggttttatttttttatgtcgtttatcgttcgtatgttcggatgggttagtggttgttagtatttggtgaagggtcgtaattagttatcgtttttttaggtttgtcggagttttttttttagggttttattttttttttttaataggttttgttgtttggtggttttcgtttgttttttgttgtaaagaagatgttagggagtatttttttttttagttttttttttttttgttttttttttttgttttgcgttttttagaggttttatgttttgtgtttgtttattttgttttcgttgttttttttagattgttggagttaatattatcgataaagagatggaggtgttttatttaagaaatgttttttttgaggacgtaggggagtatacgtgtttggcgggtaattttatcggatttttttattattttgtatggttgatcgttttggaaggtatatattgtaattttttttttcgatgttttgttttcgttacgggtacggggggagtatgtatttttaggtttggggagatatagaggtaggagagttggaagaatgggtttttgtttgtttggtgttatattttgttttagttttgagggttgaatttttttagtttagagaagagtttttttagttttgtaggcgtacggaggttttttattcgtatatttgtttttgttttttttttggttattgtaatgtatgttcgggatttgggtttattttgtagttcgatttttttagggtaggtttttttcgtttttgggtttagtagtttttttttttcgttgggtattgagtatttgaaaagttttagatagggttttatattttttttttttttttaagtgtttagtttaggggtggggtttgttgtttgtaaagagtagtttatttttttgtattgttattttattgtttttgaagaaggaggttagtttggataggtgaattgagttgtttttagaaaggtttgttttaggtagtcgtagtaggttttacgatgtttatgtattttgtttgtttgttgtcgtttttttttttttaagaggggaggtttgcgtgttgagttagggaggaaggagtttgtagtttgtttagggtggtggttggtgattgcggggttagggtttgttgttgtttttcggaatgttttgtatgtgggtttggttgtttttgttggtattgttttttttttttttttttttttttttattttgttttgtttgttcgttagggttttcggatgtttttgttggaggtagagaagcgttttgtttttattatcgtttttgttttggttttgttcgtgttttttatgtgtttttaattagttgttttcgttttttaatattagggaaagaaaaaatagtaatatttttttttgttattagttttgttgtttttttgttaggttttgggacgttttttgggtttagtttagggtcgtgttttatgttttatgtttttttgggaaggtttttaggggcgtcgtttttatggttggttggtgggttttaaaggggaaggttgggaggaggtttgtggaaggaggagggtcgtttatattcgtggggtaaagcgtgttttatgaaattagtgttgtgcgtgttgggatgaaagttttttagtttttcgtgttgaagggaaaggtggatcgaattggtttagttgttgtggtaatggggtggggggtgagttttaattagaaggtgggagaagagaataataaaatggaatttcgttttttgtcgttatatttttttaagttttaggagttggggtttatgagtagaatttgaaagaattattaaaaaagtttatttttggaaattaagttagttttgtttgtggtttggttaggaataaatatttatttgtgtgtttttatagagatgatatagatttaaagtgggatattgagtaaggtataggttggttttttttttgttttttgtttttattttgtgagtgttattattattaggtattgtggtttgtagaaataaacgaggtattaattttgtttttagggatttcgtgtttttttagggatagaggatttagaaatatttgtgttttcgtatgttaagtgtatgtatatagtgttgaggttttgtagagaagggttatggttttttgaggagattaagaaaggtatatagaagtgattttttagttggtttttgtaggatttttgggtgtttgtatttttttagtttagttgagtaaggaggtttaggaattaatgaagatggggtttgtgtagtacgatggttttaggttattttttttttatggtttaagtttattgaaggtagtttttaaaattagggggttgtttgatttttttagtgttataattttagttttagttagaatttgttatggtttttttttttaaaagtttttaggggataggagataggtgttgtttttttaatggagcgggatttcgtatggacggggttttttaagtttgttaatattttgttcgtattgatttagttttggaagagaggtcggtagtgatgatttcgtttttgtatttggagattattatttattgtataggggttttttttattttttgtatggtggggtcggttatcgtttataagatgaagagtggtattaagaagagtgatttttatagttagatggttgtgtataagttggttaagagtatttttttgcgtagataggtaatagaaagtagatgggggatttgtatatttagtattatttttttttttgggtttttaatgttttgttttttttattgtttttaatttatagttttgggttttattttttggtttttgggtaaggtatagtggaatattatgaattaagtgttttagagtttgttttaagttagtgtagttcgtgaattttttgtattttttatattatattgtaagtttttcggatttttgggatatggattgggaggaagttttatttggatagaatgtgtagttaatagtatgaatttgaattgtttttaagggttgtttagaagtgtagagatgtagggtagagaagagaattgtttgtattagtttatttttatattgttgagaaagatatatttaagatcgggtaatttataaaagaaagaggtttaatggatttatagttttacgtggttggggaggttttataattgtagaaggtaaaaggtacgttttatatggcggtagacgagaagagagtttgtatagggaaatttttttttataaaattattagatttcgtgagatttatttattattataagaatagtatagggaagatttgtttttatgagttaatgattttttattaggttttttttataatacgtgggaatttaagatgagatttgggtggggatatagttaaattattttagttatattatatttttgttttttgtgtgtttatttttttttacgggaggaaatggtatagatggtataggtgtgtgtaagaatgatcgtttttttagaagtttgtgtttattttggaaggtgttttgggagttaggaatttataagttaaggtaaagtatttgtaaagagttaggagaatagagttgttattgtaatgattagttataaaatgttaagttggaagaggtgtatttggtttgtttattttaaaggtgagtgaagtttagaaaggttagtttgtggtagaaataggttagttttagaagttgggttttttggtttattatggtttttggattattttgtgttgaggaaagaatattagatatatagatatgtgtttttgttattgttgggaagttttgattaagaatgggaaggagttatttcgttttttttttttgttttagggtgattttatttttttttgtaggtgtttgttgattttagtgtatttatgaattttggggtttttttggttcggttattacggtttttttttagtgggatttttatgttagtaggggtttttgagtatgagtttttcgaagattttcgttgggagttgtttcgggataggtaataatattttgatttttaattttttgaaggtattttttgtttgttattttagtggtggaaggtgtgtatattaatattttttgggcggtgaaggtttatgaaatgtttgtagaaatatttattttattttttgttcgtagttgggtgaaatatagagaggtggagatggggtgttttttaaggtttgaattttattagttttaatttatgttattttttgtttttttcgaaagattggttttaggtaaatttttgggagagggttgttttgggtaggtggtgttggtagaggttatcgggttggataaggataaatttaatcgtgtgattaaagtggttgtgaagatgttgaagtgtaagtgatgtttttgtttttgtaaagaaaattttgttttattttaagtaaatagtaggtttcgggtttagtagaatagtttttttggtgtttttgttgtttatatttgtttcgttgtttgtttggggttatttgggagtggagggggtgttttgtattttgagattgttttatgacgttattttgttttttggcgttaatttgggttgtggttaggtgtttattttggatttatcgtttgtaggttttttttattatatttttgtttatttattattatttattgtaataacggtttttatgagagggaagagaaaataagtttggatgaagtggggaggagagaattaagttttagggaaaagtagtttttcgatatatattttatttttttagtttttattttgtttttttttttttttaagtaaatgagttttaacgtgttttttaaagcggacgtaatagagaaagatttgttagatttgattttagaaatggagatgatgaagatgatcgggaagtataagaatattattaatttgttgggggtttgtacgtaggatggtgggtgtcggttagattggttttttttgtttagcggggagaagatttgagttggggtattagttttaaggttttttttagttatagttagggaagggggttaagagaggttgttttggtagaggtttaaaatgtgttatttcgggatttgggtttcgtttattggtgtttatttaggaatatagatatttagatttatatacgtggtgtgttaatagaggtagttgagtaattatggtttaagagcgtttaggttgggtgtagtggtttatgtttgtaattttagtaatttgggaggtcgaggtaggaagattatttgagattaggagttcgagattagtttggttaaaatggtgaaattttatttttattaaaaaatataaaagttagttaggtatggttacgtatgtttataattttagttatttaggaggttgacgtataagatttgtttgaattcgggaggtggaggttgtagtgagttaagattacgttattgtattttagtttgggagatattttcgttgttttaaaaataaaataaataaataggttaggtatagtggtttacgtttgtaattttagtattttgggagggtgaggcgggtggattatttgaggttaggagttggagattagtttggttaataggtgaaattttatttttattaaaaatataaaaagtagtcgggcgtggtggcgtatgtttgtaattttagttattcgggaggttgtggtaggagaatcgtttgaatacgggaggcggaggttgcggttagtcgagatcgcgttattgtattttagtttgggtaacgagtaaaattttattttaaaaaaaaaaaaaaaaaaaaaaaaaattagttaggtattgtttatgtttgtaattttagttgtttgggaggttgaggtaggagaattatttgaatttagaaggtagaggttgtagtgagtcgaaattgcgttattgtattttagtttgggtaatagagtgagattttattttaaaataaatagataaattggggtttttattttaatgttgttcgggaattttttggattatgttgggagtaattatttttttgattttttttgggtagtagaatggattttttaggttttttaagaggaggtaggagatgggaggttggtcggggtgtgttgttgggggtggggtttttttgaggtgaagttaaatttgtttatttgttgttggttttatggtttttttttttgtgtttgtaggttttttgtatgttatcgtggagtatgtttttaagggtaatttgcgggagtatttgtaggttcggaggtttttagggttggaatattgttataattttagttataatttagaggagtagtttttttttaaggatttggtgttttgcgtttattaggtggttcgaggtatggagtatttggtttttaagaaggtgtggaatttgaaggtttttttgggtaatgttagggtgggaatagagtttttttagttttttagtttgtgatttattattttgtggtggcgttgtggatgtattgagtattggttttgtgtgttttgtgtgttgttttaggttttttgggaattgtagagttaggagtattagtgtagttaggtggttttggggttagattgatgtagggttcgatttgtgtattgttattttttgcgtagttttaggtagttatttagtattttaaaattttttaaatataaaataataataatattagttgggtgtagtggttaaggcgggaggattgtttgagtttaggagtgtgagattaggttgggtaatatattgaaatttcgtttttaaaaaaaaaaaaaaaattaaaaaattagttgggtgtggtagtgcgtgtcgatagttttagttattcgggaggttgaggtgggaggttagtttgagtttaagagtttgaggttgtattgagttatgattatattattgtattttagtcggggcgatagagtaaggttttgttttaaaagaaaataaagtataataatatttgttgtagaattgttatgaagataaaatgaaattgtttgtgagtgttgagtgtagtgtttggtgtgtaagggttggtttggtttgagtttagttttatgtggatttgttgtgttgggaggtaggatttaggagtatgtatcgttgtagacgtagtagaggtataaggggttagtttttggggaaggaagggaggagcgtttgttgtgatgagaagtttggagttggtagagaatgttagaagagggaaagtaaaggttcggggggtagagtagtgtggtagaagttttatgagataagtcggttagttgtatgggtggcggtcgtttagagttttttagtttttttattttttcgtttttcgttttttttttttttttttttagtgtatatatcgagatttggtagttaggaatgttttggtgatagaggataatgtgatgaagatagtagattttggtttcgtacgggatatttattatatcgattattataaaaagataattaacgtgagtgtcgataaggtcgttttgtgttggtggttttatttgagaagtaaggagtggggtgggttgagaatttattttttagtttttttttatttgtgtttttatggttttgtttggggttattttaattttttttgtgttgtttttagggtcgattgtttgtgaagtggatggtattcgaggtattatttgatcggatttatatttattagagtgatgtgtgagtttgtaatagtaattgttagggaggtgtgggatagagagtttttagtattgtagagttttgttttttttttggattgaggagttttttttttgttttagagagaaaaataaaatattgtttgtggttattttttttgttttagatgttgaaaggttgatttgttttttatgttgttttttggtattgttttgggtagaggatttgtgttgggggaggggaggcggagaagttttaatattttgtggtttttcgtttatttgtaggtggtttttcggggtgtttttgtgggagatttttattttgggcggttttttatatttcggtgtgtttgtggaggaattttttaagttgttgaaggagggttatcgtatggataagtttagtaattgtattaacgagttgtaagttcgaggagatgtcggaggttttgagttaggttttggggtaagagtgggtttgaggggtagggggttagattagagagtatttatttttaggagacgtttttgattttatagttttgtcgtaggtatatgatgatgcgggattgttggtatgtagtgtttttatagagatttatttttaagtagttggtggaagatttggatcgtatcgtggttttgatttttaattaggtaaggttgttcgtgttagagttagagtttaggtcgtttttattgcgtgtacgtatttttttgagtagggaggaggggttcggtttatcgttgttttttttcgtttattataggagtatttggatttgtttatgtttttggattagtatttttttagttttttcgatattcggagttttacgtgttttttaggggaggatttcgtttttttttatgagtcgttgttcgaggagttttgtttgtttcgatatttagtttagtttgttaatggcggatttaaacgtcgttgattgttatttatacgttttttttagattttatcgttagttgtaatttttatttatagtttttgttgggtttattatttgttcgtttttgtttttttttttgttggtaggagtcggttgtttattaggggtttttttgtgtggtttgtttttattttatttagtttatttttttttttattttttttttatttgttggtgagaggtgtaaagaggtagatttttgttgttagttattttatttttttttagatgttggattaatatttttttttgttattaggtattgtttggagggtagggagtgggagttaatgaataggtatgtaagtgagagttttttgagtttttttttgtcggtttggtttgttttgtttttatttataagtttttcgtattttggtggtaggtgttttgtttttagggttatagtagtagggaggttagtgtttcgtgtttcgattgaaggtgatttttgttttagataggtggtgttagtggtttattaatttcgatattagtttgttttgttgattaaatgtttggtattagaggatggtgaggcgaaggttaggttgggggtagtgttgtggttttggggtttagttttaaattgggggttttgtatatagttatgaagaaaatataaagtgtataaatttgagtatatatttatatgtttttttaaaagggtcgttattagagatttatttatcgggtaagatgtttttggtggttgggaggtattagttgttatatattaaaaataaaaaagaaaaaaaaggaaaatgtttttaaaaaggttatatattttttgttatttttgttgttttatttttttaaattatgttttaaatttatttttagtttaggttttttaataaaaattgttgttgttttatttatttatgggttgtatgaaaagggtgggaatgtttattggaaagaagggatatttacgggttttggggttaggtttgtttcgagggtatcgtatgttttcggcgtaggttttttgtaattttttttttttaggttttgtatttagattttacgacgtattttttgttttttcgttgtttttggaaagttagaaaaagaaga

SEQ ID NO: 45 - DNA, 57096 bp, Homo sapiens
gaggaattttttagattaagtgttgtttattttttattttaatggtggttttagtttgggtttatattatatgttttaaggagttttggaaaaaataaaggtttttggtttttttttgggatagtgtgattttttatgtttgagtaggtttatgaatttgtattttttagatgttttttaggatttgtgtttatttggattagggaattattatattatattattttgtgggaagatttagggggaagtattttagttatttttttgtgttttatagtattggagggtgttttgagtgggttgtgattaatttttaaattaattatatgtttttttttaatttttattgtttattttttgttttttagatatttattgtaggttggagatttttggaagttaatagtattgttgtagaatttatagggtttagtttttggtggattataaaatttaaattatgtggttggggaaagttgaaatttaagggaagggtttgaggaggggttgattttataataaaattggtttgtatttattaagtgttaattatgtgttaggtttttgttgatgttttaattttatgtgaaaagtattattattttttatttatagatgggaaaatagagatttagagtgtgaaaattatttttttaaggtgtatagattttaaagtttatgttattaggtataattttaaggttgtggtgtttttttatttgttttttagtttttaaattgttgttatgtttagggtttgatattttggtgttttttgggatgtgtttagatgtaggggtgtaaatgttaaaggagattaggttgtaggaagagaagggtagagtgttggatagtttggtttgttttttgttttttggggttgtggttggggaattataaggtttagtaggtagttgtagggggtggaggtggaggagggattagtgtgggtgggagtgagagagtgagtttttgtgttttgttggtgtatagtgtttggagtgtttttgtggttataggtgtggtgtttttggtggtgggtggtagttagtgggagttgggatgttggtgtagttgtagtgtgtggaggaatttgggtgtgttgggagttgggtggttatgtttggatgggattgagattttttgtagtgtattgtggtgattttgttttttttggttgtgagtgtgttgttgtttgaaaagttgtggaatttaaggatttttttttggtttgagtttggggtgttttgtagggtgtatggtatttgtgttgtagttgggtatgttgtggtgttggggtttttgtagggtgatggagtttggtttgtaaggaaagtgaggtgttgttgttgtgttttggaggaggggggtataaggtttggagattttgggtggtggatgggagttttttttttgttttgtttttggggtattagttttggttttattgtttttgtttgggttggaggtgttgagtattgagtgttgttgggagttgagtgttggttgtggagtttttgtgattttgttaggatttgaatagagtttgggggtggtgggttggagttggggatgtgggtatatgtttgtttgtataagttatggtggatttttttgaggtggaatttttatgttgagtgaggtaagagttgtggtgtttttggatttggggtgggtttggtgttttgagtggtttttggtgttggagttttttggttgtgtgttttgtttgttgtagtttagttggggttggtgtttttttttgtttgttgtttgttttttttattttttggtttttttttgggtgatttgtgttttttgggtttttttttttttttttttgtttgtgttttttgtgttttttttttgtgtttgttttgttgttttttttgttgtttaattttttttttaatttgtgtttgggagttggtgaggtggtggtggttttttagtgagttttgggagggataggtttggggtgaaggtggtgaggtttgtggttttttggattggggaggagggtgggagtgggtggtgaggtgggatgtgttgtgtgtgttatgtgtgtgtgttgtattttattttatgtttttttggtttttttttggggatttatttttaatttagtaggtagttttgggtttaatgttaaaaatttggggtatttttaagtttttttttatttttgggaaagtttggggtgtgggttggggttggatggggtgggagatgaattgtggaggatgtggagggttaggttagttttttttggaataggttttaaggaggtgttgttattaaatggttgaatttgtttgagttgagagtgaaaaatgatttttttttttagaaggggtgattttatgatttggatggtttttgaaagggttggaagtttggggaatgggaggataatttatggttgttaagttgaggtgtgggatgggggtggaaggattgtttggttttaatttggtttttagaggtgggggaagggatgagggtttttgtttggtgtggtttatttggtagtgatgtgtatgtttttttggtttagatttttttgtattttgttttttttattgttatgtttggggttgggagaaaagtgaggttatgatttatgtttgtggaggaattttatggattttgtagatgggggtttatatagaatatatattttttatgaggtagttagatatttttttggtggtggtggggggggggtggggtgtgaagtttgttttttgttttgagtttagaagttattaatttttttgaaaaatattattatggtgttttttttttttagtatttttttatttttaatttttagatgtagtagttgtatttggttttgttttattttatatgggtatattgtagttgtattattaatttttttttttttttttttttttttttttaaattaaaatttagattttttagtttgttttgattatttttttttttaatatttttggagatttggagatgtggtgttgagatttgggggagaaaagaaagtttttttggattttgagttatttaagattttattaagttatttgttgttgttggtgggtggtggtggtttgggtgttttttggattgtgtagtaaagaggtattttgggagatggggttaaggttttagggggtgttatttgtgaatggtttatttgttagattaggggggttttttggttgtgtgtttggttagaattggttttgatgatggaagtttttggaattaaagtgttgtttttttttttttgtgttatagttggagttgtgggagtgtttgttttgtttggagtttgtggtttttttttggttgttttgtggtggtgttatgtgttttttttggagtaagtttggtgtgtagggttgggggtgtgggtggttgttgttagaggtgttttttgtgtgtttttaaggattgatttgggttgtattttttggaaattaaagtggggtgttttattgtttaaataatggttataggtttgaaagtggggttggatttttgagttgtgtttggtaatagtttttgaggtaggaaagtgttttgtggtttaaagttgttgggagggtggggagagttggtgttttatttgtttttttttagttttttttaaattgaaaatatttttttggtttttttttttgggtggtagttttggaggttgtaatgaaattgtattttttttagatgtggtaattaaggtgattgttttttttgtagatgtgttttattttttgtatttttggattagtgttttttttggaatattatttagttttgagattgtttagtagaaagtggttattttttttttttggtttgggtttttggttttttttttgaggtttgtttaaaagtgaagtagtagggttttgtgggatgtgttttggtttgggtaattatttttatgtttgggttatttattttttttttggtgattgaggtttagtagtttttgttattgttggttgtttttgttgatggtttgtttttttaatgatttgtttatatattttatttttagtgggttaggagaagttttggggttgttttgattttttgagtgtagggtgtttggggattgggaggttgttggggtttgattttagttgggagggttatgaattgtattagtgatgagttgtttgaaatatttgttgtatttatttttagttatagttgagtgttagttttttaatgaggtttatttagattgagagttatttggattgtgtattttattgtttgtttttttaaatatgtttgtagaaatgtttatttttgaggtattttttttaatgggaatttaggttagagtgggtattatttgaataattttagggtgttttttttttttggtttttggttatggagggtgttagatagttttattaggtggttttttgatagtaagggaagtaaaggtttaggaagaaatggagaagtgttttttattttttaggggtagaggattagatatattggtgtattttttaggttgggttagttttatttttggtggattttagagggtaagaaaattgaattgaatattgggtaggtagatttaagttttagagattaaggaaaatttatgggttttgtttttagtggtgtgttttttgtttttagtattgatttgaaataagatttttaaaatgagagatttgttggtatgaatttgggggtttagtagttggtttttataaaggttttttttttgtttttgtttttaaagtgttttttgttaaaatggttgttagttatagaatattttagtaaagtttgagtttgttgttgttggaggaaaaggagttagaattgatttaaatgttttattttgaaagggttttatattatttgatagtttaatttttttttgggaaatttgtgttttatatttgttttttttagagttttgtaaaaggtttgaatgtattagggattagtgggagtttagatgtagagttttagagaagattttggtgtttttagagaggatgaaatgttagatttgggttaggatatttgtttttttttttaaggttgtatttattttaaatagaaattttttttttgttattatttattttttttttgtaatgaaagaaattatgtttagggtttttttttttatttaatagtttttatatggatgaattattttaagaatttggtggggttttatttatagtatattttgtttttaagagtaaggttttttagattatgtgtagtagtttgtgttttatttgttgttttttttttttttttttttttttgagatagttttgttttgttgtttaggttggagtgttgtggtgttattttaggttattgtaatttttgttttttggttgaagtgatttttttgttttagtttttttagtagttgggattgtaagtatgtgttattatgtttggttaattttttgtgtttttaatagagatggtgttttattatgttggttaggttgggtttgaatttttgattttaagtaatttgttggttttggttttttaaaatgttgggattataggtgtgagttattgtgtttgattatttattgttaattttttatatgttttttatttttaaggatatttagatattttttttttttaaagagatttaaaaaattagtatttttattggattaattaaaatttagtaagttgagttgagtaattttttttatatgtttattaagtatttgttttttgtttttttaatatgtgagtagagaatggttattttggggaagaaataagttttatttttatttgaagggattaatgttttggtgttatttttttaattttgaagaattaagttgtttagaaatttttttagggttttttggattagagtttggttggttaataaggggtattatttaattgtttttttttgatatttttagtttttttttttggaggagtatttttgttagtttttttttattagttttttttttttttttatttatttatttatttatttagttaataaatatgttggtattttttgtgtatatgttaggtgttgagggtgttagtaaaggttagggaggtatagattttgttttgaaggagtttgtagttttgtggggagagaagagaatgaagaatataaataataattatataatatgatttaagtgttatgtgagaggggttagtaatgtggtttgtaaatttggaggaatgaaattttttagttagaaggtttaagaaagttttatggaagaaatagttttttaaggtggggtttagagaaaagggaagggttggtttgttgtagaataaggaatggtatgaagaaagttttgtatagaggtatggatgttgttttgagttgtggtgttttatagaaatagaatatgagtagttggttatagtggtttatgtttgtaattttagtattttgggaggttaaggtaggtggattgtttgagtttatgagatggagatgagtttggataatatggtgagattttgtgtttattaaaaaatatataaattagatgagtatgtttgtgtttattggtagttttggttatttaggaggttgaggtgggaggattatttgagtttaggaggtagaggttgtaataagttgtgattgtattattgtattttagtttgggggatagaggaagattttgtttaaaaaaaaaaaaaaaaaaaaagttaggtatagtggtttatgtttgtaattttagttttttgggaggttaaggtaggtggattatttgaggttaggagtttaagattagtttggttaatatggtgaaattttatttttattaaaaataaaaaaattagttgggtttggtggtttatgtttgtaattttagttatttgggaggtaggagaattgtttgaatttgggaggtggtggttgagttaagattgtgttattgtaattttagtttgagtgatagagtaagattttattttaaagaaaaaaagaaaggaagaaagaaatataatattataatatgagttatgtatatgtttagattttttagaagttatattggaaattaagttaaaagaaagaaataggtaaaaaaaatttttttttttgagatggagttttattttgttgttaggttggagtgtagtggtgtaattttggtttattgtaatttttgttttttgggtttaagtaatttttttgttttagttttttgagtagttgggattataggtgtgtgttattgtatgtagttaatttttgtatttttagtagagatggggttttattatgttggttaggatggtgttgattttttgattttgtgatttgtttattttagttttttaaagtgttgggattataggtgtgagttattgtgtttggttaatatttgttttttaattaatttgtttgtttagattttatttaatgtaattatatttttaaaatattattatttgaatatgtaattaatatagaaattattgatgagatattttatattttttttataataagtttttaagatgtggtgtatattttttatttatagtatatttgttagtattagttatattttaagtgtgtagtggttattgtgtgggttataggtttagaatataagatatgaagatggagagtgagaaatgtttttggaaaggttggaagtttttgtttttttgttgttaattattaaattttttgagagtgttattaaggagtgatttaaagtattatataaagagaattataaatattttaatattatatttgaaatttaaatgtataattttttatatttggttggtattttagagaggagagaatgggtatagttatttatattatttatttgagttttataattatttgtgatgtggttttttttaggtgggaaattgaggtttagaatggttaagtgattattttagggtggtaagattataagtggaagggtgtgaatttatattgtttttagtggataagaataaaaagatttaggttgggtgtggtggtttatgtttgtaattttagtattttgggaggttattgtaggtggattttttgagtttaggagtttattattagtatgggtaatatggtgagattttatttttattaaatatatagaaaattagtttagttttttgggaggttgaggtgggaggattatttgagtttgggggatggaggttgtagtgagttgagattgtgttattgtattttagtttgggtgatagagtaatattttgttttagaaagaataaaaagatttggttatgaatttgttagttagttttttttatataatttttggataaggagatttgatatttataggttttttttttagaagtgggagagttttaaggttatgtggtttgtttagtttttgttattttattagatattgtttattttgtatgttggattagtattttagtgagaagatagtaggtatttttatttatgtagtttatttagtttttataattatttgtgatggaggtaaggtaagtattttagttttttttgatgagtgggaaattgagatgtgttttttttttgttttttattgaggatttttgtatgtaggtatgaattttaggagtttagttgatattggagagatggggtggggggaattagttgtagggttttggaggaagttgttgtgtatatttgtaaggttgtaggttatatttatttgttaagtagtgaaggaaggaagttgtttttaagggattggaaaaatttattaattagtagaatgagaaattgaggtgaagtaggaggtggtagggttttagatagtatgttggattagtggtttgtgttattgtgttttttgtaggtgggtggtatggggtgtatgttgattttttattttaggagttggtgttaggaggttaggtttttttaatatttttgttttatagatgttaaatttgagggttagaggggtaggagaggaagagattttttgtattttttttgggaaagaataagagggaagttggtagatgaatttgaagtgtattgattagggagttgagagagggtggtttgtagttagtttatatttgggaggaggtggtaggtttttttggggatagagtggttaagttgaagtaagtttaattattttaatatgatattatttttttttattggaatttgagaatttgtttagtattttgatatttagtaagggatttgggtttttttggttaggtgtgtgtttttgggtgataggtttgtattaggtgtatttttgggatgtagtaagttgtggaatatgggtttaggggtattttttggtaagtattgtttttattttagttttgggaatgtgttttatgtagtgttttagatggtttatttgtggtttgtttttaagggttttttttttagttagttagttttgagatagagttttattttgttatttaggttggagtgtagtgatgtaattttggtttattgtaatttttattttttaaatttaagtaatttttatgtgttagttttttgagtagttgggattataggtgtgtattattatatttagttaatttttgtatttttagtagatgaggaattttattatgttggttagtttggttttaattttttattttaggtgatatttttgttttagttttttaaagttttgggattgtaggtatgagttaatatgttttggtataagggtttatttttgattaatggaattgtaaattaagttttttttgttattagagttattttggatttatttttatttatttggtttggataaattgagtttgtattagatggagttaggtttgattaattttttatttatttttttttattttgttttttaatatttaaaaattttgaggtattattatatgttagttatatttttttgagtaaagtatttaatttttttgagttttagtttttttattgtataaaaggaataataaaatttattttttataagtttatagtgaggaatgaattaattttttattatagttttaaattaattttatttagggtatttttggtatatagtgggtgtttagtatttattttatttttttttttttgattttttttgtaaaagtagaaaaatgaaagagaaatgttgattttttttttgatttgaaattattaaaatattttagtaagttttgggagggagttagtggtgtggtatgtgtattttgttggttaagtatatgtgaatgaagttaagaatttaggggtttttttgttagttagtattgatttatttgtgaggggttttgtttggtttgggggaggtagggttgaagtattatattagggtatgttttggggaagtagattttttgaataatttggatggttttttggagtatttaggatagaagttatttggaaaatagagatggttatttttatgtagttttgatagtgtttagaaagttttgttatttggtaaatgttaatagttatgatttgttttttaagattttggggagttttaagttttattttattagatttgagaagggtaaagggttgtagattttgtttttttaattggggttagtgtgagttatttttgatttagtgtttgtaatagattttgattttgtagtgggattttttaggtttttttgttttttgtaatttttggatttatatttgttagatattatttgttattttttagtattagggagaattggattttttttggttttatatttttaggttttttgtaagtagttggtgagggtttttttttttttgtaagggaggttggtagaattatggatgtgatttgtataattttagagataaaaagaaagtatttaggaggttatttattttagttgttttattgtataggttggggagttgagtatggagtttagtagttattaattagttatttttgtatttggtttttatttattggtttttagtttgttttgtgattttttattgttttttattttttattagagggattggttggttttagatggagtggtttttttaaaattttttttttaaattttttgagatagagttttattttgttatttaggttgtagtgtagtgttgtgattttggtttattgtaatttttgttttttgagtttaagtaatttttttgttttagttttttgagtagttgggattataggtgtgtattattatgtttagttaatttttgtatttttagtagagatgggattttattatattggttaggttggttttgaatttttgattttaaatgatttgtttattttagttttttgaagtgttgggattgtaggtgtgagttattgtatttggtttgggtagagtgaagttttatgttggggagttattagtatgtttaaattttttgtaattgtagtatattttgtaaaattgttttttataaaagggtagaattatttgggatttttatgagattatttattttgtagtatatattattttgaagtttatattttggaaaattttatgatggtatttttaggtttgtatgtaatttgtatttaaaatatagttgtagaattgaattaaagtatttttttgtttaattaagatttataatttttttttttgagatagaattttgttttgttatttaggttggagtgtagtggtgtaattttagtttattgtattttttgttttttggatttaagtgatttttttgttttagtttttgaagtaattgggattataggtgtgtgttattatgtttgggtaatttttgtatttttagtagagatggggttttgttatggttaggttggttttaaatttttggttttaagtgatttttttgttttagttttttaaagtgttgggattatagggtgtattattatatttagttaggatttatgatttaatttattgttggggtagttttataatttttttttggatgttttagtaagtttatattttaagtagttattatatggtatattttattttttgttttttttttttttttttttatttagatttttttaatttttggggttttttttttttttttagggttagtttgaaaaggaggattgagtttattgtggagtatttatggagatgtggagttttgttattaatttttaattgtagaattgggatgtggagttggaagtgtttttttttttgggttgtgttggttatagttatattttgtattgttaggttgtttttgattttgtttgaataaggtaaggtgttggttgggggtagtttggatttttgggttttgggaataggatgggttgggagggaggtgatatggttgtaggtgatgtggttaatagggaaggtttttttttaagtggagtaaagaattttttttttgtaggagaaatttttaagatatttgggttggttttggtttggttataaatataattgattttattagaggttggggttatgaaggttggtgatatttatttatttgagatgatatgtttgtggggggtaatttatgtttttttttttttgaggaaagaatatttgatgaggattttagtgttatattttaatataggtgatgtataaaatgtagttggtggtgtaatggggagagaatgattttagaatttgtgtgtagaatttgggttagattataggggatgttgtaggaggtgagagtttgttaaagatttttgatttttagaaaattgttttaaggttatatttttgttaggtatagtgggttatatatgtaattttagtattttgggaggttaaggtaagaggattatttgaggttaggagtttaagattagtttaggtaatatagtgagattttatttttataaaaaaaaaggaaattaattgggtgtgatggtgtatgttgttagttttagttatttgttatttaggaggttgagataggaagattgtatgattttaagagttgaggttgtagtgaattatgattgtattattgtgttttagtttgggtgaaaaaaaggtatattttttataagggttagtagttatggttttatgtttgtatttttttatttttaattgtgttttataggttttgtttgggggtttgttaagtgatttgttttggataggtattgtttgaggggttttgaagtgattgagatttaggaagtataaaggggtatggagatttatggtgtgttggaaatttagagttattattggtaataggaaggatttattttattatttttgggatttgtgtgagttgtggaaaggttttttgggagattataggtatagaatattggtggtttttgtgggattttgaaaattaatgtatgagtatttttgttgttagaggatagtgtggtttgtgatttagtggttggttatatagagaaggttgatatatagtgggtgaaaggttggaggtgtgtgtgatggggtggttgtgtgtaaaaggttgttatttagttggttagggatttgtttgaatgatgagtgatgggtgagaatatgtgttttttggatggagttggggatgaatagggaaagttgtgtgagattttatagaaggtgtagtggttagagtaggtatatttatgttgttgttagtaatagaattgaaggtaaggtttgagttggagtatggtggggatttaaagtgggagagattgtgtttgtttatagggagtttatggttaggagggatgggtaagtatagggataagtaatataagatagattgtgtttaaattatttagtgaagttataattagaggtggtgggaatgtagaggaagaggggagtagagagtatttgagatgggtttgagtttagaaggggaaaaatgaagggttttttaggttgaatagtatgagtgtttagagatagtatgtatatggtttatggagaatggtttgtttggtgagtaggtagttttgggaaataatatttggaaaaattggattgagttagtatatggaaggtttaatgttttgttaagaaaattatatttagggttgggtatggtggtttatgtttgtaattttagtattttgggaggttgaggtgggtggattataaggttaggagtttgagattattttgtttaatatggtgaaattttatttttattaaaaatataaaaaaattagttgggtgtagtggtaggtgtttgtagttttagttattttagttttagtttttagttgaggtaggagaatggtgtgaatttgggaggtagagtatgtagtgagttgagattgtgttattgtattttagtttgggtaatagagtgagattttgttttaaaaaagaaaaagaaaattatatttaggttaggtgtggattatgttggtaattttaatattttgggaagttgaggtaggaggattgtttgagttaagaagtttgagattagtttgggtaatatgatgagattttgtgtttataaaaaatagaaaaattagttaggtgtggtggtatatgtttgtagttttaattattagggaggttgaggtgggaggattatttgaatttgggaggtagaggttgtagtgagttatgattatattgttttattttagtttgggtgatagagtgaaattttgtttaaaaaaaaaaaaaaaaaaaaagtaagaaaagaaaattagatttaaatgggtagatgttgggaaatttgaaaagtttttagtaagtagtgatattattagtttttagaaagttaatttggtagtttagtgtggatggttgggaggaaagagtgaggtgtatttgtgtttgtattttgttttgttatttgatagttgtattatttattttaataaattatttaaatattatatgttatagtttgtttatttgtaaaatagggataaataataaagggttaagtggggtaatttagatgaagtatttttatgtaaggtgttaatagttgttattgttgttattgttgttgttagaaggatgaggttgtaggttattttgagtgtttggttagaggaagtgtaggtattgattaggatggggattgggagatgatagaggaaggaaaaagtagtaaagatattatagtaatagtatttgtgggtttaagtaggttgggtgttaattgtgggtaattggagattgagatgagagtgtaaagggagtgagttagagtgggaggtttgaggggagtttagatttgaatttgttaattgtagatagtgataaaggagtggaagagtagtaaggagttagttgaggtttgagaatgtgaatttataatggagtttaaagtatttttttttttttgtagtttaagaagggagaagtggattttgggtttggttgtttgtgagttagtttgatgggatgagtataaggaattttagggttagggtgggggtgttagtagaggagggggttttatggaagttgttggggtagggtggaggttggaatttgggggttgaagattttgatgaggataaagtattggttttgtgaatagaagaaagggagtaagagaggtggatggggtttttaggagttatgtatttaggaagattgatattaaatgattattttttaaaaattaatttaatttttaaaggtatattggtttttatttataattttagtattgtgggaggtagaggtaggaggattatttgagtttaggagtttaagattagttgggtttgtttgtttgttggttggttggttttaagagatagagttttattttgttgtttaggttggaatgtagtggtatgattttggtttattgtaatttttgttttttaggtttaagtgatttttttgttttagttttttaagtagttggaattataggtgtttattattatgtttggttaatttttatatttttagtagagatgggttttattaggttggttttgaatttttgattttaagtgatttgtttattttggttttttaaagtgttgggattataggtgtgagttattatatttggttaaattaatttaatttaggtataatagtttgggttattgtaataagattgttgtgaatttttatgtgtaagtttgggtgggtatatattttttttggattgttttggttttgattttggttttatattttattgattgttggtttttggggaagtttttttttgtgtttttttataaaatatattgataatgaatgtgtgtttataaggttattgtgaatattaaataagtatgtttgtagagtttataggatattgtttggtttgtaggttatgagtagttaatggttgttgtgggtttttttttttgggtttttaggggagatggtatatggtgaggagtatgttgttttatgggatatagtaatggaaagtttttgtatttggagaataagttttaggtttttgtttggtggagtaagtttttgttttagtgtgagtgtggtgtttttatatagtttgttttttatgagttttgtgatagaatagagaattgttgtgtttaggatattttaaggggagatttggttttatgttttgtaagttgtaaggaattttgtaagtgtaaagtatattgtatagttttgggtttgttgattattaaataataatgttgatattttttaattaattaattaatttatttgagatggagttttattttgttgtgaggttggagtgtagtggtgtgattttggtttattgtaatttttattttttgggtttaagtgatttttttgttttagttttttaagtagttgggattataggtgtgtgttattatgtttagttagtttttttgtatatttagtagagatggggttttattatgttggttaggatggttttggttttttgattttatgatttgtttattttggttttttaaagtgttgggattataggtgttagttattatgtttggttaatgttgttgttgttttaaaaaaaaaattatagggtgagtatagtggtttatatttgtaattttagtattataggaggttgatgtaggaggattgtatgagtttgggagttttagattagtttgggtaatatagtaagattttatttttaaaaattttaaaaattagttgggtaatgtggtatatattggtagttttagttatttaggaggttgagatgggagaattgtttgagagttgtttgagtttaggagttgaggttatagtgagttataattaagttattgtattttagtttgggtgttagaaggagattttgtttttaaaaaaaagaagaaatatattataatttatgtattaagggttttgtttaaaaggtgagagtaaattatttaaaattttgtttatattgagttttttttatttaaaaggttttgttgtgattttaagtgtgtgtgtgtgtgtgtgtgtgtgtgtgtgtgtgtgtgtgtgtgtttgtgtgtttgtgtgtttgttgggagtttttttttattgagtgtagtattaatgttttttagtttgtaagtgtttttgagggattggggagggtttggagtttttggttgtttttggaaagttgatttaataagggttttaggaaaattagttttttttttttttttttttttttttttttttttggtttgggattttatagagttttagtttgttttagattaggttttgagagtggtgagggagttgtttggaaagattgaagttggttttagatgataagttttaatattttgagtttgtagagggtgtatttgtttgttttttgtaataagttaagttttggtgggtaaagttagtgagtgagtataatattgtttgtaaggttattgttggtagttggggtgggggttttgttttttttttagtagtattgtgggttaaatattttagtgtttagaaaatttgtagtttagaagtgatttaatgggttgagttttatagttttttttatttatttagatttgaaggagtttggtggtttgttagaggggggagaggttgtatttaatggaaaaattatatatttttattttggttttaagttttttggatgttttgtgtgtattataaagtggggttttgtttttgtgttttgtagaaatttgtatttatgggggagaggttgtgtgtggtgttagagttattgtttagttttagattatagggtttttgtaggttttttatttttgggtgtttttagttgtttttggtttaaaggggtgtgtgttttagtttggttgtagggagagttttaaataggtattataggtttggtagtgggatattttttgttttattattagatttgtagtttagtatttatattggattgtggttttgtgttttaaggttgttttgggatataggtaagatttttttttatttttattttatttttagtatgattttttatgatgaaaagaatttgtttgttttttatttaatttggatggtaagaggagtttttttattttttgttagaaggtgaatggaattttatggagtaaaaggtgatgttagatgatttttttgagaataagggtggaggatttaggtttttagaaatttgtaaggtgttaagtttataataggtttttttagaggattagttttgttttattttttttggagaagtggttttagtgtttggaaggggtgtttgtaagtgtttagagttggatagggaggatttagtttttggtttgtgagagaatgtgaggatgtttatgtggtttttttgattaagttggggtaagtgtagtaaagttattttgaggttgtgtttttggttttggtttttgtattgttatattattagttttattgattttttattttggttttgttaggtttgttttttgaagttagggaggaggaattttttagggaagaataaatggttgtttagagattttgttgttagtgggggaagggagggattttaaataaagattttgttagggtttttattatttggtttttgtgattatttggagttgggttagtaggaattggagagatagtattagggattttttgggagtttgtggttttagtatggaggggtgtttgtttttggttaggtagaagtagtgagtgatggtttgtgtttgggtggtgatgaatggttttgggagaagtgagttttggggagttattatttgggagggtgaggtttggggttagagagtttgattagtagttggttttatttttataatgttttgtttttttggggttattgggggttttagtttattttgtagatattatttttgttttttttttttttttttgaggtttggaaatgagataattgtttttttgttgattggggaagtttagttgtttttatttttttgggtttttgaatggggtggtttaggttttttttttgggtttggtttttttattaatttgtaggtaggtaattttttttttttatttattatattttttagttttattgtattttaaataattaagttgaaagttaattgttttatttggatttgaagggtttgggttaaattttaaattgtttttttttaggagaagtttgttggagtttgggttatttttgattttggggtttgttttgatttatagttggtggtagttaagtagtagggttaattgttttaattttttttttttggtagtgggtttgttgttttttagtattgttagtgtggtattaagagatattgaatttttatttttagagttttttttttttttttgttttttggtttataatagtttttgtttttttatttgttaaataggtatttattgtttttatgtaaagtatttgtgttttgtaaattaggggttgtggggtgagggttttgtgtagttggttttaggtattgagaaagatttattttggtagagtttgaaattttatgttttttttttgtttatatgttgtggtgtggttgagttttttgggatgggttgtgtaaaaggtggggtgggggttgtgttatttgtgtttttaggttttggatatggagatatagggagtttgaagtgggtgagagggttaaggagttttgtaaagagtagatttagtggttatgaggttgggtagagaaagaggttagaaatagtaatatggaggtttttaggagttaattaatagtgaatattgaatttagagtttagtttttttttatttttttttaggattaaaaattagtttttggttaatggtttatttattgattgatttttttttatttatttatttatttatttatttagttaagtaagtttttttttttttttgtaaatataatgtatattttatatattgttttattttagttttttagttggaaatatttgtttttgtttttttttttttttttattttttataatttttgtttaaattttagtttaaggtttagtttgggtttagattaaagtttaatttaagggttattttttttttgaagtttttttttatttttaaattaattattttatttttttttttttttttttttttgtgtttttttttttttttgagatttagttttgttttgttgtttaggttagagtgtagtggagtgattatggtttattgtagttttgattttttgggattaagtgattttttggttttagttttttaaagtgttaggattataggtatgagttattatgtttttttgagatgtagttttgtttagttatttaggttggagtgtagtggtgtgattttggtttattgtaatttttgttttttaggtgttagtgatttttttgttttatttttttgagaagttgggattataggtatttattattatgtttagttaatttttgtattttttgtagagataggtttttgttatgttggttagtttggttttgagtttttgattttaagtgatttatttgttttagttttttaaagtgttgggattataggtgtgagttattatatttggtttttttttaatttttattttaatatttattttattttgttttatattatgtggagtttttaatagatgtttgtttattttattagagtaaagttttttatagttagtaagtatatttttattatttttttaaaaatattagtgtttaggttgggtgtggtggtttatttttgtaattttagtattggttagtttggtgaaattttgtttttattaaaaatataaaaattggttaggtgtggtggtatgtatttataattttatttatttaggtggttgaagtaggagaattatttgaatttgtgaggtggaagttgtagtgagttgagattgtattattttattttagtttgggtaaaagagtgaaattttgttttaaaaaaaaaaaaaaaaaaattggtgttttgttagataatttgggtttattttttaaaatttagaaaatatagatttgtaaagaggaaaaggaagatttttataattttattatttaaaagtaattattgttaattgaatttattgttttagattttttttttgtatttatgtaaatttgattttttagaattaggatttatattgtatatgatgttttgtgattgatattagtatttagagttatatagagaatgttttttattatgtttaagaattatataatgttttattgtgtgggtgtataaagttgatttagttttttatatttgggtatttaggttatttttaatagtttgtatttaatagaatatatttttataaataaaatttgtttatgtatttaaggatagttttatttgttttaagttttgattttattattattatattattatattaaatattttttaaaagattatattagtaaatgttttttaaaatataataataaatattagttgggtgtagttgtttatatttataattttagtattttgggaggttgaggtaggtagattatttaaggttaggagtttgagattagttttggtaatatggtaaaatttttttttattaaaaatataaaaattagttggttatgatggtggttatttgtagttttagttatttaggaggttgaggtaggagaatagtttgaatttaggaggtggaggttgtagtgagttgagattgtattattgtattttattttgggtgatagagtaatgttttgttttaaaagtaataataataaatattatttttatattttgtatgtttgatatttttttatttttataatgattttataggtataggttttatgattataattagatgagtaaattgaggtttgaggggttaagtaatttattttaagtttatatagtgggtgaggggtggaattaggatttaaatttaggtggttttgttatagtattttttttttattgtattatattatttttttatattaaattgggtttttttataaaatttaggtggattaatttttgaatgtaaatattgttggtttagttttttttgttttataggagttaggtattttttttttttgttaggggtgtgtgtgtgtgtgtgtgtgtgtgtgtgtgtgtgtgtgtgtgtgtgtgtgtgtttgtttgtagtaatattttttgtggtattttgtagagaggttatatattagttataggtttgtgaattgttttaatgaataaggttttttagtttagaataattaatggaataaaatttttatggatgttgttatttttattgttgttaaagatttatatggagaaggtttttaaggtgttagatttgatatttgagttttttttataggttatagttagtttagaatgtgtggtatgggtattgtttggatgtataaattagattgtttttaatatggatgtggtttaataatttttgatgaatggaagtaaatatattaaaagttttagaggttgggatattaatatttttttgaggttattagtgttttttataaataatgaagaagggttaggtgtagtggtttatatttgtaattttagtattttgggaggttgaggtgggtagatagagtgagtttagaagatttgtttgggtaatatggtataaattttatttttataaaaaatataaaaaattatttgggtgtggtggtgggtgtttgtaattttagttatttgggaggttaaggtaggaggattatttaggtttggtgtggtgggttatatttgtaattttagtatttttgggggttaaggtgggttgattgtttgagtttaggagtttgagattagtttgggtaatatggtgaaattttgtttttattaaaatataaaaaattagttgggtgtggtggtgggtgtttgtaattttaagtatttgggaggttgaggtgggagaattgtttgaattagggagttagaggttgtaatgagttgagattgtgttattgtattgtagtttggttatatagtaagattttttttttaaaaaaaaaaaaaaaaaaaaaaaggtgggagagggttgagttagtttgttttggaggtatgggggaggagaaggatgtgaatagggaagtgatttaagagtttttttaggaaggaaggatattttttttttggaatgtttttttgttttgttatagtttttagttaattattattgtttttagaatgtttattagtattttagttttttagaagtgtttttttttttttttggtgttaaattttagagtttatttttggaattaaggtttattttttttaggttttaggaagtagtttttgaattttagaagagttagttttttttattaattattgaatgaagttaggtatttaaaatttgggtagttatgatttgaagtgttatttgtggttaggtatagtggtttatttgtaattttagtattttgggaggttgaggtgggtagattatttgaagttaggagtttaagtttagtttggttaatatagtgtttttattaaaaatattaaaaaaaaaaaaaaataattgggtgtgatggtaggtgtttgtaattttagttattttggaggttgagataggagaagtatttgaatttaggaggtggaggttgtagtgagttaagattgtattattgtattttagtttgggtaatagagtgagattttgttttttaaaaaatgaaatgttaattttattgagattgtatgaatgtttgatatgtatttgaaagtgatgtttattttataattttagtttttttttattattttaaatttttagtgtatttaaaaaatttattggtttagttatttttatggggtaatatattatgattattaaaagatgatattaaagtgaattttttatgtatagttgggttttttgttagttttagattttggagaagtattttaggttagggagaatgggtgaagaggagaagtatttattgaaggtgttggtagttggagttttgagattaatatagaattgttttttttgaaggataatttaaggatagttgagggttttttattttttttatattagagggagttttgtgtttatgatgggtatggaaagggatgttagtaagtgatgtttttttattattttataagatttaggtgaaataggatattggttagggttgggatagggttagttagtttttttattttatagtggaggaagttgaggtttgagaggggaggtgatttgtttgaggttatatagtaagtgattagttgttatttgagtgatttttttaggtattttttttggttggatttagttagtgataattatttgtggtttaagttgagtttgggattaaatggttttataaggattttaaagtatatttttttttttttagtaggatatggggaatattgattttgttgagagtaagggttttttttttaggattgttttagatttttagattattggaattttgagtatagatattaggttttagttttttggttattatagagttatatatttttaggtagaaaaatttttaaattggttgggtatggtggtttatgttagtaattttagtatttttggaggtttaggtaggtggattatttgatgttaggagtttaagattagtttggttaatatggtaaaattttgtttttataaaaaaaaaaaaaaaatttagttatgtgtggtggtaagtgtttatatttttagttgtttggggggttgaggtggggggattatttgagttagggaggtggaggttgtagtgagttgaaattatggtattgttttttagtttgggttatagaatgagattttgttttaaagaaaaaaaaaaaaaaatttgaattatgtttttaattttttaaaattgagagtattaaatgtttaatgtttatgttgtgtgtataaaagtgagattgaaggatgaatgtgtggggtatggatagatgggatgtgaatgaagtagtttttgggtttaagtttttttggaaatttgtggaatagattagtggttttagatttttagattttataggttagtaaaatttttttttagatttttggaattaataaaggattattaatttttttgttaagtaagaatgtttttaataaattaatgttgtttgttattattattatttgatttttttttttttttttttttttttttttgagatagttttatttttgttgtttaggttggggtgtaatggtgtgattttagtttattgtaatttttattttttgagtttatgtagtttttttgttttagttttttgagtaggtgggattataggtatttgttattatatttggtttattttgtatttttagtagatatggggtttttttatgttggttaggttggttttgaatttttgattttatgtgatttgtttattttagttttttaaagtgttgggtttataggtgtgagttattgagtttagtgttatttaatttttttgttgtggtaaaatatatgtaatataaaattaattattttaattatttttatttttttaagttaaattgattatgtaatgtttttgagatagggttatattttgttatttaggttggagtgtagtgttgttattttagtttattgtagttttgattttttgggtttaagagatttttttattttagttttttaagtagttgggattataggtgtatgttattatgtttggttaattttgttttttttttttttttttttttgtagagatgaggttttattttgttgtttaggttgatttttaatttttggatttaaataatttttttattttagttttttgaagtattggagttaagagatgtgagttattgtgtttggttaatttttaaatttgtaattgatgtataatggttatgtataattgttgggtatggtatgatgttttgatttatgtatatattatgtaatgattaaattatggtaattgttgtattgtatttattattttaaatatttattatttttttgtggtgtatttttattaattttaagtgtatagttttgtagtataaaatttatttatgttgtgtagttattattattatttattttattttttttgatattttatttgtttaatgttaatttttttttttttttttttttagttttttggtaattattattttatagttttttatttttaaaggatgttttattgtttttagttttattgtgtgaaattttaagagaatttttttatggtggagaaaaagtaattttatgaagtttatttttttttttattttggagaggttggtgatttagttttattattgtaggaatgagatgggattgtggggatatggtaggtatttggggtgttgagagtttaggtgaattgtgagtttaagtatttatgttgggtttgggggattagaagatatattttgaaatagttgaagtttttattaatttattagtaagtttagggagtggtaatttttttttgtttagttgttggtgtttttttttttatataatttttgttgagtttgggggaggggaggttgtttgagaggttttagttgggagaggtggggggagggtgatatatttttttttttaaggaatttgattgaattttaaggttagagtttagtggagagtgggagttgtagggttatttttttgttgttgatttatttttttatttttttttatttttaatgatttttttattatagaatttagattaggaagtgtatgataggttgtagttgtagatatatggttgggaggtttgggttttgggttagtggtgggagagtttgagtttttttttagtagtgggatttttgtatatatatatatatatatatatatatatatattattttaataatttggtggaagatgtttttttttatgtattgttataggtgatgatgagttggattttgttttgagtttaggatgtgatttatattataataaaggtaggagaagatattttttttgttttggtttaatttgagtgtttagatttttttaatttatagtttatttaagtggtttttattagattttgggagttttttattattgtgtagatgttttaatttttttttttaaaataggatttatttaatatggttttagaagttttttagggtatttggggtagttgttagttatagttttaatgtttttgaaatagtatgtttttttttttatgtttttattaaaatgttagttttaaaatatgtttttgggtggaggtttaggtgtaatagtatagtttttgtaaatatagatagatttgggtttaagttataatagatgagttgagttttttattttttagtttttattggggatggttttttttatttgtaagttgtttaggaaatgttaattgattttaaattgtgttttagggggtagttgttatataggagtttttgtttttattattagttgtgtttttggtttttttttttgaatttgttaaggttggattttggtgttaaatgtgaaatggtgatataaatttttaggaattgtgagtttggatggtttttttttatagttgtagggtatttatttttgttttttttggatgagtgaatgaatttttttttttttagagtaatgttttttttttgtttagataggagggagagaagtaaagtgtattgggaataggttgagtgaaagagtgtagtaagagttttttgtatagttttgtttttaatgtattagtaaataatagggtgagaatttttgttggggagagaggaaggagggaaatttttttttagataatttttgggtgtatttttttgttaattatttaattatagttttttttttagtgaggtagtgaattttttattgtgagaggtagggaggaggtgggggatattggtgttgattggagaaaggtggtaaaatttttaggggaaaaaagtatagatttgaaggaggtattagatgaatttgtgtatagaagtttgagttttaaatttagtttttaggttgtgttattttttatgatatttagagtttttttgttttttaagatttatatataattttttaggttaatagtttttggtgtttgtgatttttaagtgggattttatatgtgttttgttgtttagtttggggggatttgtttttggggggttttggggtgggtgtagggttttggttgtggttttggttagtgtaggtggtttggtattaaattatagtgatgaggtgggatgtataaaaggttgaaatttttttttaataaaaataaaataaaattttgggttttaagtttttgggttgttgaatggttatggttttttgttaggattagttgggttgtttgggtttgtgtgtttggtttttttttttaggaaatatttttagtaagttttggtggggtttttatggtaatgtatggggggatttgttggtagaggttatttagtttgttattgttttttggtttttttgttgtgagttttattgttggttttttggtaaatatagtagtttgtattgttttgttaggttgaatgtggagtttttatattttaatgggtttttttggtagtggtttatttgtatgtaaaatgtttttttttattttttttattttttttaatttaaaaaaaaaaaaaaagtttttttttaaattttttgggttggggggttggtggatgttattggttttgggtgttaggttttgttaattgatttggtgtttttggttttttttttatatatatttgtgttttttatttttgtagttttttttttatttggggattttgagagttgagagaaatatatttttggggttttttttatttaaatttttgtaggatggtagttgtgatttgggattttggtgagatgtttttgtattttggttgggttttgttagttgaaggtaagtttttagttttattttaaagttaaaatatgtaataaaaaaatttttgtagagggtttttggagttttgttgtgttgttttgtgttttttttaagttgtttttaaagttattttgagttttttttttatttataattgtttttttatttatttttggggagtttatattaagattgtaaatatttttggattattagttttttttatgttgttgaggagtttagttttttttttttaatttttttaatttagaaattaaaaagatggaatagggatgatagaaattgttattttgagatattatgtttatggaggatgtttggattttgttgggggttagttatttaagttttaagttttttggagtgtagaatgtagagtaggtaatataaatatttattgttagtttagtattttagtaatatgagtaagtgtaagatataggtatgaatatttttagttttagggaaaggtatatttatgttggggagaggtggagaatgtagtttggttagttttagaagagtgagttttaaggtttaggaaagtgatggagatgattgtttgttggagagagagaaggagaaaggtatttaggggaagaaaaggaaaatgaaaggagtagtgaggatattggttttattggggaggtggaattggggtagtggttgaattaggggtgggagaggatgtggttgagaggttttagattagttggggttgttatggagtgttgggggtttggagtagttaggatttgaaagttgggatttttgtgagttttgtgtagttttgaggatgtggtttaagggggagggtggattagtttttttgttttgtgtttttaatttttttagtgggttattaggggttattagttgtaagttgtaattaatggtgaggggtttgagaagagaaggtgttaggtgattgttggggattgagttgaggataggagaggtagggtgttgttttttgtggtttaggtagagtggtatagatttggagtgggttattttttattattttatgtgttgtgatagtgttggttggattgaattttggaagagtatttggatatagtggaggggttaggatttagtagatgtagtttttagagtttgtttttgttttgtgattttgggagttatttttttatgtttaaatgggaaggaatataagttatttggttataaggaagtaggttttatgaaatattaagtgtaatgttaaaatagggtattgttattggttttgagtttgttataattataatgaatattttttttatttttttatttgttatatttggatagttgagtttgttggatttgtaggggtaggagagtgtattttataattaaaagtatttaattgtaaggtaatgattgatatgagttatgggtttgaggaaatgagggaaggaggggaggataaggttaaagtaattaattttagaattttatgggaggaggtaggatgtagggggtgttattagatagaattaaagggttgaattagaagggtttttttatttggggaagttaagatattgtgaagattgaggttgttttgtatagtggtaaagttggattttggatgtatgatgtatgtggattttggagaattaggttatttgtgtttgaattttagttttgttatttaataatttagttgggttattttggattaattttaaatttttttgtgttttagtttttttttttgaagataataatttttttttttttttttttttgagatggagtttgggtttgttatttaggttggagtgtagtggtgtgattttggtttattgtaatttttgttttttaggtttaagtgatttttttgttttagtttttttagtagttgggattataggtgtgtattattatgtttggttaattttttgtatttttagtagaaatagggttttattatgttggttaggttggttttaaatttttgattttaggtgatttatttattttggttttttaaagtgttaggattataggtattagttattgtattgggtttgaagataataattttaatttttaaatattttataagattttaagttaatatatgttgagaattatgttggtatgtagtaagtttttgtatttataggatagaaattatagtaggattaattttataagttttttatgaggatgaaatgggagggtttgtgttaaaagttttgtgtagtttatgggatatagtgagtgtgttggaaatattggttagtagtagtattgttgtttatttagatgtttatggatttttagataatatatgggaaggtatatggtaaattataaagtgttatgtaaatgtgttgttattttttattgggtttttgttaagttgtggggtttggggatggataatttttagattagagtggttgttgtgggattgggttggtgaagtggtattttaaaatatatttttaggtgtgtttgtttatgtggtatgaatgttttgtatttatagtttttgtagagaggtgtgttttttgggatatttttggtggttttgttttattttttaatttataaattgaaattattatttgttattgtttttttttatgaattttttgtttttggttagttgtatagtttggttttattttttattgttttttagattagggtatagttatgtttgtaagtattttatttttttttgttttttttagatattttattttttatttaaattttttttttttttttttttgttattttgtttaatttttgtttttattgttgatatttttttttatgttttatgatgttagagtttgtgttagatttgtttgtatttggttttgatattttttatttgttttatgttgtagtataaaattttaatttatattaaggtgttgtgtaaatttgagtatttttgttagggtaagatatatgttttttgggtttttgttttatttatttttttttgtatagtgataagggtttttagagttatttaatggtagttatgttgatgaaagttttttgatttttttttggatttttgagaattggggttttattttgttataagaatagtaaggtttgtatgggtttgggtttttgatggtttttatgattggtggaagatatagatttagaattaagaattgggaggttgaggtgggtggattatttaagtttaggagtttaagattagtttggttaatatggtaaaattttatttttattaaaaatataaaattagttgggtgtggtggtgtttgtttatagttttagttatttgggattgaggtatgagaattatttgaatttgggaggtggaagttgtagtgagttaagattttagaattgttttttaaatgattgtgggagatttttgtttagttttgttagaagtaaaatgttgtatttgttggtttgttggaagtataagtttgtagtatttggggggaaagtaggaagggaagagggatttagtagggttttattattattaattgtgtttttgaatttgaaagtattatgggaaaatttttttttatttttgtttttgttttttttagttgtttttttgaggattattaaaaagtgtgggtttttggtgggtttttaatttttttttaggggatagagatattttagagaagtagggtaggtttgatgtatgaatttttgttatttgtattaaaaggagtattggttgtagtttgtataaatttttaaggtttatttgttagttgttttgatttaggaatttgtgtggtaatgagattagtagtttgagtttttgaatgatgtttaaggtaaattttaattttgatttttttatttttgttgatgagaatggtgattttattttattggtattaaagtataaggtttttttttttttataatgtattttttttgttgttgttgagatagtgtttttgttgtttaggttggagtgtagtggtaagattatagtttttgtagttttgagtttttgggtttaagggatttttttttttttgttttttaagtgtttggggattataggtatgtattattatgtttggttaatttttttattttttgtagagatagggttttattatgttgttagggttggttttgaatttttggttttaagtagtttttttattttggttttttaaagggttgggattataggtatgagttattgtatttagtttgtaatgtattgttaatatatggtatttagagtttgtaatagtgaatagttagttttttttagttttaggttaggttattagggaatttagatattagatgttttttagtttttattttttattttattttttaggaaatagatgtataaagtaagtgttttggtgttgttttttttatagtatttttatgtgtattttgaggataatttttgtatttgattttaattaattaggttttttaggagttggaatgttggttttaagtgattgaataataaagtggttttttttattttttttggttagtttaataaaagtgttaggtagttttttttttgttaatggatatttaatgatattttggtttgttggttttgattagagaaaggttagtttagggtagttggagttgaagaggtaaggatttttttaatgaggatataagtgagggatattggaaagattaaaagagaatggaaagtattgatatggtagttgtagggtgttagtgagtagttatgtttttaaattagttattttatatagaattttttaagtttagggttattggatggggttgtgatgtagttaagtagggtttagaaagtatataagtagttggttttattttttgtaagaaagtggtattatttttgttttgtaaatggagaatttgatatatattaagagtatttttagttgtggaaaaaagttgttagaatttgaggttagtttgatttttggtttttttgaaaattagtttttgttggatgttagatttagttttggatttattgagtagtttttgggtttttgatattgttaggtattgtgggaaaattataataggtatgtttgtgttgagttgtttgttaatttttaggagagatttggatattttggataattaagaagtaatataggttaggtatggtggtttatgtttgtaattttagtattttgggaggttgaggtgggtggtttatttgaggttaggagtttgagattagtttgattagtatggtgaaattttatttttattaaaaatataaaattagttaggtgtggtggtatatgtttgtaataattttagttatttgggaggttgaggtaggagaattgtttgaattggggaggtaaaggttgtagtgatttgagattatgttattgtattttagtttgggtaataagagtgaaattttgttttaaaaaaataaataaataaaaagaagtaatatagttttttgagaaagatgtagttataagtggtgtagagttgtagtttgtttatttttgttttttatttattgttgttttgaataagttagttaggaagttgtattgtattaaggtttttaaagatattagaaaatatttgtgaagttggaggtgattatttattaaatttgaatttttttaatgatttgtagtgtaaaatttttggagaaggtgtgtgttgatttgatttagaggaggaaaggaaaagaatgtttaagtgaagggattagtttgaatgtttgttaagattttgagaattattataagaaaatttttttgtggtgaaggtttagagatatgggattgtttttagatgagaatttataagttatttattgatttgtatagtttttttgagattgttaagtagttgatttttattagtgttgagttaggaattgaggtggaagttattattgtagatgtttaaagttaattattttaataaattgattagtggttgttataaaaaaaaaaaaaaaaagtagtagtaatatgggttgagtgtagtggtttatatttgtaattttaatattttgggaggttaaggtgggtgggttgtttgagtttaggagtttaagattagtttgggtaatatttgaaattttaatttattttttaaaaaagaaagaaatattatatttaatatttgttaattgatgattgtaatgtggtatgtttatataattgaatattattaggttattaaaaggaataaagtgttgattttatgttataatatggaggaagtttgaatatatgttaagtgaaagaagttagttataaaagattatatattgtatgattttattgatatgaaatatttagaatagttaaatttatagatagaaagtagattagtggttgtttagattggggataggggatggaggagtgattattatgggttaggtattttttgaggggtgagggatggtaaaaatgttttaaagtgagattgtggtgaatgattgtataattttgaatatataaaaattattaaatggatgaatattatagtatgtgaattatttgtttgttgtttaaataaaatagaaataatataaaatggaatgtaattgagtgtgaatttgtgtgatttaggtggtaattgttttatagaaaattagagatgagatattgatataaataaggttttttagttttttgttttgttttaagatagggtttggttgggtgtggtggtttatatttgtaattttagtatttgttaattgaagatgtaaggattgaggtgggtagattatttaaggtttggagtttaaggatagtttggttaatatggtgaaattttatttttattaaaatgtaaaaataagttagttattgtggtatatgtttgtagttttagttgttttagaggttgaagtgggaaaatggtttgaatttgggaggtagaagttgtagtaagttaagattgtgttattgtattttagattgggtaataaagtaattttgttttaaaaaaaaaaaagggtttttgttattttgtttagtggtatgattatagtttattgtagtttttaatttttgggtttaagtaattttgttttagtttattgagtagttgggattataggtatgtgttattaagtttggttagtttttaaatttttttgtagagatgaggttttattatgttgtttaggttggttttgaatttttgggtttaaatgagttttttgttttagtttttttaagtgttgggattgtaggtataagttattgtatttagtttttggatgttttggatggtggattttgagtagtttggggtaggaggattttggagtggtgttgatagtttttaggaaggagtaagttttgttatgttagggaggatgtagttgtgttgaaagtattttaattggggaggggggggggtgtggtggggagggatagtttttggtagagagaatggggttgggtggagagagtggaagttaattgtagggagttttgaaggtgaggtagggatgtggattttattttgtatatagggtagattttgattaggaaaataatgttaagtatatgatagtttggaagtaggagtttgagttgtagttttagggaggttatttaaaagattattttggttgggtgttatggtttatgttagtattttgggaggttgaggtaggtagattatgaggttaggagttttagattagtttgattaatattttttttttttattaaaaatataaaaattagttgggtatggtggtgtatgtttgtaattttagtaatttaggaggttgaggtaggagaattatttgaatttgggaggtagaggttgtagtgagttgagattgtagtattttattttagtttgggtgaaagagtaaaattttattttaaaaaaaaaaaaaaaaaaaatttattttgagatggttttggtaaagggataggatagagtatatttgagttatgtttggaagggaattggggtttaaatttgtattaggaggaaagtgagttggtttttgaggtttttatagattatgtatagtggagttttgtttgtatgttttggttgggatgggtaggaagttatggatttaagttggtattagttagagtgggttttattagggttagtgtttttttgttgtatttttttggggggaaataaatgtttgggggttttttttgttatatttttgtttttgggagttgtttttttttttgggattggttgtaataggttttgtgatgttagagggtaagaatttaagtttatttttgattaatgggttgtatagattataagttgtaaaatatttaattattgaggttatttgagggaaatgagatttgattaatagaagtgtttgttttgttttttaagagttgagtttaaattgtttttttttttatttttgtttggtaaaattatagattattaaaaatggaaagaataattttttttaaggtttataaaagtttatttttaattagttgtgtggtttatttatttttgtggtgttttttttgattggatttataaaaataaatgtgtgtaagtttagtggtttttgagtttttttaaagtagtatttttgtttttgataatttttatttaagataaagtttatgggttaatgtaggattgggtttgtaattttggtttttttaagagaaattattgttagtttttgttagttgttgattatgatgtgtgggatatttatttttatttttaaggtttttagtggaagtttgttgagtatttgaggaagattgtgttttaaataagggggagtgaaagagaaaagggagagtagaaaggaaggtagtgaagagttagagtgattgtatgtgtggtatttattgagtaagtattttttgagtaatttttgggtgttaggtattgtagtaggtgttggggatttaaaggtattgatgatatattattgtatttaggtttagaaagaggattgttttttagtgtgataggtgttaggagggggagggtatttaatttagattgggagttagtattgttttggaggagaagttattagttaggttgagatagaagagtgagtagtgagagttggatagaaaaaaattaggggttttgtggttattggggtagttgtgagttatagtaggggttgagggagaatatgttgttttagagttttatgtattggggagtggtagttgttttattgagttttttagggtgaataaatggtgagaaaagttttttttaaggttgtgggtgggatgtgggtggtaggtgagaggtggaagatgttaggagtatatttgaatattttaaaaggaaatagaaagtttatttttttttgtgagtgtagaggggtgtgtttaggagatgggtaatagtttaggatggtgaatttaggtgtgtttgggttatgggtttttttgaatgtgtgtgggaagaggtattggttaggggagggataggtgtttttggtggtattagattttgtgaggtgtagatattttggtgggtttagtgtttttatttagggatagagaaggatggggtatggggagggagagtggatggtggggggtttgagggtgtgtttagttagagggttgaggagaaaggatttttgtgtgtgatagtttttgttgttagagtaagtgtgggttttatggtagttgtggttttttgttttaatatagttaatagttttaaattttttgttttgatatttgttagtgagaggttttttgagttgatttttttttgggttgtttttttagtatgtgtatttgatgtgttgagggttagatttttattttttttgaattatatgtattttggttagtttttagttgataaattgtttttttttgatttgggtaggggttgttggggttttgaggggtggggtttgtttagttgttgttagggaagggtgaggttgagttattttaaaggaaatggggtgtttttttggtaagtggtaattttggtaaagaattgagtatttggggagggggtaattttggatataaagaagttttggggagggttgatttttttttttaggatgggggaaatgaaatgtgtttaatgttgttatagttgttttttaattttgtttttttttttttttgatttttggaggagtggggtggaaaagagatgggggtttttaggtagttagttgttttttttattgatttatgttttaatttttattgttttggtttagtagtttttagtaagtgatgtttaggatggtgtggttttgtgtggttagtgtaattttttttgttttttttttttttttttttttttgttttttttttttgttttttggtttttttttttggttttgtggtggttgtagtttagttttggggagtttttgtggaagtggagttttttttggtttattttggtgatttgttgtagttttgttgttggttgtgggatgatgtgtagagtattaattggttgtgggatggggtgtagttggtggaaagtaattgtatttgtattataggggaggaggtggaggtgtaggattttgtgtttgtagattttggtttttatgtttgtgtaattagtagttttttgggtagtgatattatttatttttttgttaatgttttaggttggtagttaagttttgtttttgtttttttttagatttattttttttagttttttttgttagttttagaggaaggtgaattttttttttttttgtgatttgtttttattttgttttagaaattgttgtttattaatattgttttttgtttgttgtgtggtttggtttttagagaggtgattaggtggggtgggttttagggttggagatttggggtttttaggatatattttggaggtgattgttagggtttttgggatgttaagattttgtgatttttttttattatagtttgtttagatttttaggaggttaagtggtgtttggttagtttttattttattatttttttgttatttggatttggtatttggtttagtgattagaggttttgaataggtggtggtatttttgttttgttggagaggaatttaggtgtattgtaagggagttgtgtgagggtagttagggagttttggagttttgtgaatttgggaatttgttatttttagaatgtgatttttataaaattaggagttgaggaagtggagttgaaattttttttatgttatttatgtattttagggtgtggatttggtagtagatttttaaaggtgataggaaggattggagaaagatttggtatgaattttgatgggtgattatatgtgtattaagtgtgtttttataagaaataaatatttattggggagaggtgttggtagttgttggggtggtgggtgttttatttgttttgattaaggagggtagtttttaaattttagtagatatatgttagaaaaattttgattgtggggtgtttagtttattttttggaaatagtatttagttatagtgtgtttagatttgtttgggtttttttatagttagttgtttaaagaagaatataggttgtttggttttagtatatttaggtggtattataagttgagaaagtgtttttgaatgtaggatggaattaagttaaataggaatagttgattttgatggaattatttagtgtgaaggtttttaggtagtgggggtagtgttttggggaaggaagtaaatatgtataggaattgtttttaaatagtttttattttattaagagattattattaagggagtagtgggattgggatttttatggggagggtgtttgtgtttatttggaattgtattagttttggtgaaatttaggggtttttaggaggaattttagtgtttttttttttttttatagatgtttttttttttttggaggatgatgatgatgatgatgatttttttttagaggagaaagaaatagataatattaaattaaattgtatgtgtgagatattgttttttattttattgttttttgggtttgggtattgggtttaagaggggaggggaaggttgaaaggggaggaagaggagggtatatggggttatggtgtttgttttgttaagtgttaggtattgtttataggtgttgggtagatgggtaagatatttttaggttttggtttgggttttgtttttgagtttgattagttgtttttttttattttgtttgttttttttggttttttttgggtagttgtagttttatattggatatttttagaaaagatggaaaagaaattgtatgtagtgttggttgttaagatagtgaagtttaaatgtttttttagtgggattttaaattttatattgtgttggttgaaaaatggtaaagaatttaaatttgattatagaattggaggttataaggtatgtgtgtgtgtatgtgaaagttagagtaatgggaataggggaggttgagttaggaagttttgattatatgttttttatttttttaagtaatattttttatttatataggttatttattaaaatttttaaatataaaaaaatgtaaataaagtttaaatatttttttagttttttttttgtaatatggtttttatatagttgattatattatgtatgtaatttttttgttttgttatttgttaatatgagtttttttttgatatattttaagtatgaatatttgaaatataattttttatgattgtataagattttattattttaaaattttataatttggttgggtatggtggtttatgtttaaaattttattattttgggaggttgaggtgggtggattgtttgagtttaggagtttgagattagtttgggtaatatggtgaaattttttttgtattaaaaatataaaaaattagttatgtgtggtggtaggtttttgtaattttagttattggggaggttgaagtaggagattgtttgaatttaggagatagaggttgtagtgagttgagattatgttattttattttagtttgggtgatagagtgagattttgtttttaaaaaataatagaaaaagttttataatttaatgaattattttgtgatattaggtattttttggttttttattataataaataatgttgtagtgaatttttgttagtatttttttaagtgtgtttttttaggatagattgttataagtgaaattattaatttaaagggtgtaagtattttttttttttttttagatggagttttattttgttatttaggttggagtgtagtggtgttattttggtttattgtaagttttattttttaggtttatgttatttttttgttttagttttttgagtatttgggatgtgtagttattatttttagttaatttttgtatttttagtagagatggggtttttttatgttggttaggttggttttgaatttatgattttaagtgatttgtttgtttgggttttttaaagagttgggattataggtttgagttattgtatttagttagaaatattttaaattaatttattatgtatttattatatgtaagatattatgttttaaatgttgtaagatagtgtttttgtttataaaaattttgtagtttgataggaggtaaatgtttatgagtagttattgtaaaaagtagattgtgattagtgttttggtaggtagagaggaaagggtgagtatagttttgattagagattggattggaggagatggtttttgaaatgagttgttaaggatagtgggggttggatttttagtgtaataggagaggtgtatagttgggaatatttttggtgtatttgggagtgtttgtagaaggtatatttgtttggattatgaatgattttgaatgttatagtggagatttttggagtttttatattttatttgttagtttgtagagtgtgaatgggttggtaggggggtaatttatgttttgttttagttaattttgtagtttggggttttgtgttattaggttttgatatggagggtaggtgttatggggtgttgatattgttatggggtttgtatttttttttggatttttaatgtatttttttggtatttttttttaggtttgttatgttatttggagtattataatggattttgtggtgttttttgataagggtaattatatttgtattgtggagaatgagtatggtagtattaattatatatattagttggatgttgtgggtaagagggtagaggtagtaggaggaatgagtttagtgggaagagttaggtttggagaatatagttggggtgtttaggttttttaggggtagagttaggatagtgattggtattttttggttttgttattttgagtaggttattttttttttttgagttttattttttttatttgtaaaatagagttaagattagatagtaatatggttaaagttggttgttattgtgaaattgaaggtgttgtttagagtttgttttgaaggaggtgttgttggagaggtgttaaatgtagtgtaataggagttgttgtttaatgttagtaagatgttaggttttttaaatatttgttttgtaatgtttatggtatatttgtaaggtgggtagtattagtttagttttgtataggagtataggtgtataggtttagagaggttagatattttgttaatgtagaattgtatatttgtgttaattttagggtattataggagattttgggaagaatattgagttttttggagttattattgtaattttttttttttaggagttttgaaatttattttttagagattattgggtatagaattttttagttagtgttttttttgattatgatgatatggtttaagaaggagattgtggttaggagtagtggtttatgagttttaggtggtatgatgggattatttatgtttgtgattttattattttaggaggttaaggttggaggattgtttgaggttaggagtgtgagattagtttgggtaatatagtgagattttgtttttataaaaaaatttaaaaattagtttagtgtagtgttatgtatttgtagtattagttgagttaattgaggttattgaggtgggaagattatttgagtttaggaatttgaagttgtagtgagttatgatgatatttttgtgttttagtatgggtgatagagtgagattttgtttttaaaaaaaaaaaaggtaaaaaggagattttgatttaagaggttggggtaagatttgagattttgtgtttttaataagtttttaggggatgttggtagtattgtttgtggattatattttgaatagtaggagttaaagtgattttggttttttaaggaggagtaggttgtgttgaggtttgggggtgtaattgaattagaaggttttttattaaagtatgagtgatttattgtgattgtaaatatgatgattgttttggggaggaggattttgatggtttagggtttgaagagagggtgtttttttttttagttttgttttgagaggtttgggtttagtagaagtgttgggaggtttataatttattattgggaaagttaagtggggtgtaggtgagtttatttttttttagttatggtaaggtttttatgataagtgtttttttttttattttttatagagtggtttttttattggtttattttgtaagtagggttgtttgttaataaaatagtggttttgggtagtaatgtggagtttatgtgtaaggtgtatagtgatttgtagttgtatatttagtggttaaagtatattgaggtgaatgggagtaagattggtttagataatttgttttatgtttagattttgaaggtaattatggtattagtttttgtgggttagtttattgggaaggagattattgttttgggggtttaagtttttgtgggtaggtttagttgtttttgaatgggattattttttatgttttaggtatatatattttattttagtagggatttagttatattttttaggattagtaatagaggttataaagtggaggtgagttgggaatagagggttgtagggatgggtggtgttggtttgtaataagttttgagagtaatgttattggggttttggggttagttatataaggaaggtatttggatttttgtttttttattgtttgaaattagagtttttttattaagtgttttttagttttagttttgtgttttgagttatgtatgatttttttggtaaatggggtgtatgataagagtattttttatgaagagttggaaaaataaatgttatatataaattttaagttatatgaggatgaggagtaatggtattttttttttttttttttttatttttagatatttattgtttttgaatgttttattaatttagggaaggtaattgtttaaatttttagtggattttgtaataggaaggaattagaagttgggaaagttgtttatttttttgttttagagttagattttatttttttttagtttagttgttttagagatatattggttttttttttttttttttttgttgttggtgttaaaattgttttgtaggttattggttattgtttttatttataatttttgttttagttttggagggagtgggttaaatataaatagaatattttatttgaagtagtgattttttttttttttttttttttttaattaaatgttttggatttttgaagtttatttgttttgtatttgtaaaagggaaagaaggttgggtgtagtggtttatgtttgtaattttagtattttagattatttgaggttaggagtttgagattagtttggttaatatggtgaaattttatttttattaaaaatataaaaattagttgtgtatagtggttggtatttgtagttttagttatttaggaggttgaggtaagttaattgtttgaatttagaaggtagaggttgtagtgagttgagattatgttattgtattttagtttgggtgatagagtgagtgagattttgtgttaaaaaaaaaaaaaaaaaaaaaaattaaaagggaaaggtaataaattttatttaatatttttttttgttttttgggtttgtttgaaagttatatgggagtaatgtgtgtggttatattttagttttgtttaattgattggtgtgttgttggtttgttttagtatttggggattaatagtttggatgtggaggtgttgattttgtttaatgtgatagaggtttagagtggggagtatgtgtgtaaggtttttaattatattggtgaagttaattagtttgtgtggtttattgttattagatttgtggtaaaaggtaatggggagatggatgggattttgtgttggggatttgatgtaggttttaagttgttggggtaggtggggaagttagtattggattgtttttgttattttattgtatttttagtgtttagagttatggaaaaatatttggtttgggaggttggtttggtttggtattgtgttggtgtttgtgggttttttttttgttttttgtgtgttttttggttttgtgtggatttatgtgaggatttatggggatatggttttgttgtgttataaatggtattttagattgaagttgtgagtgagtggtgattaagagaaggggttataggttaggtatagtggtttatgtttgttattttagtattttgggaggttgaggtgggaggattgtttgaagttaggagtttgagattagtttgggtaatatagtaagattttatttttataaattaaataaattagttaagtatggtggtgtgtgtttgtagttttagttagtttgaaggttgaggtaggaggattgtttgagtttaggttgaggttgtagtgagttatgtttatgttattgtattttagtttgggttgatagaatggtattttattttttaaaaaagagagagaaggggttaggtatttttttgtatatttgtatttgttggttgtgtatgtatatgtgtgtgtgtgtatgtgtgtgtatgtgtgtgtttgtagtttttgttattttttttgtgtttattttttggttatttttatttgaaattaaatagtttttgtttgttggttttatttttttatgttgtttattgtttgtatgtttggatgggttagtggttgttagtatttggtgaagggttgtaattagttattgtttttttaggtttgttggagttttttttttagggttttattttttttttttaataggttttgttgtttggtggtttttgtttgttttttgttgtaaagaagatgttagggagtatttttttttttagttttttttttttttgttttttttttttgttttgtgttttttagaggttttatgttttgtgtttgtttattttgtttttgttgttttttttagattgttggagttaatattattgataaagagatggaggtgttttatttaagaaatgttttttttgaggatgtaggggagtatatgtgtttggtgggtaattttattggatttttttattattttgtatggttgattgttttggaaggtatatattgtaatttttttttttgatgttttgtttttgttatgggtatggggggagtatgtatttttaggtttggggagatatagaggtaggagagttggaagaatgggtttttgtttgtttggtgttatattttgttttagttttgagggttgaatttttttagtttagagaagagtttttttagttttgtaggtgtatggaggttttttatttgtatatttgtttttgttttttttttggttattgtaatgtatgtttgggatttgggtttattttgtagtttgatttttttagggtaggttttttttgtttttgggtttagtagttttttttttttgttgggtattgagtatttgaaaagttttagatagggttttatattttttttttttttttaagtgtttagtttaggggtggggtttgttgtttgtaaagagtagtttatttttttgtattgttattttattgtttttgaagaaggaggttagtttggataggtgaattgagttgtttttagaaaggtttgttttaggtagttgtagtaggttttatgatgtttatgtattttgtttgtttgttgttgtttttttttttttaagaggggaggtttgtgtgttgagttagggaggaaggagtttgtagtttgtttagggtggtggttggtgattgtggggttagggtttgttgttgttttttggaatgttttgtatgtgggtttggttgtttttgttggtattgttttttttttttttttttttttttttattttgttttgtttgtttgttagggtttttggatgtttttgttggaggtagagaagtgttttgtttttattattgtttttgttttggttttgtttgtgttttttatgtgtttttaattagttgtttttgttttttaatattagggaaagaaaaaatagtaatatttttttttgttattagttttgttgtttttttgttaggttttgggatgttttttgggtttagtttagggttgtgttttatgttttatgtttttttgggaaggtttttaggggtgttgtttttatggttggttggtgggttttaaaggggaaggttgggaggaggtttgtggaaggaggagggttgtttatatttgtggggtaaagtgtgttttatgaaattagtgttgtgtgtgttgggatgaaagttttttagttttttgtgttgaagggaaaggtggattgaattggtttagttgttgtggtaatggggtggggggtgagttttaattagaaggtgggagaagagaataataaaatggaattttgttttttgttgttatatttttttaagttttaggagttggggtttatgagtagaatttgaaagaattattaaaaaagtttatttttggaaattaagttagttttgtttgtggtttggttaggaataaatatttatttgtgtgtttttatagagatgatatagatttaaagtgggatattgagtaaggtataggttggttttttttttgttttttgtttttattttgtgagtgttattattattaggtattgtggtttgtagaaataaatgaggtattaattttgtttttagggattttgtgtttttttagggatagaggatttagaaatatttgtgtttttgtatgttaagtgtatgtatatagtgttgaggttttgtagagaagggttatggttttttgaggagattaagaaaggtatatagaagtgattttttagttggtttttgtaggatttttgggtgtttgtatttttttagtttagttgagtaaggaggtttaggaattaatgaagatggggtttgtgtagtatgatggttttaggttattttttttttatggtttaagtttattgaaggtagtttttaaaattagggggttgtttgatttttttagtgttataattttagttttagttagaatttgttatggtttttttttttaaaagtttttaggggataggagataggtgttgtttttttaatggagtgggattttgtatggatggggttttttaagtttgttaatattttgtttgtattgatttagttttggaagagaggttggtagtgatgattttgtttttgtatttggagattattatttattgtataggggttttttttattttttgtatggtggggttggttattgtttataagatgaagagtggtattaagaagagtgatttttatagttagatggttgtgtataagttggttaagagtatttttttgtgtagataggtaatagaaagtagatgggggatttgtatatttagtattatttttttttttgggtttttaatgttttgttttttttattgtttttaatttatagttttgggttttattttttggtttttgggtaaggtatagtggaatattatgaattaagtgttttagagtttgttttaagttagtgtagtttgtgaattttttgtattttttatattatattgtaagttttttggatttttgggatatggattgggaggaagttttatttggatagaatgtgtagttaatagtatgaatttgaattgtttttaagggttgtttagaagtgtagagatgtagggtagagaagagaattgtttgtattagtttatttttatattgttgagaaagatatatttaagattgggtaatttataaaagaaagaggtttaatggatttatagttttatgtggttggggaggttttataattgtagaaggtaaaaggtatgttttatatggtggtagatgagaagagagtttgtatagggaaatttttttttataaaattattagattttgtgagatttatttattattataagaatagtatagggaagatttgtttttatgagttaatgattttttattaggttttttttataatatgtgggaatttaagatgagatttgggtggggatatagttaaattattttagttatattatatttttgttttttgtgtgtttatttttttttatgggaggaaatggtatagatggtataggtgtgtgtaagaatgattgtttttttagaagtttgtgtttattttggaaggtgttttgggagttaggaatttataagttaaggtaaagtatttgtaaagagttaggagaatagagttgttattgtaatgattagttataaaatgttaagttggaagaggtgtatttggtttgtttattttaaaggtgagtgaagtttagaaaggttagtttgtggtagaaataggttagttttagaagttgggttttttggtttattatggtttttggattattttgtgttgaggaaagaatattagatatatagatatgtgtttttgttattgttgggaagttttgattaagaatgggaaggagttattttgttttttttttttgttttagggtgattttatttttttttgtaggtgtttgttgattttagtgtatttatgaattttggggtttttttggtttggttattatggtttttttttagtgggatttttatgttagtaggggtttttgagtatgagttttttgaagatttttgttgggagttgttttgggataggtaataatattttgatttttaattttttgaaggtattttttgtttgttattttagtggtggaaggtgtgtatattaatattttttgggtggtgaaggtttatgaaatgtttgtagaaatatttattttattttttgtttgtagttgggtgaaatatagagaggtggagatggggtgttttttaaggtttgaattttattagttttaatttatgttattttttgttttttttgaaagattggttttaggtaaatttttgggagagggttgttttgggtaggtggtgttggtagaggttattgggttggataaggataaatttaattgtgtgattaaagtggttgtgaagatgttgaagtgtaagtgatgtttttgtttttgtaaagaaaattttgttttattttaagtaaatagtaggttttgggtttagtagaatagtttttttggtgtttttgttgtttatatttgttttgttgtttgtttggggttatttgggagtggagggggtgttttgtattttgagattgttttatgatgttattttgttttttggtgttaatttgggttgtggttaggtgtttattttggatttattgtttgtaggttttttttattatatttttgtttatttattattatttattgtaataatggtttttatgagagggaagagaaaataagtttggatgaagtggggaggagagaattaagttttagggaaaagtagttttttgatatatattttatttttttagtttttattttgtttttttttttttttaagtaaatgagttttaatgtgttttttaaagtggatgtaatagagaaagatttgttagatttgattttagaaatggagatgatgaagatgattgggaagtataagaatattattaatttgttgggggtttgtatgtaggatggtgggtgttggttagattggttttttttgtttagtggggagaagatttgagttggggtattagttttaaggttttttttagttatagttagggaagggggttaagagaggttgttttggtagaggtttaaaatgtgttattttgggatttgggttttgtttattggtgtttatttaggaatatagatatttagatttatatatgtggtgtgttaatagaggtagttgagtaattatggtttaagagtgtttaggttgggtgtagtggtttatgtttgtaattttagtaatttgggaggttgaggtaggaagattatttgagattaggagtttgagattagtttggttaaaatggtgaaattttatttttattaaaaaatataaaagttagttaggtatggttatgtatgtttataattttagttatttaggaggttgatgtataagatttgtttgaatttgggaggtggaggttgtagtgagttaagattatgttattgtattttagtttgggagatatttttgttgttttaaaaataaaataaataaataggttaggtatagtggtttatgtttgtaattttagtattttgggagggtgaggtgggtggattatttgaggttaggagttggagattagtttggttaataggtgaaattttatttttattaaaaatataaaaagtagttgggtgtggtggtgtatgtttgtaattttagttatttgggaggttgtggtaggagaattgtttgaatatgggaggtggaggttgtggttagttgagattgtgttattgtattttagtttgggtaatgagtaaaattttattttaaaaaaaaaaaaaaaaaaaaaaaaaattagttaggtattgtttatgtttgtaattttagttgtttgggaggttgaggtaggagaattatttgaatttagaaggtagaggttgtagtgagttgaaattgtgttattgtattttagtttgggtaatagagtgagattttattttaaaataaatagataaattggggtttttattttaatgttgtttgggaattttttggattatgttgggagtaattatttttttgattttttttgggtagtagaatggattttttaggttttttaagaggaggtaggagatgggaggttggttggggtgtgttgttgggggtggggtttttttgaggtgaagttaaatttgtttatttgttgttggttttatggtttttttttttgtgtttgtaggttttttgtatgttattgtggagtatgtttttaagggtaatttgtgggagtatttgtaggtttggaggtttttagggttggaatattgttataattttagttataatttagaggagtagtttttttttaaggatttggtgttttgtgtttattaggtggtttgaggtatggagtatttggtttttaagaaggtgtggaatttgaaggtttttttgggtaatgttagggtgggaatagagtttttttagttttttagtttgtgatttattattttgtggtggtgttgtggatgtattgagtattggttttgtgtgttttgtgtgttgttttaggttttttgggaattgtagagttaggagtattagtgtagttaggtggttttggggttagattgatgtagggtttgatttgtgtattgttattttttgtgtagttttaggtagttatttagtattttaaaattttttaaatataaaataataataatattagttgggtgtagtggttaaggtgggaggattgtttgagtttaggagtgtgagattaggttgggtaatatattgaaattttgtttttaaaaaaaaaaaaaaaattaaaaaattagttgggtgtggtagtgtgtgttgatagttttagttatttgggaggttgaggtgggaggttagtttgagtttaagagtttgaggttgtattgagttatgattatattattgtattttagttggggtgatagagtaaggttttgttttaaaagaaaataaagtataataatatttgttgtagaattgttatgaagataaaatgaaattgtttgtgagtgttgagtgtagtgtttggtgtgtaagggttggtttggtttgagtttagttttatgtggatttgttgtgttgggaggtaggatttaggagtatgtattgttgtagatgtagtagaggtataaggggttagtttttggggaaggaagggaggagtgtttgttgtgatgagaagtttggagttggtagagaatgttagaagagggaaagtaaaggtttggggggtagagtagtgtggtagaagttttatgagataagttggttagttgtatgggtggtggttgtttagagttttttagtttttttatttttttgttttttgttttttttttttttttttttagtgtatatattgagatttggtagttaggaatgttttggtgatagaggataatgtgatgaagatagtagattttggttttgtatgggatatttattatattgattattataaaaagataattaatgtgagtgttgataaggttgttttgtgttggtggttttatttgagaagtaaggagtggggtgggttgagaatttattttttagtttttttttatttgtgtttttatggttttgtttggggttattttaattttttttgtgttgtttttagggttgattgtttgtgaagtggatggtatttgaggtattatttgattggatttatatttattagagtgatgtgtgagtttgtaatagtaattgttagggaggtgtgggatagagagtttttagtattgtagagttttgttttttttttggattgaggagttttttttttgttttagagagaaaaataaaatattgtttgtggttattttttttgttttagatgttgaaaggttgatttgttttttatgttgttttttggtattgttttgggtagaggatttgtgttgggggaggggaggtggagaagttttaatattttgtggttttttgtttatttgtaggtggttttttggggtgtttttgtgggagatttttattttgggtggttttttatattttggtgtgtttgtggaggaattttttaagttgttgaaggagggttattgtatggataagtttagtaattgtattaatgagttgtaagtttgaggagatgttggaggttttgagttaggttttggggtaagagtgggtttgaggggtagggggttagattagagagtatttatttttaggagatgtttttgattttatagttttgttgtaggtatatgatgatgtgggattgttggtatgtagtgtttttatagagatttatttttaagtagttggtggaagatttggattgtattgtggttttgatttttaattaggtaaggttgtttgtgttagagttagagtttaggttgtttttattgtgtgtatgtatttttttgagtagggaggaggggtttggtttattgttgtttttttttgtttattataggagtatttggatttgtttatgtttttggattagtatttttttagtttttttgatatttggagttttatgtgttttttaggggaggattttgtttttttttatgagttgttgtttgaggagttttgtttgttttgatatttagtttagtttgttaatggtggatttaaatgttgttgattgttatttatatgttttttttagattttattgttagttgtaatttttatttatagtttttgttgggtttattatttgtttgtttttgtttttttttttgttggtaggagttggttgtttattaggggtttttttgtgtggtttgtttttattttatttagtttatttttttttttattttttttttatttgttggtgagaggtgtaaagaggtagatttttgttgttagttattttatttttttttagatgttggattaatatttttttttgttattaggtattgtttggagggtagggagtgggagttaatgaataggtatgtaagtgagagttttttgagtttttttttgttggtttggtttgttttgtttttatttataagttttttgtattttggtggtaggtgttttgtttttagggttatagtagtagggaggttagtgttttgtgttttgattgaaggtgatttttgttttagataggtggtgttagtggtttattaattttgatattagtttgttttgttgattaaatgtttggtattagaggatggtgaggtgaaggttaggttgggggtagtgttgtggttttggggtttagttttaaattgggggttttgtatatagttatgaagaaaatataaagtgtataaatttgagtatatatttatatgtttttttaaaagggttgttattagagatttatttattgggtaagatgtttttggtggttgggaggtattagttgttatatattaaaaataaaaaagaaaaaaaaggaaaatgtttttaaaaaggttatatattttttgttatttttgttgttttatttttttaaattatgttttaaatttatttttagtttaggttttttaataaaaattgttgttgttttatttatttatgggttgtatgaaaagggtgggaatgtttattggaaagaagggatatttatgggttttggggttaggtttgttttgagggtattgtatgtttttggtgtaggttttttgtaattttttttttttaggttttgtatttagattttatgatgtattttttgtttttttgttgtttttggaaagttagaaaaagaaga

SEQ ID NO: 46 - DNA, 53638 bp, Homo sapiens
ttagtagataaggtgagtttttttgtgtttcgtggtaaagagtgcggtgggtgatattgatttatggttaggtaatttggtaaggaaagatttcgttgtaatatatttgagtaacgagattaaaggaagggtttgttgttacgaggcgaagtttgtttttttgaatagagagtttagtagagttgggcggtaatcgtgtttagtattgaggtcgaggagaaagagagtaggagtattatattattgtattaagagtaggaaaatatgatgtatgtttgggattaggtaatcgaaatttttttttagtagcgttttttaaagtcgggtatcgttttttttcggagaaggcgtagagtttttagattcgggttgagtcgtatttttattttttttttttttttttcgtcgttaaatatagacgagtacgtgagcgtcgtagttcgttttagttgtgttttagttgatcgttttttgattggttgagagcggcgtgggttggggtggggatttgtcgtttgcgtcgttcgttattggatttcgaggaattcgtttttattttaggtgaggcgggtttgcgggagcgcgcgtcggtttgggtaggcgagcgggcgcgttttcgttttttttttttttttcgcgcgttcgagcgcgttttcgtttttgttcgttttttgacgttgttttagttttttagtgtatagtgttgtttcgtttgaggggataggaggattatttttttcgtcgtttcggttagtgtgtcgggttgggttttgataagttatttgaggagaggttcggagtcgggttcggatttcggcgattgtcgttcgtttttttttagttttacgaggggtttttcgtttcgtatttttatttttggatttgtttttttttttttttttcgcgtgtggagggagttagcgtttaggtcggagcgagtttgggggtcgttcgtcgtgaagatatcgcggggatcgatttattatggagggcgtcggcggcgcgaacgataagaaaaagtaagtttattttttcggttcgtcgttttttttttcggcgatttcgttcgtttgttcgttttgggtttttgggtcggtttcggcgttaatgggattggggggggtagtttttttgtttttgttgttgttttttttttttttttttttttaatttcgtcggtcgggttttttcgttgtttacgtcgttattttgtcgtggggggtgggagacgtttcgaaagtgtttttaggggtcggggtttgagttttgtttgtttttttcgtcggtcgtgggggtttcgcgtcgtttatttattcgttttaaaaatttagtttgttttgtggttttattcggaggggattttatttagtttgaaaatttcgggaagagaaatgagttgtagttcggtagtcgcggtttgtattcggagttttcgttttttttcgtttttattttttttagttttattgaaaattcggttttggggcggattttgtacgttggttttggttttttagtggatttggggttttgagttttcgattgagggattcgcgtggtcggatgcgattttgttttgtagttgtttagtcgtcgcgggtgtttttgtttttgtgtattagggatttgtcgcgatggttttaagatgcgaattttttagtttgtacgtgtaggttttgtttcgttttaatcgttttgaaaaatttgtttagattgagagttagagtaatgggaatttagggaaatggtaatattttaaagagaattttagaattggatatttgagtttatattatttgttacgagaacgtagatattataaatgaatatatgttttatttattttttaaataatgaaaatgtaggggttggttaaatttaggtagttttaatgatattgaaaaaagtatatgatgagtgaatgaaatgcggtattaaaatgttgtaaaaattttcgaattttgttttatttttttgaaattgaagtatattaaaggaaaatcgttaatatatatttaaagtaagtaattattcggttagaatttaatgtaagttttataaattattttgaagtttgagtttaaggggtatattagagattaagaattgtgagttggattagtggtgttaagagcggatttttttattttttaatatatatataattttgtttattttggtattttaatttttaaggaaattatttaaggaattgaagatttagagtaagagttttggttagtagattggttttgttgttaaatttttttatttttttggtagagagattaatttttttaattagtattagtagaagataaatttgtttatatttttgttgttttgtagatttttttttttggtttttttttaatagaatattaaatttttagtttgtatatagtagagaaggttatttataaaatttaaaaagtgagtaaataggtttagattaattttaagagttattaggaattaattgtagtttattttgcggaggtgattatagtgtttttgatgaaatgataaagttgttatattgtaaatttaaggtagattatttttgtgtagtgttagttttttatttttattatatattgaattatatttaatataatgtattaaattatgtattattttttttatatatagtatcgaatttattgttttgttatttattcgtttagaatattagaagtagttttgaaacgaattaataaattagttattgtttattagttttaattttaaataagtttttagattttttttagtttatttgttatttttaaaatttttttatttgaaaatttggtaattttggattggatggatttatattttttagtatagaagtttttgatataattgaaaaattaagttaaatatttaataagtggtggttatttagtatttttagatgttgtttataatagatgattttttttaattaatttatagttttttgaaagataattgagaggttgagggacggagattttttttaagtaatttttttttttattttaaatgagtttttaatgtcggagtttggaaaataaatttgtttttttaaaagaaggtttaggaaatttaaaatttgaagaattggaagaaattagaatagaaaatgggtatggttatgatattgtagatttaacgtaggatattttatgttgtttttagttataggggttgaatttatttaatagtacgtgtattttgatttttagatttttaagggaatgttaagagagtaatgattttgttttaggttttaggttagatttttttagagttttttaaaataaataattattgaattattaaagtaaaatttttgagaatagatattttttaattttttttattaattttggttattaaaagttaagaagtttttttatttattagtaaatttttttttttatgattttattttgattgtttttttgtttgaggaagtagtatatggtggttaagagtataggatttagaggtagatatttttgagttaagggttttagttttttatttgtgagtttgagtaagttattgaatgtttttgagttttttttttttttttgaaatgatgataagaatagtagttatttgagtagttattgtaaaggttaaatgagataatgtttgtgaagtatttagtttattgtaggagttttgatgatattgtgtatttgaaaatagatgttatttgttaaaatttttgtttaaatttttataatttttaaaatttttttttgttagtttttttagttgttttttttagttttttttttgtgtttttatgtattttttttattttttgaaagtgaaaagattaatattggatttagagtttgaaaagcgttttttttttgttataatgggtaaaagagtatatttttgggttatattggtatttagtattagttattttttttgagtatttgatttgttttttattttagtggaggttttttgttttataattgtttatttttgtgttttttttttaaatagaatattgagtttattttggattttagagttaaatatatatagtattttagttttattgtttatttaagtaagatatgtgtaagatattgtatttttagtattggtagtaagttaaaatatttttcgttttgatgttaaagtttagataattttataaaaattaatttttgtaaaagataatgagttgataaaatatttttagtaaagtagttacgtggtagaaaaattgttttttgtttatgagtttttttagagttaagattattgggttttatttgaaggtaagattttaagtttgttttattggtttgttttgtggtttaatttgtatgaagtttatgtatttttttatacgtgtgtatttattgaattatcgagttattttagattgagaaagtattggagtttatttttacggtttattgtagagtattttgtgtagtttggagaatgttaatttttttatttgttaatttttattgtttttatttttaacgttattgtttgtgattttaatggtgttacggtttagggtttagattttgtggttatattttatttttgtatgttaagagtggtgtatagaaagttgagggggattatttagttttttgattgattttttttttttttttgaagaatttagtttattatgtttggtggtgaaataaaaattgatgtgtatggatgttaaagatttgggttaaattgtgtgtttatagatgtttttttttagtatataattttttaaatttagatatttaaaatattgtatttttttatttaagattaatataagtttgttttttaattaggataaaaaaatttaaatttaaatgtgatgttggatgagtttttaattaagaaattgattttttaaattttgtgattagttatttagtgggtggattttatttagtgtgtgtatgtgttttttgtttaattttggaaggttagaaagagaatttgaaattaagataagttaagttttttgttgtttagtatttttggtaaaaatatggttagattgtttaaattaattataggttttggaattttaaaaataattatattttttggttttttgatatattaagaattaattgttttgtatatgcgttgagtattaatgtttatgttttttgtagtagaaatttataaatttttatttatttgttagatatgatttttttagagaaatttagtatttaaaatttgaatttttaaaataaaatttaaaatttttgttttataaaaataaaaatgtgattattttatggttttttttttatagtttttgattgttttttaaaatcgtagtttaaaaatattaatttaaaatttattattttaattatttttaagtattgtttagtagtgttaagtatatttatattgtgttattaatttttagaatttttttattttgtaaagttgaaattttatttattaaataatttttaatttttttttttttttagtttttggtaattattattttattttttgtttttgtaaatttaattattttagatgttttatataaatagaattatagggttttaatatttttgtgatgggtttattttattttgtgtaatgtttttaaggtttatttatgttgtagtatgtgttagaattttttttttttttgagtttgagtaatattttattatatgttttatattttgtttttttatttatttagtaacggatatttgggttgtttttatattttggttattgtgttgttttgaatatgagtttgtaaatttttttttgaagtttttattttttttggatatatatttagaagagggatgttggattatatggtaattttttttaatttttaaggaattattatattgttttttatagtagttgtattagtttatatttttattaatagtgtataagggtttttatttttttatatttttttaaatatttgttttttttttttttttttttttttttttttttttttttagttatttaatgtggtaaagtggtagttatttaatatgttgaagtgattgtttttaagggtttgtttgtggataattaattagttgaaagttaattatagtttgttagtggaagttttaattgaaaggagagtaagtatttttaaaaggagaatttaatttttttagtgatttagatttgttatgttagtatttttttatagaaatattttttgggtaaaatagtgtatatttgttttattgttgataaagtttaatttaattaggaaatttgttttttaagatttaaaataataattgaaataatgtatttttattaaaaattgtttttaagatgttagtttttagttgttttggtgattttaattgttatttatgagtgtttttttattttaaaattttattttaatcggttatagttttaattataaagattattttaatatatgattttgaaaatttattattttgtaaatgggaaaatgtagtgatggaatatagtttattgtatgtagttttttatttgtttgaaaagttataatatatttaggtaaattaatttaaaagtgtttagtatttaatattgtaatttttatttattaaggataggtttttcgtgttttttttttttttttttttaagtagtttgggaggatttgtttttttagttgaaaaatattatggttaaaaataaggtttaaaggcgaaagttgaagtttttgagggttgggatacgtttttgtttttaagagttttgtaaatttagatgttaagtaaatttttttaaaatgatttttattttttttttttttattataaaattggatatgttttagtggattaaattttaagtaggttgaatttgaaatttgtgggttgggcgcggtggtttatgtttgtaattttagtattttgggatgtcgaggtgggtggattatttgaggttaggagttcgagattagtttggttaatatggtgaaattttatttttattaaaaatattaaaattagttaggcgtggtggcgggtgtttgtaattttagttatttaggaggttgaggtaggagaattgtttgaatttgggaggcggaggttgcggtgagttaagatcgttttattgtattttagtttgggtgatagagtaagattgtgttttaaaaaaattaaaaaagaaatttgtggtgtgaatattggtacgtggtgtatatagtgagtttttaataagtatttgaattaataaatgagataatgattgaataattggatgaataaagagaatgtaggtttttaaaaggtttttttagaaatattgtcggttcggtacggtggtttttgtttgtaattttattattttgggaggtcggggtaggtgaattatttgaggttaggagtttaagataagtttgattaatttggagaaatttcgtttttattaaaaatataaaaaaaaaaaaaaaaaaatagtaggatgtggtggtatatgtttgtaattttagttattcggaggttgaggtaggagaatcgtttgaatttgggaagtagaggttgtagtgagttaagatcgcgttattgtattttagtttgatgatagtgtgagatgttgtttttaaaaaaaaaaaaaaaaaattaaaaagaatgttttaattttttagttttttgtttgagatttattgattggtaagaagaaagttaaagaattttttttgattttttttgatatagatatttaaattttattattttatagtaaggttggggtttattttttttgttttataatagaagagtattgattattttttttgttttataatagaatattatttaaataggagttttttgagtgtgtttataattatttgatttggttaaattattttaatgttaatgaaattttaaaattttggaggaaaaaatttaaaaattatataggtgtataaagaaataaaaattatttgtttttttattatgtagagattattgtttattattttttaattttgtgttatatttgtatgttaataattgtaggattagggattgagtattgtttttaatttgtttttaaaaaatttatatttatatttttttttatttaaatagtgaggaagagtattagaattttgtaggtttgtggtgatggttaaattagataatattaatgttgggtatttaatataatatatggtttttaatattttttagattttagatatagtttgttttattattattgtttttttattaaatttatttttaaaaaagtgagaaaagtgttgagattataggcgtgagttattatgttcggttttatggtttttttttaataataaattagaagaagtagaattatagggttaaaaagtatttattttaaagtttttaatgtaattgtttgtttattttttagaaagtttgatttagttgtattttagagtgttatttttttgaattttattattattaaagttttaaatttggaatattggtaatttgataagtatattaggattttttttattgtaagtagtaaaatataatttaatttagtttaagaggggaaaatgtagttattggttaatataatttaattttggtttaagagataaatttagagttttaaatgattttagagtgtaataatttttgatttttgttttgatattatttggtttgtatatttttgttttatttgtatgttggttttattttgttattgataggttgtttgtatggtgtggaagaggacggttagtatttttatatttgtatttatatagtttgtaatataaaaaaaaaaaaagtaaaaaaaatttttttttttttttagtgtttatatattagttttttagaagaaaacgttttgttttatttggttatgtgaatggagttttttgattatatgagttaaatatgttttattgtagtatatttgatggtttttttgtagaatattattttattatatatagaatttttgattagtaattaatgggttatgagtttttgttgtaagttatttgaatttatattttatagttttttattaagtgtagttattttgtaagttgtttttgttatgatttttgggaagttgagtattttttttatgggttagggtttttattttaagaaaaagatgatttttttttttattaaatatgtgttaagattatatatttttttagatcgtttagttttattgtgtgattttatataaattgttttattgggatgataagaataattgttttataggattgttatgagaatgaaatgatatattaatttatatgaaatatttagaatagtttttggtataaagtaagggtttaattaagtagaaattatttatatatttataatattatagtattggttaagttgtttttaatattgtttagaatcgtttaagttttttttgtgataatttgacgaaggttatttattattagtgagtaaataatagtggtagaatagttattgatgttttttttttatttggttttttttttataaatatttggtttttgtagattaaatattggtttatgtatagatatgttattttaaaataattttttatagtggtaatattaaaggaagaaaaatgtttttaaagttatttatttgggatgttaaaggagggggaaattaagaaagtttatatttttatgttttttgtgtttagaattttattaaatgttttttaatttgttagtagaggaaagttggatattgtttgtttttgtagttaatatagttaaaatatttaaatggttatagtgttaaattagtagttaaagtttttattgtgaatggatgaagggatatttttttgaataatttaagttgatttattttagtggtttaaaaaatttttttaacgtttaattatgatttaggtatttaattattatattatgttttgtaatagattgttgtgtatttatttatttaataggtatttgtgtagttaatttattgagtatagtattgaatcgttgatggtttaggttatagttgaatattttattttttatgtttatttatttatttatagtatattttatttttaaatttttagtttattgtattttaaagtttgaggtttttgcgaagtatagatttttgggtttaagttttgttatttaatgttaattattataggcgtattggttagtttgtttttagaatttttagatatatatatataaaatatttttataagataatttatttatttttttttttatttttgtgttttttaatataggattaatgtttagattttttttggagtaaaataattttttgaatttttgagatgtatttagtgattttagtttgagtatgtatattgtattaaaaaatgtaattttgttttttttagtggttatttggtaatagtttgattataaataaatgtagttttaaatatagaaggtttgaggtaagtatatagaattatggagagattatttagatgatgtagaatatgttttttttttttttataatgttattaaaatgaaaatacggttttaaaaatttttatagagtgtaattttaatattgttttaattttattaaataaagtattgttatgttgtaatttttatttattattttttggagttgtataaattattaaattcgttttttgtttgatattttttttaaatatttgagggtagttattatgttttttttttttatttttaaaaaatagttttaaattttttgaattttttaatttaaaaattatatattgagtatttgatttgtggaaaggtataggttatattaaaaatggggttttatattaaaatggggaaaagggtggagatttttaggtggaatttgagatttgttatatattaatagtgttatttaattttttttaaagataaagaaataggattagaaggttattttggaaaatttatttggtaatattggataggatggattagtatagttggaaaatagagatttttgttttaggagagttgtttttttgttatttttagaattttaattatggttaaggtttagagttaaatatttaatagaagaagtttttagggtatgttttttattgtatatttttattttaatatatgtgtttttttttgttatgtaagtattttattattatttatgtattttttattaaagttaagtaaataattattttaaggatatatttttttatatatatataaagtttagggttattgatttttttaggttttagttttagatttgttattatttaagagtatataaataagggaaatagaaagaaaaggatttataagttgagaaggaagtaatgtagagaaagaagagtgatagagtaggtaatttggggaaagttagtgatatatagtttttaattatgaatagtgattttttatttttgaatgtttgtgatatttatgaaggtattaaaagttgatttttaaaaaattgttttagagaattggaaaaaaatttagttgttatatttttttttaggttatttttgaattttatttatgtatttacgtgtttaaggtaaagttttattaaacgtatatttgtttttgttggtttattgatttttattgttagttttttatttttagtaattatattttatattatatagtattgtgaaatttattatatttagtgttttgtttgataaatatggtatgttataggatgtgtatttagttatagttaaaaataaattattttcgttttttaaaatttgttggtttatttgttaagtttttgttttaagatttgttaatgttttttaaatttttgtggttaaattatttgagtgtttagttgttttatggatttttagggatttattcgttagagattttgatttggtaattttgggatggaatttagggatttgtaaattttataagtatttagaaatgaaatatagattttaaatagttaagagtgtttattaggattatgttgatattattttttaaatagatgtgttaagtttttaatttgaatttttagggttgggatttggttttttatatttgggggaaaaaagttttattgatgattgtggatatatattataggttaattattgaatagtttagttagtgtagttagtgtattttataattattaagttttaagtatgtggtgtattaatgttttaggaggtggatatattttttgtatttgtaaagtatttgggtaggttttttaaagagaaaagtatgtaataaattagttttgagcgttgtttttttatttttttgggtatttttgaagaatacgttaagtatttttttagagtagaggggtttagagtggtttttagattattattattggtaatatttagttggtgtattattaatttgttagaaatgtatatttttaggcgttatttagattttataaattagaaattttggaagtaaggtttagtattttgtgttttttttttttttattatattttaagttttagggtatatgtgtataacgtgtaggttagttatatatgtatatatgtgttatgttggtgtgttgtatttagtaattcgttatttaatattaggtatattttttaatgttattttttttcgttttttttattttataataggtttcggcgtgtgatgtttttttttttgtgtttatgtgtttttattgtttagtttttatttatgagtgagaatacgcggtgtttggttttttgtttttgcgatagtttgttgagaatgatggttttcggttttatttatgtttttataaaggatatgaatttatttttttttatggttgaatagtattttatggtgtatatgtgttatatttttttaatttagtttattattattggatatttgggttggttttaagtttttgttattgtgaatagtgttataataaatatacgtgtgtatgtgtttttatagtagtatgatttataattttttgggtatatatttagtaatgggatggttgggttaaatggtatttttagttttagatttttgaggaatcgttatattgatttttataatggttgaattagtttatagttttattaatagtgtaaaagtgtttttgtttttttatattttttttagtatttgttgttttttgattttttaatgatcgttattttaattggtgtgagatggtattttattgtggttttgatttgtatttttttgatggttagtgatgatgagtatttttttatgtgttttttggtagtataaatgtcgttttttgagaagtgtttgtttatatcgtttgtttattttttgatggggttgttttttttttgtaaatttgtttgagtttattgtagattttggatattagttttttgttagatgagtagattgtaaaaatttttttttattttgtaggttgtttgtttattttgatggtagttttttttgttgtgtagaagttttttagtttaattagattttatttgttaattttggtttttgttgttatggtttttggtgttttaaatatgaagtttttgtttatgtttatgttttgaatggtattgtttaggttttattttacggtttttatggttttaggtttaatatttaagtttttaatttattttgaattaattttagtataaggtgtaaggaagggatttagttttagttttttgtatatggttagttagtttttttagtattatttattaaatagggaattttttttttattttttgtttttgttaggtttgttaaagattagatggttgtagataagcggtattatttttgagggttttgttttgttttattggtttatatttttgttttggtattagtattatgttgttttggttattgtatttttgtagtatagtttgaagttaggtagtgtgatgtttttagttttgtttttttggtttaggattgatttggtaagtattttgtgttttgagaatttttttaggggattgtgatgaaaattgacgtttgagaatttttattttagagtaaaaattttatatatatatttttgttgttttatttatttagtataatattttttttttttgaaatggagttttgtttttgttgtttaggttggagtgtaatggtgtaattttagtttattataatttttattttttaggtttagttgatttttttgttttagtttttcgagtagttggggttataggtacgtggtaatatgtttagttaattttgtatttttagtagagacggggtttttttatgttggttaggttggtttcgaattttcgattttaggtgattcgtttattttagttttttaaagtgttgggattataggcgtgagttattgtatttggtataatattttatatataattagggtttaaagatttgttgagaggtttaatattaattttggattaggaaagattttatttatattattagttaggaataatttaaaaataaaaagtatattttttttataagtaatattttaatatatattaatgtaaatatatggaaaagtattagttatttaataaattaatatgtaaatgaaaaatttatatattatggttattttagatgtgatatagattttatttttagaaggaattttttaatgtaaaatagtgattttttttttcgtttattttattgtattagaaaattatatttaaagtaagtattttggtgaggtttggaaggtgaataaatttattttttttttaattatggatatttaagagagatgttgttgtgtcgtttagataataatgatttaaattaagaaatttagttgtttttaaaaataaaataagtgtatgtattttgaatatttttttttagaaataaattattttatttgtttttttgaattttaaattaattatatagaatttttaaaatttgaaaattaggttagtatgagaaattgaagatattgaattatattgtttgtttagtttatatttttttttaggatatatagtaggaaagaaatatgatagtttaagttagattattattttttttagagttttttgataaatgtaggtatagtgatagtgttagtttatggtgaatttttgttaaaataaattataaaaaatttgtgattttggtattttgaaattagttaatatttgtaaattttgttaatattgtatattattgtattttggttttatttgtgtatttatgagttatatgtgtgtatagttatatatgtttatatttatatatatatattatatataggagtggaattatatttaattttttttgtatagtttgttttgtttatataatattatattgtagtatttagtataagtaaagattaatttttgtagattttgtttttattttgaaattttgtggtagttggtttaatggaaagataatttttgtgacgtgttttgttagttagggattgattttggtaaaatattgttggataataataagtaatgtaaaaatatatttgttttataagataattttcgtgaaggtagagatttggtttgttttgtttattgtatcgtgttttgttttgggaagagtgttagatttatagaagatgattaagaaatattttttgaatatattaataatattttttaatatgtgggtattttaaaggtttatttttaaagtttattgattagaatttagaagatatttttttagataaaataatagattgttagttgttttgaaaatgtaatttatatttaatttgaaatgttaggtttttgttattttttttattaagtagagatagggtttttaaaaattatatgtgatgttttaagtattttggttttgtaataattattagatagaaaatgtaataatagattttattaataatatttttaataatatatataaaatatttgtttaaaagtaattttttttaaaaaaataaagttggttaggcgcggtggtttacgtttgtaattttagtattttgggaggttgaggtaggcggattaagaggttaggagtttaagattagtttggttaatatagtgaaattttatttttagtaaaaatataaaaaattagtcgggtgtggtggtaggcgtttgtaattttagttatttaggaaaatcgtttgaatttgggaggcggaggttgtagtgagcggagatcgtattattgtattttagttttgggtaatagtgcgagattttgttttaaaaaaaaaaaaaaaaaaaggtaataggattaggtattaatttaatgaaaatttcgtgatagtatttttttgaaaaagattgtggaaattaaagttagtaaatttttgtttttgtttgggttcggaaaatataaagatgataaagatgtttaagtatttttttttttttttttttttttttttgagatagtgttttgttttgtttggagtgtagtggtataattatagtttattgtagttttgaatttttgggtttaaataatttttttgttttagttttttgagtatttggaattataggagtgtattattatattcggttagtaatttgattggttaagaatattaattataatttatatatttttttgattatatttgtttaggataaaatagtaaaagatatgagtgtagatgaaagcgataagggaattaattttaaatattgaatttttttttagtaaattggttttttagttttttagttttttttttatatttttaaattttttttttggtaagattatttatttgttttggtttatggtgatattttttattgttatattggtgggtgattgttttaattgatagttgtttttttttattttaggaagatgatattgttggttttgttggttttgatgtttattttgtggttaatgtttgtgtttgtttgtgtttatatttattttacgatttatttgttaatatttattaagttgtttttttgtgttaggaatttggttagataaataaatggttgtttttgtatatagaattagttgttataattagttattgtagtatttatttttgtaaaaatatatatttatattttaattagtgatcgaattttaatttattaatttatatatttagttagtatataattgaatattttttatgtgttagaaattgttttaggtgtttgggatgtttattgaataaaatagataaaagttttcgtttttatggaatttattttttagtgaaggtgtggattggtgggatagaaaataaaataattaagtaagatatgtatttaggtttttataaaaatatagtagggtaagaggattaagatggaggtagtgattagggaattttaatgagggtgagattgcgataaagatttgaaaaaggtggagaagtaagttttgtgggtatttagggtagtagtagtttaggtaaggggaataattagtgtaaaggttttaggaggtaatgtgtttgaagtgttttaagaatagtaaggaggttagtatggttagaatagaatgagtaaagggggtaaagtggtagaaggtgagattaaagaggtaatgaggttattgtggaggtttatatggattattggaagggttttggtttttattttaaatgaggtaaaaattattttaagtagagaggagtgatatgatttgattttttgttaaaaggattattttagttgttgttatagaaaaagattataggggtgtaaagaaatagggagataaaagaatataagatttttattgtaatttatatttagtatgtttgtttatatttgaaaatgtatatttagataattgtagtaaatttaaatattatgtttatttaatagtattaatattgatatgttggttaattatgattaggagtattaataaagtataaattagggatttttaaaaagaatgttgaaagggtagttagttttttttgtgttagaaattaaagttatagtagatttggggtaaatatgttaaagttaaatttacgtatattattattgagaagataaagatgaatgtgtgatagttttttgtttttaagaatttttaagtattgtgaaggaagattaatatagttaaataattagagtgattagttttattagagaggattagttttggaagttagaggaaaaaaaaaaaaaatagaaataaaatgatgtttgaattaaatttttaaaagttttttttataaatttattaagttatatattgggaatggtattttaggtagaaggagtagagtaagtaagttagaaaggaaatattatggtgtttttgagtaattgtagtgtggttgaagaatgtggaaaatgatgaggataaagaggtggatagggaattaggtaagggagggtttttttttaaataattagattttgttttgtgtatatttaatgggattttaattaggttataatgttaaatttttttatttcggaaggatttttatggtgatggttttagaaagaaattaaagtagagtaatagtggttagtaataatgattagttagtggtttttaaatttacgtattatatgtattttggaagtttttaaaaatttagattttgggattttgatttagatttattgaattagaatttatagatttaaatttttagtgaggtttaggaatttgaaatgttgaatgttttttacgatgtagttagataagtatttgggaataaagtattaggtgattattttagtagattaaggagtgggaggttatttaagtttaaaggttattttattttttattatatttttagtatttagtatagtgtatggtatttgatagatgtatttttttttttatatttcgttttatatatttttttatgtgtatttttattaatattttttattataaattggtaaatatgtttttttgagttttgtgagttgttttagtaaagatgggtttgtgagaattttaatttttgaagtttgttagttagaagtttttgaggttagatttgtaatttttgttgagggggtagttttggggattgagtttttaatttgatattgtttttaggtagatagtgttagaattgaattgaaggatatttagttggtgttcgttgtagaattgattgtttatttggtggtggagagaattttttttttttcgatagggttgtagaagttgttttttgtgttgttgattgttgtggtgtgggagtagaggggggaaaaaagttgttggagagttttttttaaaataataggagattatttagatttataaaaatagaattaaagtagattaattgagtatattgtgaaatatagagtagagttgtgtgtaaggagtatattttaatgttaagttgatattaaattgaatgtttgttggaacgtttaaaaatttaagttttttaaatttgtgaaaatatttaggttagtaaatagttttatgtaaatagtaagataatgtttaaagttatttaaggaaaaagaatagtaattgaatttttttatggaaatgtgagatgttgttttagtaagtattgatggtgttatattttttgtttattcgtttgttggtattttagtttttaaaatttttttaaatatgttgtaaaatataaattaagaatttggtggattttttatttgtttttttgtgggaaatgatggaattaaaaattttgaggattagattttgagagttattttttagtgtttatgttattattatataaaattttggaggataaaattttttttatttaaaaattagttagttttagaaaattattttatgttaggagattgtattattatagtatgtgtgttagttttaggtatagatttaaaatatttttaatattttaaaaatttaagtttttttttattaatttggtttaatataagttagaataattttaaaaatgagtataaataataaggaagggttaggcgtagtggtttaacgtttgtaattcgaatattttgggaggttaaggtgggtagattatttgaggttaggagttttagattagtttggttaatataatgaaattttatttttattaagaatataaaaattagttgggcgtggtggtatacgtttgtaattttagttattcgggaggttgaggtaggagaattgtttgaatttaggaggtagaggttgtagtgagtcgagatcgcgttattgtattttagtttgggtaataagggtgaaatgtcgttttaggaaaaaaaaaaatagtttttgtgattgttagataaatgttgagtaagtaaaatattaataatgttgaatttagatattgaaatagttgttttgtataaataaagtttattgggagtatagattgaattattattttttgattttttcgttataatgattggtattatcggaagggattattttgttttgaagagttgttggatagtagagtagagagtatttattattattgtaggtgttttttagttaggattttggatttataagtaaattttaagaaagagtttggttttgagtttttttgaatagtttaggttaagttttaaattttgaagttaatttttataattttttttttatgtttttggtatgtgaagtaggtaaatttcgaattttataataatagtttagatttataaatatttgttttggtaattaggatgagtttttgagagataatatagtttagtgttaatcgcgtggatattagattgtttgagtgaaatataggttttattatttattaacggagtaatgttgggtaagttatttagttagggtttttatttgtaatatggtgataataataaagattaaataataggtgaaaaatgtttagaatattattgtgttattagtaagtattatgtataggtgtttggatttaaaaatattggtaaaggttaggttgggtggtttatatttataattttcgtattttgggaggttaaggtagaaggatcgttttagtttaggagtttaggattagtcgaggtaatatagatttcgtttttgtaaaaaatttaatagaattagttgggtatggtagcgtgtgtttgtagttatttgggaggttgaggtagggagggggaggattgtttgagtttacgatttcgaggttgtagtgagtttatgattatgttattgtattttagtttgggtgatagagtaagattttgtttttaaaataaaatgaaaataaaattgtaggtaaaaatgttaattgaagagtgaatatgaatttttttttgtattttttttgggtttgagattttaagaagtgtagggtagttaaaatgatgagatataatttttatttattagtttagtagaaattaataagattaaaaagatgcgtaatatataatattgtagagtgtatgggggaattgatatatatatttatgaattggtagagataaaaatgggtatagaattatttggaaagttattgtgtattttaaaaaattttagtagtatattttttatattatgaaattttattttagaatgttagttttgtagaaatattgacgtaagtgtaaaaataataaaaattaatttgtatttttaaggttagaaagagttattttattaaataatataattgaggtatattaattttattagaagtaaatttgataatttgtttatattttaaatagttatggtttaattttagtttttgaagttatatatttttataattaggaatgttaataggttttttgtgtaatacgaaaagatgattttaaatgtttataattattttgtgtttttttatttttttttaatttttattgatttattataaagtattaaatattttatgtttttaatttgaagaataatagatattttttataaaataatttttgtttatttatgaattttgtatataagaagtttaataagacgggtttaaaattatttttttaaatatattttttatataaaataattttaagatataattgttatttttgtgtttaatattgtatgttaaataataaaatggtaagtatgtaaaaattataatattataaagattgagttattttgttagtagtatattttaattttagttttagaatagttgtagaaatgggtaaataaattgttttaattgtatttttaattgaaatatagtattttatgtagtagtagaatatattagtagaagaattttatttgatttgtatttaaaaataaaatagatgtaatttataaaatttagagaaatatagtgattttatttgtatgtggaaaatgtatttttttttgatttatatattttttgttgtgtaatgtaagtagtaaaataaatagtataggatttatttttgtgggatttagattttttggtttaataaataatttttggttagtattgtaattttgtggtataaaattgataaaattagtttttttgtgattagataagaagtcgggtagtttaaatgttgaaatttataagaattttagaagttttagttttaagttttaagtttatttagaaatgttataagatttttagtagttatatatgaagaatattatgaagatttttttattaaatttttattatagattttttgattggtttttgtttagatttattgtgtgataaaggatataataatttttattatttttatttaatataggtttgttaattttatattagttgtttttttgaaggttggtttttttttaaaatttagttttatttttagtttatattagtttttaaatatattgttttttagatgttttatttaattttaaatttttaatggatttgttttagatatttattgttattttttagatagttattgttatttttgaagttttggacgatacgtgtattatagaggaattggagatattttattattatagttagtttgattggatattttttaaaagtatatattcgcgtttgtaattttagtattttgggaggtcgaggcgggtggattatttgaggtttggagtttgagataagtttggttaatatggtgaaatttgtttgtattaaaaatataaaaattagtttggtatggtattatatgtttgtaattttagttatttaggaggttgaggtaggagaattgtttgaatttgggaagtggaggttgtagtgaattaagattttgttattgtattttagtttgggtgataagagtagaattttattaaaaaaaaaaaaaagtatatatagtatatattataaggtttttaatttttttattaagtgttttatttgggtagttatttattggtagtttatattagttgagtggtttagaaaaaatatagtaagttgtttataaaattttgaatattttggttaggtataatggtttaagtttgtaatttgagttttttgtgaggttgaggtaggagaattgtttgagtttaggcgtttaagattagtttaggtaataaagaacgtttggaatgattgtggtatttgaattaatatttaggtttaataagagataattgattattattttattttagaggttttatttgaattagatagaaatttattttttatagttattattgtttgttatttataatttaagggggttggggaggaagtgagagattttttgttagggttaatagggatttgttagatatttttttattttgggaatggtgtatggaattttagtgtatgttggagttattattattatatttgtttttttattttatttttttgtttatatagattaagttttacgttttatttttaagtttaaattgaaaatatttatagagaataatgtagtgaaatgaaaaaattatagattgttggtatttgtatttttatgtagttttagtgattaatttttttttattgtatagtattgagaaaattttagtttatataattagttatagtttatatagatttatataattagttttaagtgataatagttttttttttttttttttttattatttaattagatgaagataatagtttttaatagtttatcgtaaattttaaggtatttaagttaaattgatttagatgtttgagttgaaatttttttattaaagtttaataatatgtttatattttttattaaagtataaaagttttataaatatataaatttgagtaagtattaaaattagtattagtattgttataatataatatgttatattgtaataagagtatttgttgagaattgtgtttgttattttagaatgttgtttttatggttgtattttttaattttgtagattatttggaaggaggagagatttggggtggagataattcggtattttatttataggatgtaaggaggattaagtaaaataatgttggttaaaagtttttatttagtatattgtttaatgtttattaaattataatagttgtttttaatatttggtgaagaatttatttaataggagtgagttgaggggtataggagattatgtgagtgtttaaagtagaagtagtattttttattaagaagagaaatattgtggaagagtaaagattttaaaatatttgggtttaaattttatttgttatataatggttatttttaatttattgaacgttagtttttttatttgtaaaatagggataatatttaatttatttataggttgtgagagaattaggtatttagtatagggtaatgttggtatatggtaatttttaataaattgttgttatttaataagttattagatgttattaggtagttaagtaaaggaagatagtttttgtttggtgtgataatgaaaatttttttgattttttttttggaagagttttttgaagatatgttattgtattgatatttttatttttgttaatttatttttttaaattttggatattgtgtgtgttatagtttttttttttttatatttttgtatttatttggtatttgttgtgttagtaatagataaggggttgttaagggaggaggtaatttgtattggtttatagttgttaatgttagtttttatagtttatcgttagtgttatttatgtggtaaaagggtgagaaagtattggagtttaaagaaataagtagaaattagtttgtagttattatcgttttatttgttaataatttttgtttttaagttattatgtataattttaggtagtttttttagttttaatcgtggtttttttgtattgagattatttttgaattttatgaagtatagttttagatgtataggttattttaaatttttgtttaaaataaaaatattttttttaattatatatgttggggaggaaatatttgttttcgataggtttaaagtttggttttggattttttgtgagagttttttatgtgtgtagtaatttaaaatttgtatagttgttttttataaaagtatattaatttagtagataaatttttatgtaatttaattatatggtattttttaatttttttgtgataagtagaaatgtaaagttttatttaagttaaggtaaattaatttgtatatattttttatttcgtgttttttttgttgttgttaagtaggataagttttgaacgtcgaaaagaaaagtttcgagatgtagttagatttcggcgaagtaaagaatttgaagttttttatgagtttgtttattagttgttatttttatataatgtgagttcgtattttgataaggtttttgtgatgaggtttattattagttatttgcgtgtgaggaaatttttggatgttggtgagttattttataagggtataaataggtttgaaaattagaagttagaagtaaatagaaattatttttagaaggtggtcgtaatgttttgattttgtatatttttttatattgtgatatgtatacgtttaaaaatttttttgtaatttttattatttttattaagttttattttttttttattagttattttttgaaataattattttttatgtatataatttgttttgttttatttttttaaatatatttttaatttttttttaatataatattttttttattatttgtttttaaagttttagttaggaataagatattggttttttttttttttttttttttttttgttttatttatttttttttttttaaaaaatatgatttaggtcgggcgcggtggtttacgtttgtaattttagaattttgggatgttgaggcgggtggattatgaggttaggagtttaagattagtttggttaagatggtgaaattttatatatattaaaaatataaaaaattagatgggtacgttggtaggtgtttgtaattttagttattagggaggttgaggtaggagaattgtttaaatttagagggcggagtttgtagtaagtcgagattaagttattgtattttagtttgggcggtagagtgagattttattttaaaaataataaaataaataaataaataaaaaatattatttttttttttttttttatggtttgttttgttgtattattttaattatgaaaagtagttggtatatttaattatagtttttttagtttttggtttgtatttttttgtgttgaaatggttgtatatattaaataaagtgtttgcgagaaaattttgtaaaaatatttaaatattatattatttaagtataattttttaattaattatttttttttttttgtgttttttttaggtgatttggatattgaagatgatatgaaagtatagatgaattgtttttatttgaaagttttggatggttttgttatggtttttatagatgatggtgatatgatttatatttttgataatgtgaataaatatatgggattaatttaggtaaaatgtatatatattaagagtttttttatatgtttttatgattttatgatttagttttaatttttaaaaatgtgtttatagtttgaattaattggatatagtgtgtttgattttatttatttatgtgattatgaggaaatgagagaaatgtttatatatagaaatggtaagaaaagtttgttgtttgatttaatgtgataggtggttttatataataagatattattgttaattattaaattttgttattgtatttatttaaggtaaaatgttattttatgtttaataaaatgtttattttttgttaaaattattattttagtttttaggaattttattttgaaagtttatttaattgtataaataattgtgtgggtgtgagaaataaaatggaaaagtaaaattatgattaagagagttataaataattttttttttttttttttaagatggggtttcgtttttttgtttatgttggagtgtagtggtataattagttgattgtagttttgatcgttgggatttaagcgatttttttattttagttttttaagttagttgggattatagacgcgtgttattatgtttagttaaatttttaaaaattatttgtagagataaagttttattatgttgtttaggttggttttgaattattgggtttaagttatttttttatttcggttttttaaagtgttgggattataggtatgagttattacgtttaggttattttttttttttttttttttttaaattgtgataggggtttttgttgtattgtttaggttggttttaaatttttggatttaagtgatttttttggtttagttttttaaagtgttaggattataggtatgcgttattatatttggtggagttaaaaattaaaatatattattaaggtaaggagaaattataatataaatggtagataataggattttagatagttattaaagttgaggtgttagtttgagtttaaggtttaataaaaaaagtttattagaattttaagataaataattgtttatttgatttttttggatgtttttaataattcgagatcgtgtagttagattataaagtattatattgtggatgtttatatattaataaaaatagagagtaagatttttaatttttaggaattaattgttaaaaataattaagtgttttaagattttttggaaattattttttgaattaaaaaattaaagtttttttatatttttattttgttaaatagtgtatattgattataattatttaaaaaattatgtgttttaagatttttggaaagtattttttgaattataaaaataagaaagtttttttatatttgtgtttttttaagtagtgtatattgattataattgaatttttttttatgatggaaagttattataaggaaaattttttatgttttgttgttttttgttgttttttaatttaagtgtatacgtttgtttgtttttatattataaaattttaaatttattttttgtataatttttgaggtttttttttttattttatttattataataatagttaatttttattgagagaatgttgtgtgttaggatattgttttttttattttatatgtttttaatttttttattttttataataattttgtgaagttaattgttagataatttttattttattaggaaattgaggtatagagttattaagtaatttttttaatattatttggttagtaaatggtagagtttgggttgaattttagtagattggttttagagtttacgtttattagttttttggagcgttttttatatttttgaatttttatattttgtttttttttattttgttagtaggatttgatttttgtttttaaattttatattgtgtttttattgttaatttggaaaataaatgtatattttttagaattttgtataaaggaggagtaaatatgttgtgaataaggatttaagtgggttgttaatgagtttaatatatgagttttaatgtgtagagttgaggtttatattgattgtttagtgtttttttggggttagattataaatggatggatattaggaagttttgttttgatttggtaatgatgttaatgtattattttaaattagatagttttaatatagtttaaatgtatgtttcgaattaaatgtttttttttaaagtatataaatattttgaaattattattaatgtggttaatgaattattgatgttttattgggaaattaaaatgtagattttttttttttagaaattagggattattgtaaagtattatattttagtgatatattgagagttagtggtgtgtttatataaatagttttattttttaaataaattttagaaaaatgttttagaatttataaattatataaaatatgatttatttttagagagtttaaaatttaggtttttttaatggtttgtttttgtttgtttgttttttgttttttttttttttattaggaaaatattagtattttttagttattttgatttttaaattaatttgtaggtttttatttaaaggttttgggttttttttaaaggttagtataatttaagtttagtttatgaaggattgaatatatttaaaggattttgtatgtggatttttattgttattattataattattaatatttatatatatacgatatatatatattttttttttttttttttttttttttttttttttttttttttttcgtattttttttttttttttttttttgtttttatggtattttttaaaaatatatttttaaatttttttagggagggtaaatttattttttaatttaagtaaatttaaatggtatgtattagtattaggattgtttattttttttagttttattatttatagagtataggttggaatttattttgttttttaagagtttagtatttttagttaattatgtttatatttaaatttatttttattttttttttattttatagtgtttttttaatatattagtattatagtttttagatttgattttttttttgttttatttttattagtttttaagtttattaagattttatttttttatttgttttttgttattattttttttttttatattttattggtttagtttttttattatagttatttaattttaatatatatattgttgttaagttaattttttttaagttattgattgtgtttttttaaagttttttgttgaatatttaggtaggattttatgtggatatttatagtttttcgtggtatagttttaatttttttttttagttttgttttattatttttttacgtgtattttatattgtggataaattattatatgttgttttttaaatatgttttattttttttatttttgtgttttttatttttttatttttttttggaatatttttttaatttatttttatttattgatattttaatgtttttttttttaagtaagattttttgattttttttgattagaaattattttttaagttttttttatttttttttaaagtatttttataagttttaagtattaattttatattgtgtttttgttgattttattatatttattatatttttaatttttttaggaaaggtggcgtattttatttatttttgtattgtttataatatttagtttaggttttgaataataaatatttttatatgtgttttgaagtatattgattaatgaagataagaaattaagaggttagttttttattttttttaatttttttttttgagatagtgttttattttgttatttaggttggagtgtagtggtataattttagtttattataatttttgtttttcgggtttaagtgatttttacgttttaattttttaagtagttgggattataggtatgtgttattatatttagttgatatttatatttttagtagagatggggttttgttatgatggttagtatggttttaaatttttgtttttaagtgatttttttgttttagttttttaaagtgttgggattataggtatgaggtataagttattgcgtttagtaagatgttttttttttagttatttaaatataattttatttttagttatagaaggtttgaaattggagtgaatagattttatttaattttgattttatttttgtagttttttttttttgagatggattttcgttttatattttaggttggagtgtagtggtatagttttagtttattgtaatttttgttttttacgttcgagtgatttttttgttttagttttttaagtagttgggattataggtatttattattatatttagttaatttttgtatttttagtagagatagggttttattatgttggttaggtcggtttcgaatttttgattttaagtgatttttttgttttagttttttaaagtgttgggattataggtatgagttatcgtgttttgtttatttttgtaatttttgataagttatttgatttgttgttgttgtttttttatagtaataaagtagaagtaattttttgtttgttttattagataaattaaggggaaaaaaataagatacgtaaaaatgttatttgttattaaaaagaaagttgttattttaaaggttttataaagatatagagtgtttattagaaattgagttaatatatttaggaaaggataggaagagtttgttgaagttttttttttagggatttttgtgtatcgatagtatagttaaagagtaaatttatattatttttatatttttgtgtatttgattaagtttattggttttaatgattaattgttattttaaatatggattattttttagttaatttagggaattatagttattgagtagtgtgtgttagattttttgggtgtgttggagtgagtaaaaggggaatgaattattgtgtttatgttgagatttaattgaacgggtatttagttgatttaggtgatgggtattttgttatttttattgtaataaatttgtatatttagttgttttaaaattttattttatgtttttattaggttttgtgaaaaagggtaaagaataaaatatatagcgaagttttttttttagaatgaagtgtattttaattagtcgaggaagaattatgaatataaagtttgtaatatggaaggtaagtgaaaattatttgtgattgattatatattttatttatatatagatattgtagtattaagataattttagaattgtgagggaaggtttatagttttatggtgtttggttatgtaatatttatatttttaatttatttgtatgtgatttttaaaatgtagaatcgtgtagtaatttgttaatttgaggtataaatttaaattacgtgaattgtggtattggtgttttaggtttaattagttggttttgttagttatataatatttgaattttgatagggtttaattttttattaattatggttttatatttttgtttaatgttgaaatatagttattagtgtaagaaataattattaaatagttatgatgatgagatgaatgaaaaagtagtttagattttatacgaggggaattttttaaagagtaatgtataggttttgggtaggaagtaggttataggtggtattataggaaaaatgtttattgatttttaaaaacgtgattaatttattagtgatagtaaattttattaaagtttattggttatgttagatttaattatttatttttgttttttttttttttagtattgtaaatattttttttaattgttttgttttttatatataggtattgtattgtataggttatatttacgtatatgatattaatagtaattaattttagtgtgggtataagaaattatttatgatttgtttggtgttgatttgtgaatttattttttatttattaaatattgaaatttttttagatagtaagattttttttagtcgatatagtttggatatgaaatttttttattgtgatgaaaggtaaattagatttaaaatgtgaatttgaaatttttaattagtttatagtattattgaatatttattatagtaaagatttagcgttggttatgtatggtggtttatatttgtaattttagtattttggaaggttgaggtaagcggggggtggattatttgaggttaggagattgagattagtttggttaatgtggtgaaattttatttttattaaaaaatataaaaattagtgggacgtggtggtaggtattatttaggaggttgaggtaggagaatcgtttgaatttgggaggtggatgttgtggtgagttgagtttatattattatattgtaagtttggatgatagagtaagatttttattttaaaaaaaaaaaaaaaaattatttaatgttaaattatattttttattaaattgaatagaatgatatattttataatattagattaattttgtaaattaatttagttatatttattgaatatttattttgtattatgaatatttattttattaggtgttatttagaagttaagatgagtttttttttttttaataggggttttatttatttagagaattttaaagatatgtagtgtgtattttgagtaaagatagattattttaggttggggattagaaagttaagtgtttgtatatttttttattttatatattttttttgagaagttttaattttgtttatggtttttattattattttttatatttttttttgtaattaattttatttaattgttaatttaatatttttatttggatatttttttgtattgtaaattaagtattattgtaataattgtattattattgtttttaaataatattattattaaaaattgtttttttttttataatgtttattgtggtttaatatattattatatatatatgattttagtaaaattttggaagttatttgtaattttttttttatatttattggttatatatagttggtgtttaaattttatagatttattatttatatatattttttgatttatttttttttttttatttttgtatttttgttattgaatttattagtttattattatttttgatttgagttgttggtatagttgtttttttgttaatagatttgtatttttataattttttatttaagttgttagaaagtgggtgttttaatgtgaaaattagattatgttattttgttgttgaaaatgttttaaatgtttttttttatttttgtatataaaaatattttgtttataaaaatattagatgagggaagtaaattttttatttattaaaagaagatgtgtattttagaagattgaaaaaaaatagatttatataatataatttaaatttagtatggtaaataaagatatttatgttttggttttaattttgtttttggaattagatgttagatttatttatggtttgtagttttgatatttataatgtggttttggttttggtatttaattgttgtaaaatttatattttttatttataaaataagaattatggttgggtggggtggtttatgtttataattttagtattgtgggaggtcgaggtgggtggattatttgaggttaggagtttgaaattagtttggttaatatggtaaaattttatttttattaaaaatataaaaattagttgggtatgggggtatatgttcgtaattttagttatttgggaggttgaggtaggagaattgtttgaatttaggaggcggaggttgtagtgaattaagtttgtattattgtatttcggtttgggagacggagtgagattttattttaaaaaataaaaataaaataaaaaaaagattttagaaggatgttgttaggattaaaggagtttattgagtgtttagtatagatagtgaatgttttattattggtgttaattttaagaaaatgaatatagaaaagttaagaattattttaaggtgtttattattagtatgtaaatgtatgatgggatagagatttttattttattttgaggaattattttttatttttttgaaaatttaaggtaataaagtagagaggaggttagggagaaaggaaggtagtggagtaaaaatgagaaagggagtgatatttttttttagttatagtagaaaattagtaaaatgattatgataggaggtaatagtaaagatagttagtttatatattaattaagatagttttgagtttgattagtagattgttattttttggtttagagttttttttaggaattttttgtatttataatttttgagaattaagttatggaaaaaattttgtttaattttaagaaaatttaatatattaagttttttaattttaaaatattttataaatagttgttatttattatattgagtaataattatttaaaattatttaatattttatttgagtatttattatgtttatggtattaaagtagaaatgaagatgaatagtttttgttttaaaataaatgagtagtatattgttttagattatgggttttttagtttattaaaaatattttttggttatattttttggatatttcgatttttttggtatagaatataatttatgtaattttttaaagttaaattaattttattttttttgttttaatatgtgtaaaattgattttttaggaaagtatatatagtttatatttttgattttttggtattttttagtgatagatatattttagattgagaagtattgattgatattagattaaattagagttttttatgataatataaataatatttttattaatttgatttttttatttatttttttagtattattttatatttgtttttattaattatattatagaatttttgttatttgtattatgttaagtatttttaaaaattttttgtttatattatattttttttttgaaagcggttttgttttttttttgtttttagttataagttttttataagaggttgttttttattttattatttttttgtatggataggattttatggaatagatttttattattgtatttattatattattttttaagtagtatagtatatttattggaagattagttacgtattgagttttgtttttgtatttttatgtttagaataatgtcgggtatatataggtatattaagatttgaatagtgaaaaagtttttaattttatggggattttatttaaatagaaaaatataagattaattagaattatttttaaagtataattttaagaaatatgattgattttgtttaaaaatatgtttttttttataatgttgttatttggtgttgttgtgtttagagatgtttttttgtaaagaattgagggtttgagttgagtttggtttggtttttggtaaattagttttttttttgtatatttattttgtaataaattatggaagattttgtttttaagtgtgagaatataagtaatgttatttttatatttttatagaatattttgtttatgttttttttgtagttaggtagggttttttttttgatatatagtatgttatataaggtttgtttgtatttcggtaggaaagttttttgaaatttaaaggttgagaatttaaaagtttaatttatgttttgtttttagaaagatttgagaagagagtatttttgtttagtatggtattaagaagatagtttttttttttttatgttatggttgttattttatattgtttatagagaataagatttagtttttgttttaaataaaggtttattttttgttagcgagttagatagggtaattggattgttttttaatttatttttatttgaaatattgttttatttgaaattatttttataattttatgtaatgttaaaaattaaattaagtataagagtatttttaaaaattaatataatttttttagtttttatttagtgtagatgttttttggttgatgatattagaattgtgtaatggttattgattttttaaagtgaggtgttgtttaggggtttaaaagttattatataaagaatttggttttatgaagaaatgttatagattttatttatattttaaaataagtgtaagtgattatttttataatttttattatgtagtttagtagtattttttatttgtttattaatattttgttttgttattaaaagtatgtataatgagatgtaataagaataggtaataagtaggttgggtacgttggtttatgtttgtaattttagtattttgggaggttaaggcgggtgaattatttgagtttaggagtttaagacgagtttgattaatatggagaaattttatttttattaaaaatataaaattagttgggtatggtggtatatgtttgtaattttagttatttgggaggttgaggtaggggaatcgtttgaatttaggaggtggaggttgcggtgagttaagattatattttattgtgttttttagtttgagtaatacgagggaaatttttgttttaaaaaaaaagattaggtaataagtttgggtgaataggattaaagagttaaataataggaggaatttagaggatttaaagaaatgtgtggtgttggatttaataattgtagttgttaaaggtgaggtgtaaatttattttaagtaaaggaggatgtttatttttgaaaatttatttgtttataagattaatgtttattagttaatttgggaggagaaaaatttttttttattagtgtttttttttttttttttaaattttgtattttttattaatagaattatcgaattgatgggatatgagttagaagaatttttaggtcgtttaatttatgaatattattatgttttggattttgattatttgattaaaatttattatgatagtaagtataatggaagaatttagagatattttaattatttaattgttgtaatttttgtatagtttggttatttatttaattttttggttaaaagttttagattaaatgtgttaataggtttatttagtagagattttgattattttgtgttttgtatgtgttgtaataaatattagtaaaaatagaattatttaattatagaaaaaattttttggtattttaaatataaagatttttgaaaatttaaatattatagagtattgaatagtataatttttagaatttatataaatatttagaatagtggttggtatgtaaaaggtatttagaaagtatttgtataattaatgaatgtgaaggtggtgaatattatttttggtaataagtattattttaaaaaatgtttataagtgtatagttaggtatttatatttatgggtttatgaaatattttgatataggtatgtagtgtataaggataaatggagtatttattattttaagtattattttgtgtgataaataatttagttatatttttttggttatttttattttattttattttattttttttttttgagataggattttattttcgtttaggttggagtgtagtggagtaattttagtttattgtaattttcgtttatcgggtttaagagatttttttgttttatttttttaagtagttgggattataagtatgtattattatgtttggttaatttttgtatttttagtatagatagggttttgttatgttggttaggttggtttcgaatttttgattttaggttatttatttgttttggtattcggttttttttagtttttttaaaatgtataattaaattattttttattatagttatttaaaataagtatttttgatataagatttgattttgaattttatttaaatgaatgttaagatttttaagataagttaaattttggattattttatttgtttaatttgtatttatgtatgattttttattgtgtttgaggatatttgaatattattgagtttgtgtgattgattagttttgaatttaagagtaaatttaagtttgtagttaggatattttaatttttaaaataatattattattagtatttatttagtatttttttttaaattagtatttaatttaaattgttaaaagatttataatgtggtattaatttatatttaaatatgttatatatagttttttaaagtatttttggttttttggaaattatagttagaatttaaggaagttattgtggtattatttttttgaaaaaggttattgattattttttaatttgatattaatttaagttattaaaggaattttagttattgaagattgtatatttatgaattttttatttagtttattggtagtaaaggagttttatttagggggtttgaaaaaggaaatgggtatatttttagttattttgggacgtattgttagaatgtaagtagttataattgattttattaaataaatatttgttttttaaaataatgatgaatatttagtatttgtttatttaattgaaaatttaaagttaaaatattttttttgtatgattttttttttttttttttttagtgtttattaaaggataagttattataggatagtataggatgtttgttaaaagaggtggatatgtttgggttgaaatttaagtaattgttatatataatattaagaatttttaattatagtgtattgtatgtgtgaattacgttgtgaggtaagtaagtttgagaaataaatatttttggggaataaatagtaattttttttggatattttgtttatttataggaagataagataataaatattaattaaattttaatttttttatatcgttattaaattattattttttatattttgatttaggtttttagtttagttattttatagtgatgttgttaaatattgttagtagttgtttatttttatatttttatttttatttttaaaaagattatgaaaaaaatattagatttattgattggtttggtttaattatatagatatcggtatatattattttaagatagttgtgttttttttgtaggaagaattttggtttagatttgtattatagttttattatttattagttttttgattttggggaagtttttttatttttttgaattttatttatgtagataattttttagaaggttataatgaaaattaaatgaaattttatgagattagggaggggggagggatagtattaggagatatatttaatgtgaatgatgagttaatggatgtagtatattaatatggtatatgtatatatatgtaataaatttgtacgttgtgtatatgtattttagaatttaaagtataatttaaaaaagaaaagaaattttatgagattaataagttatatgatgtaatatatggtttttgtatatttatgaattttttatttagttttttggtttgtgaatattatgtatattaaaatttaattttttatttgatttattttattagatttttgttttatttagtttatttgtttatattattattatattttagtttattttgtttattattattaggttaagttttttagtgtggatatgttattattttattttttttagaattttagcgatttttttattatttttaagataaatatttgtttaggtgtatagtatttttgtttattattatatttacgtattagagatttagttttttttttaaaatttagggttattttttttaggaagattttgggtagtttttatttttgttatttttgatattattttttaatgttttaatattagtgttatagagtttttttgtgattttattattatgtaagaattttttatttggaatgttttttttttttttatattttagtttgtttagtaaatgttatttgattttaagtattagtttgttagttttttagtgaagtaagttttttttattttagtagttattatagtgtattttaattgtttatatatttatttttataatgggttataaattttttaaggttaagggttggttattttaatttttgtattattagtttattttagatagtgaatatttaatacgttaattaaaggaataatttatatttaagttaaacgtgaagataaattattgtttattatttttttttagtcgtattttgtaggtggtattattttatatttttattattaaagaaaatatggttttttttttagaaagattttaattatttatttgtgtatttttaggattatttttagattatgttttatatattgatgttaaagagtttttttgtgttaattttataatgtgtgttagtataataattttgaagatttgttggtgttttttatgtatttgattataaattgttttgttattattattttttttaaaggatatttgaaatttttttttttttttttttttttgagatggagttttattgttatttaggttggagtgtagtggcgtgattttggtttattttatttttcgagtttaagtgatttttatgttttagttttttaagtagttgggattataggtgtgtattattatatcgggttaattttttgtatttttagtagagatagggttttgttatgttggttaggtttttgaatttttaggtttaagcgatttattcgttttagttttttaaagttttgggattataggtatgagttattacgtttagtttggatatttgaaatttttaattgaaattagttaaattattttgtattggggattttttttttaattttaatttttatttttgatttaggggatatatgtataggtttgttatatgggtatattatgtgatgttgaggtttggggtataattgattttgttatttaggtagtgagtataatatttaatagttgtttaatttttgttttttttttttagtagtttttagtgtttattgatgttatttttatgtttataagtaatttagtgtttagtttttatttataagtgagaatatgtagtatttggttttttgtttttgggttattttatttaggataatggtttttggatgtatttatgttgttgtaaaggatattattttatttttttttatggttgtatattgtggattttattgggtttttattttgtattagtattttaaaattttaaatgtgatatagtacgtatgagtgattatgtattttaagaaattttgaaatgtttttgtttataaagtagaattttttaagagattattttatagttttttttttttttattgtattaagtgtttatttgtgaattattaattttttttgttttgatagtggtattatttagtacgatttgattttttttttttaataaatagaatgtgtttttaaatcggttgaatttttagatatgaaaatgatttagttatttattaaagttgaattagaagatataagtagtttttttgataaatttaagaaggaatttgatgttttaattttgttggttttagtcgttggagatataattatatttttagattttggtagtaacggtgagtagttatttttgttaattttttaaattgtgtttgttgttataagttttattttaattaaatattattttacggtttttgttggtaattatttggatattataagttaatatatgtttatagtttttttaaatgtatttgtttaaatatttttgttttcgtaattttttattatttttgtttttttatattgttggaaattgtgttttaaagtgtttttaaggtattttttttttttatataaattttttttggttattttatttttgtattttgttgttagattttttttatagtttagtagagttatatggaagtaggtattgttgtattaaaggataaaaaagtagttatattataatattaagtattgaagatgaaaattgtaattttaaagtagagaatattttaatgtataaaaaggttggtattgttttttgttttttatgttatagagattaagacgcggtattaatagtggattgtaaaggtaatttagatttatggttatattatattattgtatgtaaattttttgatgaaggaaaatttggtgatattttgttgtttgatgaattagataaattttttgtgaaaaagaatataaattttttatatgtgaaaatttttgtggtcgggcgtagtggtttacgtttgtaattttagtattttgggaggtcgaggcgggtggattatttgaggttaggagttcgagattagtttggttattatggtgaaatttcgtttttattaaaaatataaaagttagttgggcgtggtggtgtgcgtttgtaattttagttatttgggaggttgaggtaggggaattgtttgaatttgggaggtagaggttgtagtgagttaagattgcgttattgtattttagtttgggtaatagagtaagattttgttttgggtaaaaaaaaaaaaaaatttttttatattttagattgatttatattttttttttatagatatagaaattgatgattagtaatttgaggaagtattattatataatgatgtaatgttttttttatttaacgaaaaattatagaatataaatttggtaatgtttttattatttatcgttgaaacgttaaagttatttcgaagtagtgttgattttgtatttaattaagaagttgtattaaaattagaattaaatttagagttattggaatttttttttattatgttttagatttaggattagatatttagttttttcgatggaagtattagataaagtttatttgaggtaggtgttatgatataattagaaagggataatttttagattttaatatttaagaatgtatttataagtttgatttaaatatttatttgaattataaattatatttgtgtgtgtgtttgaattttagtattttaaaattattgtaagagttattgtttaatttagatttgagtatatgttttaggtttaaagatagttaggaatatgggaagaaattagtttaatataaattaaaaggtgaaacgtatattgtttttttattatttatattagtaggataaaaatattttgaatttggatatttaaagagaatagtattaagtgtgtttaaggtagttatagtttatatttgttattttttttagtttgttttattgtgttttgttttgttttgagaaagagttttattattatttaggttggagtgtagtggtgtaattatagttttaattttttaggtttaaatgatttttttattttagttttttaagtagttgggattataggtttgtattattatgtttggttaattttttaatttttttttgtgtgtgtgtgtggagttggggtttttattatgttgtttaggttggttttaaatttttgggtttaagcgatttttttgttttggttttttaaagtattaggattataggcgtgagttattatgtttggtttattatttttttgagttggagaattgtttggtagtaatagatttacgagggtttaaatgggaaaggattttataaattttttgtttaatttagtttaatttttattattattttgaaattttgggtaagtataatatgaaaataataagtgttatataaaataaatatttagtaattggttttttttattttggatttgttttgatattaattgttttatgaatataaaaataatttttaaaggttaggttggttaagatttagagatattatatagggttttatttttaaatttagaatgattttattttagggttttttatatttaaaaatatgtttaggagtagggtaatttagatttgaatattataatttgataaatgaggtataaataagttttaataagtggtaaataattttatattaggtatttgttgaataaaattgataagttaagagtaggggatttgatattttatagttttgtgttgaatgaatatatattttatgttttggttgtttaatttatttagaaaaaaaaatgtttgatttattttggtttttatttaataaaagtaaatttaataaaaacgttagaatgaggaaagtaaaattttttgtttagaatatatagttatagttttttgttaaattttttgtttagaatttttaaaatagtaataatgtatattcgtttaggtatatgtaggtaaaataatttaggtttttatttttattttcgatagtaatagtgagatttttaggtagtttagttattataggagtgtgtttttttagtttaaaggtaaattttagtgaatgtagtatttagttaattggttaattaggtattattgtgggatgtgaattattaaataggttttattttttagaataaggtgtttttttttattttaattttgtaaatgatgttatattatatagttagaaatatatatattggtaaaattagttattagtataagttttaaaatgttattatttttataaatttttttttttttttttttttttgatatggagttttattttgtcgttaggttggagtgtagtggtatgattttggtttattgtaatttttgttttttaggtttaagtgatttttttgttttagttttttgagtagttgggattataggcgtttgttattatgtttagttaatttttgtatttttagtagagacgaggttttattatgttggttaggatggtttcgattttttgattttattatttttttattttggttttttaaagtgttgggattataggcgtgagttattgagttcggtttagttaaataaaatttgataaatacgatggatttggttgtgtgttttttggtttttttgagatttagtttgaaaattttgataattagtaaagtatatggaagtttttttaggaaatagtaaatatatttttttttatagtttaatagttttagtgaatattgtttttatgtggatagtgatatggttaatgaatttaagttggaattggtagaaaaattttttgttgaagatatagaagtaaagaatttattttttatttaggtatatgaatttatttgttttatattaaattttattaatttttagtttgaagtgattttgagttttatttgttttttatttataaggtgtggttattgtaaaaatttatgtatttgttgttttaaaggatatagatttagatttggagatgttagttttttatattttaatggatgatgatttttagttacgttttttcgattagttgttattattagaaagtagtttcgtaagttttgaaagcgtaagtttttaaagtatagttatagtattttagtagatttaaatataagaatttattgttaatgttattattattattgttattattgatgaattaaaaatagtgataaaagatcgtatggaagatattaaaatattgattgtatttttattttttatttatatatataaagaaattattagtgttatattattattatatagagatatttaaagtcggatagttttattaaatagagtaggaaaaggagttatagaatagatagaaaaattttatttaagaagttttaacgtgttatttgtcgttttgagttaaaggtatttatatgtaatatttaagttatagtttttttattatttttgagataaatgtatgtgatagtatatgatttttaaatttatagtaaattttttgatatatatgttttaacgtaaatttttgagaatttaaaaaattttttaaattaattttatatatttttttttttttttttttttttttttttttgagatagagtttcgttttgtcgtttaggttggagtgtaatggtatggtattattttagtttacggtaatttttgttttttgggtgtaagagatttttttgttttagtttttcgagtagttgggattataggtatgtattattacgttcggttgatttttttggtattttttatagagatagggtttttttacgttggttaggttggttttaaattttcgattttaggtgattcgtttgttttagttttcgaaagagttgggattataggtgtgagttattatgttcgtttttattttttttaaaataattataaattttaaaattatttatttaaatggaggagggttttttgatatttttaaaataaaatttagtttagtattgtaaatgtgtttatagaatttgtttaaagtttttatagttgtttaaattagattagttaattatttttattatttagatgtttttattttttagagtttttttttaagtttatttgaagaaaagtttttttaatttaagggttatttttaattgtatattttaaattgagttttttatttttagtatttaatatagatatttataggttttttttttaaaattttattatagttaatttgtattaaagttgtttttattttttattacgtatttgtagaatattagttatatatatattgtaggttatataggtttttaaattgtataataggaatttaagtatgaattgttatttttatggagttagtttaaataaatatatggatatgatttaatttttaagttatattttttgtatataatttgtaaggggattttatatattttaagtttgaggttatagttagaagaaattaagttttatttaataagtgtgtggaaaagggaaatgattttttttttattatgtttagattaagttagatattaatagtaataggaaagaattattgtcgtagttagaatatatagtttttttttttgtttaatatttttattttgatttagagtgttgggagaggttttttttttaagtttggaaaagatattggggttttagatgaatttagaagtattttatattattttatttattgtgttatttatttatttttgattttgagttttacgagggtaattatagtgttttgggtattttagtgatattaatatttagtttatgatttaatgtgtagtatttttttaataaatggttgttgaggtagggcgtagtggtttattattgtaattttagtattttgggaggttgaagcgggtggattatttgaggttaagagttttagattagtttggttaatatggtgaaattcggtttattaaaaatgtaaaaattagttgggcgtggtggtacgtgtttgtaattttagttattttgggaggttgaggtaggagaattgtttgaattttggaggtggaggttgtagtgagtcgagatcgtgttattgtattttagtttgggcgagaagagtgaaattcggttttaaaaaaaaaaaaaaaaaaaaaagttgttggattgatagatgtatgaatatagtagtaaaaatgataattatttataagttatagtttattattagttatagaggatgggatatttagttttttgaataattgtttttttgtatttgttaaagttaaagtgtaataatatattaagttattttagtaatttatttttgagacggagttttgtttttgttgtttaggttggagtgtaatggcgtgatttcggattttggtttatcgtaattgtcgtttcgttggtttaagtaaatttcgtgttttagtttttcgagtagttgggattataggtatgtattattatatttagttaattttgtatttttagtagagatagtgtttttttaggttgattaggttggttttaaattttcgattttaggtgatttatttgttttagttttttaaagtgttgggatgatagttgtgagttattgtgtttagttagtaattgtttttaaatattagttttaatgtagtgtatattgaaaatttttatgaaaggaattttaaaaattaagataaattattaaaaacgtaattattaagtattattattattataatgatatttatataatagattgagttatattttataaagataatatatttgtataagaatttttaaatttttttgtttatataatagaagttttagagaaattttttaaaaattaaagaaaattgtaaaataagattatttatttatttggtatttttaattgtttggaatagtaaggagttattatgattatgtatttggtttgtggggtgttttgaaaagttaaaataatgtaataaagttgatgtattttatttattagaataattttttataatttaatattaattttagatatatatagtttatgtttgataattagattaatattgagtgaaaaatagtatagtgggaagagtaggggaggggaggtagggatttggagatttagagtgtatttttatattgtaattagtgagtagtaggattttgagaaagttatttaataggttttagggttttaatttataaaatgggtatgatatgtttgttttatttgttttgggaatttaagtaaggttaaaatgaattaatgaatttgaaatgttttataaattgaaaatgttatacgaatgtgagattgattttgtattttaatagttttaataatattattgtattgttatattaggtggaataaaaggataatatttaattgttttgattttataatagtgttaatttagttgtgtttagttttattttataaaatagggatacgtatattgtagaaaattttttgttaaattaagttttgacggttaggtgtttacgtttgtaattttagtattttgggaggttaaggtgggtagattatttgcgtttaggagtttgagattagtttgagtaatatagtgaaattttgtttttataaaaatatgtatatataaattagttataattttagttatttgagaggttgaggtgggaggattatttgattttagaggtagggtttggttgtagtaagtagagattacgtttttgtattttagtttggttgatagagtaagatcgtgttttattaaaaaaaaaaaaaaaaaattaagtttttatttttaagatgataaattttagtgattaggaaagttattttatgtatattatattttttaatattggagaattaaagaattatgtattttttttaaaagcgtttattggatattttttttaaaaacgttatatttttatttagaatttttttttttttagaattatagtttttgaggaagaattaaatttaaagatattagttttgtagaatgtttagagaaagcgaaaaatggaatatgatggtttatttttttaagtagtaggaattgtaagtatgagtagtaggttttgtttttttagttaatgtgttatttcgtgtgtgtgtgtgtgtgtgtgtgtgtgtgtgtgtttttacgttttttttaaatagtaaagttatatttttagaagttatatattgggtttttttattttgtatgtattggtttttaaaaatataaatgtttaatatatatatttttggtataaaaattttaaataattttagtgtattttgagttaaaaagtgaagttttttttttattttattttgaatattattattaattttatttttttttttttaagttattttgttttattaaaagaattgttattggttaggtatagtgttttacgtttgtaattttagtattttgggaggttaagatgaggattatttgaggttaggagttcgagattagtttggttaatttggtgaaattttgtttttattaaaaatataaaaattagttaggcgtgttggtgtataattataattttagttattttggaggttgaggtaggagaatagtttgaattcgggaggtggaggttgcgatgagttgagattaggttattgtattttagtttgggtaagagagtgagagtttattttatatttaaaaaagaattgttatgttttggggtaagttaatggtggtataatatattttgatatttttaaattaaattaattggaaagtatttatagatagaatggttataatggatgataaataatttaagaaagaatttaaaataatttagggtagtatttaagaaattgtttataatgttattaaatttatattaattttaaggtttttggttgtttaaaaaaaaaatttaataaattaaatttgaaataattttattgtttatagggaatattattatagtagttagacgattatgtagttattatattatttttttggaaacgtgtaaaaggatgtaaatttagtgaatagaatggaatggagtaaaagataattattttaatattttttggttagtttattttttttgattttgaatattataaagataaaatatatgaaatatttttatttaggagttttaatttaagtgagaatgattttggttttttagtaagattaaaaagtaaagttgtggttgggcgcggtggtttatatttgtaattttagtattttgggaggtcgaggtagttagattatttgaggttaggagttggagattagtttggttattatggtgaaatttcgtttttattaaaaatataaaaattagttgggcgtggtggcgggcgtttgtaattttagttatttgggaggttgaggtatgagaattgtttgaattcggaaggtagaggttgtagtgagttaagatggtattattgtattttagtttgggcgataagggtgagattttgttttaaaaaaaaaaaaaaaaaaaagtatagttgtattttatgtgatggttttaatatagagattaatattttaaggtggagttttttatttttagtaattttttttgatttttttatgtttatgtgttgttaatattgatagaagttgaaatttgtgaatttttatgattttttttttttttttttttttttttgagatagggtttcgttttgttgtttaggtttggagtgtagtggtatgattatagtttattgtagttttaaatttttgtgtttaagtttaagtaattattttattttagttttttgagtagttcgtattatagatatgttttattatattcggttgttttttgtagagatggggttttattatgttgtttaggttggttttaaatttttggttttaagtgatttttttgttttagtttgtgttaggattataggtattagttttgatgtttattatatttatgtttttttttaaattgttatttttttgtgtttttattgtattttgtaaatatttttgatatagtaatagtattattggattatatttattttttaatatagttgtggttttgttaggtaaattaaaaatttttttagaattttgttttattttttatgatatttaatatattgtgggtgtttaataaatatttattgattagatgaatgtatatttaggtattttttttgttttttagatttagtatgtagattgttggggtaattaatggatgaaagtggattattatagttgattagttatgattgtgaagttaatgtttttatataaggtagtagaaatttattgtagggtgaagaattatttagagttttggattaagttaattgagtttttttttaattttatttttttttttggatattggtggtttattatttaaagtagtttatttatattttttatatttaattttagaagtttggttataatattgtataaatttggttagtttaattttgattttttttttatttaatttatattaatgtttttttttagtatgttttttaatgttggattatagatagtttatttttttagttttttggtatttaaattattgtattgtagtagtattattttaaaaaatgtatttttttatttatttatttttggttagggagtttatttttttttcgaattatttttaagaagatgttaatataatttttgtaagaaggtagtaattttttattatgattataggtagttgaaaaatttttatatttttttttttatattttatataaataataatgttttgttagtagtacgtggtagttataattgtataatatatttttttaaaaaatattagtagttatttatggaatatattttgcgtttataaaattagtttttaagaagaaattttttttggtttatgaaattgttaaatttggaatatgatattgttaattatataataatgatttttaaatgttgtatggtttattatttaaatgggtaaagttatttatataatatagaaagatatgtatatatttagaaggtatgtggtatttatttggataaaatttttaatttagagaaattatttgatgtttttatagttattttgttagtttaaaagaaaataatattttatgtagttgtggaagtttatgttaatattgtgtaattgatattaaatttaaatgttttgtttattttgttggtataaagatattttgagtagattgtaaataagaaaaaaaaaattatgtatttttagtaaaattgtttagtatgttaatttgtttaaaatataatgtttgattttatgtattttgtcgttattaatatttttttttttatgtagattttaataattgagtaattttagaagtattattttaggaatatatagttgttatagtaaatattttgttttttttatgtatattgtataaattttttattttttttgttttttgtggttggatttaatattaattgtattgttttgttatattaaataaatattttttgtggattaggtttttttgattagtttttatgtttaaatattaataatatttgttttaatatttttaatttataaaattgtttattaataatttaagtatttatgaaaattatatggtattggttatttttatatttattttagtgttattattttaatgtatgttgagtttttaaatgttatgttaaataataataattataatatttta

SEQ ID NO: 47 - DNA, 53638 bp, Homo sapiens
ttagtagataaggtgagtttttttgtgttttgtggtaaagagtgtggtgggtgatattgatttatggttaggtaatttggtaaggaaagattttgttgtaatatatttgagtaatgagattaaaggaagggtttgttgttatgaggtgaagtttgtttttttgaatagagagtttagtagagttgggtggtaattgtgtttagtattgaggttgaggagaaagagagtaggagtattatattattgtattaagagtaggaaaatatgatgtatgtttgggattaggtaattgaaatttttttttagtagtgttttttaaagttgggtattgtttttttttggagaaggtgtagagtttttagatttgggttgagttgtatttttatttttttttttttttttttgttgttaaatatagatgagtatgtgagtgttgtagtttgttttagttgtgttttagttgattgttttttgattggttgagagtggtgtgggttggggtggggatttgttgtttgtgttgtttgttattggattttgaggaatttgtttttattttaggtgaggtgggtttgtgggagtgtgtgttggtttgggtaggtgagtgggtgtgtttttgtttttttttttttttttgtgtgtttgagtgtgtttttgtttttgtttgttttttgatgttgttttagttttttagtgtatagtgttgttttgtttgaggggataggaggattattttttttgttgttttggttagtgtgttgggttgggttttgataagttatttgaggagaggtttggagttgggtttggattttggtgattgttgtttgtttttttttagttttatgaggggttttttgttttgtatttttatttttggatttgttttttttttttttttttgtgtgtggagggagttagtgtttaggttggagtgagtttgggggttgtttgttgtgaagatattgtggggattgatttattatggagggtgttggtggtgtgaatgataagaaaaagtaagtttatttttttggtttgttgtttttttttttggtgattttgtttgtttgtttgttttgggtttttgggttggttttggtgttaatgggattggggggggtagtttttttgtttttgttgttgttttttttttttttttttttttaattttgttggttgggtttttttgttgtttatgttgttattttgttgtggggggtgggagatgttttgaaagtgtttttaggggttggggtttgagttttgtttgttttttttgttggttgtgggggttttgtgttgtttatttatttgttttaaaaatttagtttgttttgtggttttatttggaggggattttatttagtttgaaaattttgggaagagaaatgagttgtagtttggtagttgtggtttgtatttggagtttttgtttttttttgtttttattttttttagttttattgaaaatttggttttggggtggattttgtatgttggttttggttttttagtggatttggggttttgagtttttgattgagggatttgtgtggttggatgtgattttgttttgtagttgtttagttgttgtgggtgtttttgtttttgtgtattagggatttgttgtgatggttttaagatgtgaattttttagtttgtatgtgtaggttttgttttgttttaattgttttgaaaaatttgtttagattgagagttagagtaatgggaatttagggaaatggtaatattttaaagagaattttagaattggatatttgagtttatattatttgttatgagaatgtagatattataaatgaatatatgttttatttattttttaaataatgaaaatgtaggggttggttaaatttaggtagttttaatgatattgaaaaaagtatatgatgagtgaatgaaatgtggtattaaaatgttgtaaaaatttttgaattttgttttatttttttgaaattgaagtatattaaaggaaaattgttaatatatatttaaagtaagtaattatttggttagaatttaatgtaagttttataaattattttgaagtttgagtttaaggggtatattagagattaagaattgtgagttggattagtggtgttaagagtggatttttttattttttaatatatatataattttgtttattttggtattttaatttttaaggaaattatttaaggaattgaagatttagagtaagagttttggttagtagattggttttgttgttaaatttttttatttttttggtagagagattaatttttttaattagtattagtagaagataaatttgtttatatttttgttgttttgtagatttttttttttggtttttttttaatagaatattaaatttttagtttgtatatagtagagaaggttatttataaaatttaaaaagtgagtaaataggtttagattaattttaagagttattaggaattaattgtagtttattttgtggaggtgattatagtgtttttgatgaaatgataaagttgttatattgtaaatttaaggtagattatttttgtgtagtgttagttttttatttttattatatattgaattatatttaatataatgtattaaattatgtattattttttttatatatagtattgaatttattgttttgttatttatttgtttagaatattagaagtagttttgaaatgaattaataaattagttattgtttattagttttaattttaaataagtttttagattttttttagtttatttgttatttttaaaatttttttatttgaaaatttggtaattttggattggatggatttatattttttagtatagaagtttttgatataattgaaaaattaagttaaatatttaataagtggtggttatttagtatttttagatgttgtttataatagatgattttttttaattaatttatagttttttgaaagataattgagaggttgagggatggagattttttttaagtaatttttttttttattttaaatgagtttttaatgttggagtttggaaaataaatttgtttttttaaaagaaggtttaggaaatttaaaatttgaagaattggaagaaattagaatagaaaatgggtatggttatgatattgtagatttaatgtaggatattttatgttgtttttagttataggggttgaatttatttaatagtatgtgtattttgatttttagatttttaagggaatgttaagagagtaatgattttgttttaggttttaggttagatttttttagagttttttaaaataaataattattgaattattaaagtaaaatttttgagaatagatattttttaattttttttattaattttggttattaaaagttaagaagtttttttatttattagtaaatttttttttttatgattttattttgattgtttttttgtttgaggaagtagtatatggtggttaagagtataggatttagaggtagatatttttgagttaagggttttagttttttatttgtgagtttgagtaagttattgaatgtttttgagttttttttttttttttgaaatgatgataagaatagtagttatttgagtagttattgtaaaggttaaatgagataatgtttgtgaagtatttagtttattgtaggagttttgatgatattgtgtatttgaaaatagatgttatttgttaaaatttttgtttaaatttttataatttttaaaatttttttttgttagtttttttagttgttttttttagttttttttttgtgtttttatgtattttttttattttttgaaagtgaaaagattaatattggatttagagtttgaaaagtgttttttttttgttataatgggtaaaagagtatatttttgggttatattggtatttagtattagttattttttttgagtatttgatttgttttttattttagtggaggttttttgttttataattgtttatttttgtgttttttttttaaatagaatattgagtttattttggattttagagttaaatatatatagtattttagttttattgtttatttaagtaagatatgtgtaagatattgtatttttagtattggtagtaagttaaaatattttttgttttgatgttaaagtttagataattttataaaaattaatttttgtaaaagataatgagttgataaaatatttttagtaaagtagttatgtggtagaaaaattgttttttgtttatgagtttttttagagttaagattattgggttttatttgaaggtaagattttaagtttgttttattggtttgttttgtggtttaatttgtatgaagtttatgtatttttttatatgtgtgtatttattgaattattgagttattttagattgagaaagtattggagtttatttttatggtttattgtagagtattttgtgtagtttggagaatgttaatttttttatttgttaatttttattgtttttatttttaatgttattgtttgtgattttaatggtgttatggtttagggtttagattttgtggttatattttatttttgtatgttaagagtggtgtatagaaagttgagggggattatttagttttttgattgattttttttttttttttgaagaatttagtttattatgtttggtggtgaaataaaaattgatgtgtatggatgttaaagatttgggttaaattgtgtgtttatagatgtttttttttagtatataattttttaaatttagatatttaaaatattgtatttttttatttaagattaatataagtttgttttttaattaggataaaaaaatttaaatttaaatgtgatgttggatgagtttttaattaagaaattgattttttaaattttgtgattagttatttagtgggtggattttatttagtgtgtgtatgtgttttttgtttaattttggaaggttagaaagagaatttgaaattaagataagttaagttttttgttgtttagtatttttggtaaaaatatggttagattgtttaaattaattataggttttggaattttaaaaataattatattttttggttttttgatatattaagaattaattgttttgtatatgtgttgagtattaatgtttatgttttttgtagtagaaatttataaatttttatttatttgttagatatgatttttttagagaaatttagtatttaaaatttgaatttttaaaataaaatttaaaatttttgttttataaaaataaaaatgtgattattttatggttttttttttatagtttttgattgttttttaaaattgtagtttaaaaatattaatttaaaatttattattttaattatttttaagtattgtttagtagtgttaagtatatttatattgtgttattaatttttagaatttttttattttgtaaagttgaaattttatttattaaataatttttaatttttttttttttttagtttttggtaattattattttattttttgtttttgtaaatttaattattttagatgttttatataaatagaattatagggttttaatatttttgtgatgggtttattttattttgtgtaatgtttttaaggtttatttatgttgtagtatgtgttagaattttttttttttttgagtttgagtaatattttattatatgttttatattttgtttttttatttatttagtaatggatatttgggttgtttttatattttggttattgtgttgttttgaatatgagtttgtaaatttttttttgaagtttttattttttttggatatatatttagaagagggatgttggattatatggtaattttttttaatttttaaggaattattatattgttttttatagtagttgtattagtttatatttttattaatagtgtataagggtttttatttttttatatttttttaaatatttgttttttttttttttttttttttttttttttttttttttagttatttaatgtggtaaagtggtagttatttaatatgttgaagtgattgtttttaagggtttgtttgtggataattaattagttgaaagttaattatagtttgttagtggaagttttaattgaaaggagagtaagtatttttaaaaggagaatttaatttttttagtgatttagatttgttatgttagtatttttttatagaaatattttttgggtaaaatagtgtatatttgttttattgttgataaagtttaatttaattaggaaatttgttttttaagatttaaaataataattgaaataatgtatttttattaaaaattgtttttaagatgttagtttttagttgttttggtgattttaattgttatttatgagtgtttttttattttaaaattttattttaattggttatagttttaattataaagattattttaatatatgattttgaaaatttattattttgtaaatgggaaaatgtagtgatggaatatagtttattgtatgtagttttttatttgtttgaaaagttataatatatttaggtaaattaatttaaaagtgtttagtatttaatattgtaatttttatttattaaggataggttttttgtgttttttttttttttttttttaagtagtttgggaggatttgtttttttagttgaaaaatattatggttaaaaataaggtttaaaggtgaaagttgaagtttttgagggttgggatatgtttttgtttttaagagttttgtaaatttagatgttaagtaaatttttttaaaatgatttttattttttttttttttattataaaattggatatgttttagtggattaaattttaagtaggttgaatttgaaatttgtgggttgggtgtggtggtttatgtttgtaattttagtattttgggatgttgaggtgggtggattatttgaggttaggagtttgagattagtttggttaatatggtgaaattttatttttattaaaaatattaaaattagttaggtgtggtggtgggtgtttgtaattttagttatttaggaggttgaggtaggagaattgtttgaatttgggaggtggaggttgtggtgagttaagattgttttattgtattttagtttgggtgatagagtaagattgtgttttaaaaaaattaaaaaagaaatttgtggtgtgaatattggtatgtggtgtatatagtgagtttttaataagtatttgaattaataaatgagataatgattgaataattggatgaataaagagaatgtaggtttttaaaaggtttttttagaaatattgttggtttggtatggtggtttttgtttgtaattttattattttgggaggttggggtaggtgaattatttgaggttaggagtttaagataagtttgattaatttggagaaattttgtttttattaaaaatataaaaaaaaaaaaaaaaaaatagtaggatgtggtggtatatgtttgtaattttagttatttggaggttgaggtaggagaattgtttgaatttgggaagtagaggttgtagtgagttaagattgtgttattgtattttagtttgatgatagtgtgagatgttgtttttaaaaaaaaaaaaaaaaaattaaaaagaatgttttaattttttagttttttgtttgagatttattgattggtaagaagaaagttaaagaattttttttgattttttttgatatagatatttaaattttattattttatagtaaggttggggtttattttttttgttttataatagaagagtattgattattttttttgttttataatagaatattatttaaataggagttttttgagtgtgtttataattatttgatttggttaaattattttaatgttaatgaaattttaaaattttggaggaaaaaatttaaaaattatataggtgtataaagaaataaaaattatttgtttttttattatgtagagattattgtttattattttttaattttgtgttatatttgtatgttaataattgtaggattagggattgagtattgtttttaatttgtttttaaaaaatttatatttatatttttttttatttaaatagtgaggaagagtattagaattttgtaggtttgtggtgatggttaaattagataatattaatgttgggtatttaatataatatatggtttttaatattttttagattttagatatagtttgttttattattattgtttttttattaaatttatttttaaaaaagtgagaaaagtgttgagattataggtgtgagttattatgtttggttttatggtttttttttaataataaattagaagaagtagaattatagggttaaaaagtatttattttaaagtttttaatgtaattgtttgtttattttttagaaagtttgatttagttgtattttagagtgttatttttttgaattttattattattaaagttttaaatttggaatattggtaatttgataagtatattaggattttttttattgtaagtagtaaaatataatttaatttagtttaagaggggaaaatgtagttattggttaatataatttaattttggtttaagagataaatttagagttttaaatgattttagagtgtaataatttttgatttttgttttgatattatttggtttgtatatttttgttttatttgtatgttggttttattttgttattgataggttgtttgtatggtgtggaagaggatggttagtatttttatatttgtatttatatagtttgtaatataaaaaaaaaaaaagtaaaaaaaatttttttttttttttagtgtttatatattagttttttagaagaaaatgttttgttttatttggttatgtgaatggagttttttgattatatgagttaaatatgttttattgtagtatatttgatggtttttttgtagaatattattttattatatatagaatttttgattagtaattaatgggttatgagtttttgttgtaagttatttgaatttatattttatagttttttattaagtgtagttattttgtaagttgtttttgttatgatttttgggaagttgagtattttttttatgggttagggtttttattttaagaaaaagatgatttttttttttattaaatatgtgttaagattatatatttttttagattgtttagttttattgtgtgattttatataaattgttttattgggatgataagaataattgttttataggattgttatgagaatgaaatgatatattaatttatatgaaatatttagaatagtttttggtataaagtaagggtttaattaagtagaaattatttatatatttataatattatagtattggttaagttgtttttaatattgtttagaattgtttaagttttttttgtgataatttgatgaaggttatttattattagtgagtaaataatagtggtagaatagttattgatgttttttttttatttggttttttttttataaatatttggtttttgtagattaaatattggtttatgtatagatatgttattttaaaataattttttatagtggtaatattaaaggaagaaaaatgtttttaaagttatttatttgggatgttaaaggagggggaaattaagaaagtttatatttttatgttttttgtgtttagaattttattaaatgttttttaatttgttagtagaggaaagttggatattgtttgtttttgtagttaatatagttaaaatatttaaatggttatagtgttaaattagtagttaaagtttttattgtgaatggatgaagggatatttttttgaataatttaagttgatttattttagtggtttaaaaaatttttttaatgtttaattatgatttaggtatttaattattatattatgttttgtaatagattgttgtgtatttatttatttaataggtatttgtgtagttaatttattgagtatagtattgaattgttgatggtttaggttatagttgaatattttattttttatgtttatttatttatttatagtatattttatttttaaatttttagtttattgtattttaaagtttgaggtttttgtgaagtatagatttttgggtttaagttttgttatttaatgttaattattataggtgtattggttagtttgtttttagaatttttagatatatatatataaaatatttttataagataatttatttatttttttttttatttttgtgttttttaatataggattaatgtttagattttttttggagtaaaataattttttgaatttttgagatgtatttagtgattttagtttgagtatgtatattgtattaaaaaatgtaattttgttttttttagtggttatttggtaatagtttgattataaataaatgtagttttaaatatagaaggtttgaggtaagtatatagaattatggagagattatttagatgatgtagaatatgttttttttttttttataatgttattaaaatgaaaatatggttttaaaaatttttatagagtgtaattttaatattgttttaattttattaaataaagtattgttatgttgtaatttttatttattattttttggagttgtataaattattaaatttgttttttgtttgatattttttttaaatatttgagggtagttattatgttttttttttttatttttaaaaaatagttttaaattttttgaattttttaatttaaaaattatatattgagtatttgatttgtggaaaggtataggttatattaaaaatggggttttatattaaaatggggaaaagggtggagatttttaggtggaatttgagatttgttatatattaatagtgttatttaattttttttaaagataaagaaataggattagaaggttattttggaaaatttatttggtaatattggataggatggattagtatagttggaaaatagagatttttgttttaggagagttgtttttttgttatttttagaattttaattatggttaaggtttagagttaaatatttaatagaagaagtttttagggtatgttttttattgtatatttttattttaatatatgtgtttttttttgttatgtaagtattttattattatttatgtattttttattaaagttaagtaaataattattttaaggatatatttttttatatatatataaagtttagggttattgatttttttaggttttagttttagatttgttattatttaagagtatataaataagggaaatagaaagaaaaggatttataagttgagaaggaagtaatgtagagaaagaagagtgatagagtaggtaatttggggaaagttagtgatatatagtttttaattatgaatagtgattttttatttttgaatgtttgtgatatttatgaaggtattaaaagttgatttttaaaaaattgttttagagaattggaaaaaaatttagttgttatatttttttttaggttatttttgaattttatttatgtatttatgtgtttaaggtaaagttttattaaatgtatatttgtttttgttggtttattgatttttattgttagttttttatttttagtaattatattttatattatatagtattgtgaaatttattatatttagtgttttgtttgataaatatggtatgttataggatgtgtatttagttatagttaaaaataaattatttttgttttttaaaatttgttggtttatttgttaagtttttgttttaagatttgttaatgttttttaaatttttgtggttaaattatttgagtgtttagttgttttatggatttttagggatttatttgttagagattttgatttggtaattttgggatggaatttagggatttgtaaattttataagtatttagaaatgaaatatagattttaaatagttaagagtgtttattaggattatgttgatattattttttaaatagatgtgttaagtttttaatttgaatttttagggttgggatttggttttttatatttgggggaaaaaagttttattgatgattgtggatatatattataggttaattattgaatagtttagttagtgtagttagtgtattttataattattaagttttaagtatgtggtgtattaatgttttaggaggtggatatattttttgtatttgtaaagtatttgggtaggttttttaaagagaaaagtatgtaataaattagttttgagtgttgtttttttatttttttgggtatttttgaagaatatgttaagtatttttttagagtagaggggtttagagtggtttttagattattattattggtaatatttagttggtgtattattaatttgttagaaatgtatatttttaggtgttatttagattttataaattagaaattttggaagtaaggtttagtattttgtgttttttttttttttattatattttaagttttagggtatatgtgtataatgtgtaggttagttatatatgtatatatgtgttatgttggtgtgttgtatttagtaatttgttatttaatattaggtatattttttaatgttatttttttttgttttttttattttataataggttttggtgtgtgatgtttttttttttgtgtttatgtgtttttattgtttagtttttatttatgagtgagaatatgtggtgtttggttttttgtttttgtgatagtttgttgagaatgatggtttttggttttatttatgtttttataaaggatatgaatttatttttttttatggttgaatagtattttatggtgtatatgtgttatatttttttaatttagtttattattattggatatttgggttggttttaagtttttgttattgtgaatagtgttataataaatatatgtgtgtatgtgtttttatagtagtatgatttataattttttgggtatatatttagtaatgggatggttgggttaaatggtatttttagttttagatttttgaggaattgttatattgatttttataatggttgaattagtttatagttttattaatagtgtaaaagtgtttttgtttttttatattttttttagtatttgttgttttttgattttttaatgattgttattttaattggtgtgagatggtattttattgtggttttgatttgtatttttttgatggttagtgatgatgagtatttttttatgtgttttttggtagtataaatgttgttttttgagaagtgtttgtttatattgtttgtttattttttgatggggttgttttttttttgtaaatttgtttgagtttattgtagattttggatattagttttttgttagatgagtagattgtaaaaatttttttttattttgtaggttgtttgtttattttgatggtagttttttttgttgtgtagaagttttttagtttaattagattttatttgttaattttggtttttgttgttatggtttttggtgttttaaatatgaagtttttgtttatgtttatgttttgaatggtattgtttaggttttattttatggtttttatggttttaggtttaatatttaagtttttaatttattttgaattaattttagtataaggtgtaaggaagggatttagttttagttttttgtatatggttagttagtttttttagtattatttattaaatagggaattttttttttattttttgtttttgttaggtttgttaaagattagatggttgtagataagtggtattatttttgagggttttgttttgttttattggtttatatttttgttttggtattagtattatgttgttttggttattgtatttttgtagtatagtttgaagttaggtagtgtgatgtttttagttttgtttttttggtttaggattgatttggtaagtattttgtgttttgagaatttttttaggggattgtgatgaaaattgatgtttgagaatttttattttagagtaaaaattttatatatatatttttgttgttttatttatttagtataatattttttttttttgaaatggagttttgtttttgttgtttaggttggagtgtaatggtgtaattttagtttattataatttttattttttaggtttagttgatttttttgttttagttttttgagtagttggggttataggtatgtggtaatatgtttagttaattttgtatttttagtagagatggggtttttttatgttggttaggttggttttgaatttttgattttaggtgatttgtttattttagttttttaaagtgttgggattataggtgtgagttattgtatttggtataatattttatatataattagggtttaaagatttgttgagaggtttaatattaattttggattaggaaagattttatttatattattagttaggaataatttaaaaataaaaagtatattttttttataagtaatattttaatatatattaatgtaaatatatggaaaagtattagttatttaataaattaatatgtaaatgaaaaatttatatattatggttattttagatgtgatatagattttatttttagaaggaattttttaatgtaaaatagtgatttttttttttgtttattttattgtattagaaaattatatttaaagtaagtattttggtgaggtttggaaggtgaataaatttattttttttttaattatggatatttaagagagatgttgttgtgttgtttagataataatgatttaaattaagaaatttagttgtttttaaaaataaaataagtgtatgtattttgaatatttttttttagaaataaattattttatttgtttttttgaattttaaattaattatatagaatttttaaaatttgaaaattaggttagtatgagaaattgaagatattgaattatattgtttgtttagtttatatttttttttaggatatatagtaggaaagaaatatgatagtttaagttagattattattttttttagagttttttgataaatgtaggtatagtgatagtgttagtttatggtgaatttttgttaaaataaattataaaaaatttgtgattttggtattttgaaattagttaatatttgtaaattttgttaatattgtatattattgtattttggttttatttgtgtatttatgagttatatgtgtgtatagttatatatgtttatatttatatatatatattatatataggagtggaattatatttaattttttttgtatagtttgttttgtttatataatattatattgtagtatttagtataagtaaagattaatttttgtagattttgtttttattttgaaattttgtggtagttggtttaatggaaagataatttttgtgatgtgttttgttagttagggattgattttggtaaaatattgttggataataataagtaatgtaaaaatatatttgttttataagataatttttgtgaaggtagagatttggtttgttttgtttattgtattgtgttttgttttgggaagagtgttagatttatagaagatgattaagaaatattttttgaatatattaataatattttttaatatgtgggtattttaaaggtttatttttaaagtttattgattagaatttagaagatatttttttagataaaataatagattgttagttgttttgaaaatgtaatttatatttaatttgaaatgttaggtttttgttattttttttattaagtagagatagggtttttaaaaattatatgtgatgttttaagtattttggttttgtaataattattagatagaaaatgtaataatagattttattaataatatttttaataatatatataaaatatttgtttaaaagtaattttttttaaaaaaataaagttggttaggtgtggtggtttatgtttgtaattttagtattttgggaggttgaggtaggtggattaagaggttaggagtttaagattagtttggttaatatagtgaaattttatttttagtaaaaatataaaaaattagttgggtgtggtggtaggtgtttgtaattttagttatttaggaaaattgtttgaatttgggaggtggaggttgtagtgagtggagattgtattattgtattttagttttgggtaatagtgtgagattttgttttaaaaaaaaaaaaaaaaaaaggtaataggattaggtattaatttaatgaaaattttgtgatagtatttttttgaaaaagattgtggaaattaaagttagtaaatttttgtttttgtttgggtttggaaaatataaagatgataaagatgtttaagtatttttttttttttttttttttttttttgagatagtgttttgttttgtttggagtgtagtggtataattatagtttattgtagttttgaatttttgggtttaaataatttttttgttttagttttttgagtatttggaattataggagtgtattattatatttggttagtaatttgattggttaagaatattaattataatttatatatttttttgattatatttgtttaggataaaatagtaaaagatatgagtgtagatgaaagtgataagggaattaattttaaatattgaatttttttttagtaaattggttttttagttttttagttttttttttatatttttaaattttttttttggtaagattatttatttgttttggtttatggtgatattttttattgttatattggtgggtgattgttttaattgatagttgtttttttttattttaggaagatgatattgttggttttgttggttttgatgtttattttgtggttaatgtttgtgtttgtttgtgtttatatttattttatgatttatttgttaatatttattaagttgtttttttgtgttaggaatttggttagataaataaatggttgtttttgtatatagaattagttgttataattagttattgtagtatttatttttgtaaaaatatatatttatattttaattagtgattgaattttaatttattaatttatatatttagttagtatataattgaatattttttatgtgttagaaattgttttaggtgtttgggatgtttattgaataaaatagataaaagtttttgtttttatggaatttattttttagtgaaggtgtggattggtgggatagaaaataaaataattaagtaagatatgtatttaggtttttataaaaatatagtagggtaagaggattaagatggaggtagtgattagggaattttaatgagggtgagattgtgataaagatttgaaaaaggtggagaagtaagttttgtgggtatttagggtagtagtagtttaggtaaggggaataattagtgtaaaggttttaggaggtaatgtgtttgaagtgttttaagaatagtaaggaggttagtatggttagaatagaatgagtaaagggggtaaagtggtagaaggtgagattaaagaggtaatgaggttattgtggaggtttatatggattattggaagggttttggtttttattttaaatgaggtaaaaattattttaagtagagaggagtgatatgatttgattttttgttaaaaggattattttagttgttgttatagaaaaagattataggggtgtaaagaaatagggagataaaagaatataagatttttattgtaatttatatttagtatgtttgtttatatttgaaaatgtatatttagataattgtagtaaatttaaatattatgtttatttaatagtattaatattgatatgttggttaattatgattaggagtattaataaagtataaattagggatttttaaaaagaatgttgaaagggtagttagttttttttgtgttagaaattaaagttatagtagatttggggtaaatatgttaaagttaaatttatgtatattattattgagaagataaagatgaatgtgtgatagttttttgtttttaagaatttttaagtattgtgaaggaagattaatatagttaaataattagagtgattagttttattagagaggattagttttggaagttagaggaaaaaaaaaaaaaatagaaataaaatgatgtttgaattaaatttttaaaagttttttttataaatttattaagttatatattgggaatggtattttaggtagaaggagtagagtaagtaagttagaaaggaaatattatggtgtttttgagtaattgtagtgtggttgaagaatgtggaaaatgatgaggataaagaggtggatagggaattaggtaagggagggtttttttttaaataattagattttgttttgtgtatatttaatgggattttaattaggttataatgttaaatttttttattttggaaggatttttatggtgatggttttagaaagaaattaaagtagagtaatagtggttagtaataatgattagttagtggtttttaaatttatgtattatatgtattttggaagtttttaaaaatttagattttgggattttgatttagatttattgaattagaatttatagatttaaatttttagtgaggtttaggaatttgaaatgttgaatgttttttatgatgtagttagataagtatttgggaataaagtattaggtgattattttagtagattaaggagtgggaggttatttaagtttaaaggttattttattttttattatatttttagtatttagtatagtgtatggtatttgatagatgtatttttttttttatattttgttttatatatttttttatgtgtatttttattaatattttttattataaattggtaaatatgtttttttgagttttgtgagttgttttagtaaagatgggtttgtgagaattttaatttttgaagtttgttagttagaagtttttgaggttagatttgtaatttttgttgagggggtagttttggggattgagtttttaatttgatattgtttttaggtagatagtgttagaattgaattgaaggatatttagttggtgtttgttgtagaattgattgtttatttggtggtggagagaatttttttttttttgatagggttgtagaagttgttttttgtgttgttgattgttgtggtgtgggagtagaggggggaaaaaagttgttggagagttttttttaaaataataggagattatttagatttataaaaatagaattaaagtagattaattgagtatattgtgaaatatagagtagagttgtgtgtaaggagtatattttaatgttaagttgatattaaattgaatgtttgttggaatgtttaaaaatttaagttttttaaatttgtgaaaatatttaggttagtaaatagttttatgtaaatagtaagataatgtttaaagttatttaaggaaaaagaatagtaattgaatttttttatggaaatgtgagatgttgttttagtaagtattgatggtgttatattttttgtttatttgtttgttggtattttagtttttaaaatttttttaaatatgttgtaaaatataaattaagaatttggtggattttttatttgtttttttgtgggaaatgatggaattaaaaattttgaggattagattttgagagttattttttagtgtttatgttattattatataaaattttggaggataaaattttttttatttaaaaattagttagttttagaaaattattttatgttaggagattgtattattatagtatgtgtgttagttttaggtatagatttaaaatatttttaatattttaaaaatttaagtttttttttattaatttggtttaatataagttagaataattttaaaaatgagtataaataataaggaagggttaggtgtagtggtttaatgtttgtaatttgaatattttgggaggttaaggtgggtagattatttgaggttaggagttttagattagtttggttaatataatgaaattttatttttattaagaatataaaaattagttgggtgtggtggtatatgtttgtaattttagttatttgggaggttgaggtaggagaattgtttgaatttaggaggtagaggttgtagtgagttgagattgtgttattgtattttagtttgggtaataagggtgaaatgttgttttaggaaaaaaaaaaatagtttttgtgattgttagataaatgttgagtaagtaaaatattaataatgttgaatttagatattgaaatagttgttttgtataaataaagtttattgggagtatagattgaattattattttttgatttttttgttataatgattggtattattggaagggattattttgttttgaagagttgttggatagtagagtagagagtatttattattattgtaggtgttttttagttaggattttggatttataagtaaattttaagaaagagtttggttttgagtttttttgaatagtttaggttaagttttaaattttgaagttaatttttataattttttttttatgtttttggtatgtgaagtaggtaaattttgaattttataataatagtttagatttataaatatttgttttggtaattaggatgagtttttgagagataatatagtttagtgttaattgtgtggatattagattgtttgagtgaaatataggttttattatttattaatggagtaatgttgggtaagttatttagttagggtttttatttgtaatatggtgataataataaagattaaataataggtgaaaaatgtttagaatattattgtgttattagtaagtattatgtataggtgtttggatttaaaaatattggtaaaggttaggttgggtggtttatatttataatttttgtattttgggaggttaaggtagaaggattgttttagtttaggagtttaggattagttgaggtaatatagattttgtttttgtaaaaaatttaatagaattagttgggtatggtagtgtgtgtttgtagttatttgggaggttgaggtagggagggggaggattgtttgagtttatgattttgaggttgtagtgagtttatgattatgttattgtattttagtttgggtgatagagtaagattttgtttttaaaataaaatgaaaataaaattgtaggtaaaaatgttaattgaagagtgaatatgaatttttttttgtattttttttgggtttgagattttaagaagtgtagggtagttaaaatgatgagatataatttttatttattagtttagtagaaattaataagattaaaaagatgtgtaatatataatattgtagagtgtatgggggaattgatatatatatttatgaattggtagagataaaaatgggtatagaattatttggaaagttattgtgtattttaaaaaattttagtagtatattttttatattatgaaattttattttagaatgttagttttgtagaaatattgatgtaagtgtaaaaataataaaaattaatttgtatttttaaggttagaaagagttattttattaaataatataattgaggtatattaattttattagaagtaaatttgataatttgtttatattttaaatagttatggtttaattttagtttttgaagttatatatttttataattaggaatgttaataggttttttgtgtaatatgaaaagatgattttaaatgtttataattattttgtgtttttttatttttttttaatttttattgatttattataaagtattaaatattttatgtttttaatttgaagaataatagatattttttataaaataatttttgtttatttatgaattttgtatataagaagtttaataagatgggtttaaaattatttttttaaatatattttttatataaaataattttaagatataattgttatttttgtgtttaatattgtatgttaaataataaaatggtaagtatgtaaaaattataatattataaagattgagttattttgttagtagtatattttaattttagttttagaatagttgtagaaatgggtaaataaattgttttaattgtatttttaattgaaatatagtattttatgtagtagtagaatatattagtagaagaattttatttgatttgtatttaaaaataaaatagatgtaatttataaaatttagagaaatatagtgattttatttgtatgtggaaaatgtatttttttttgatttatatattttttgttgtgtaatgtaagtagtaaaataaatagtataggatttatttttgtgggatttagattttttggtttaataaataatttttggttagtattgtaattttgtggtataaaattgataaaattagtttttttgtgattagataagaagttgggtagtttaaatgttgaaatttataagaattttagaagttttagttttaagttttaagtttatttagaaatgttataagatttttagtagttatatatgaagaatattatgaagatttttttattaaatttttattatagattttttgattggtttttgtttagatttattgtgtgataaaggatataataatttttattatttttatttaatataggtttgttaattttatattagttgtttttttgaaggttggtttttttttaaaatttagttttatttttagtttatattagtttttaaatatattgttttttagatgttttatttaattttaaatttttaatggatttgttttagatatttattgttattttttagatagttattgttatttttgaagttttggatgatatgtgtattatagaggaattggagatattttattattatagttagtttgattggatattttttaaaagtatatatttgtgtttgtaattttagtattttgggaggttgaggtgggtggattatttgaggtttggagtttgagataagtttggttaatatggtgaaatttgtttgtattaaaaatataaaaattagtttggtatggtattatatgtttgtaattttagttatttaggaggttgaggtaggagaattgtttgaatttgggaagtggaggttgtagtgaattaagattttgttattgtattttagtttgggtgataagagtagaattttattaaaaaaaaaaaaaagtatatatagtatatattataaggtttttaatttttttattaagtgttttatttgggtagttatttattggtagtttatattagttgagtggtttagaaaaaatatagtaagttgtttataaaattttgaatattttggttaggtataatggtttaagtttgtaatttgagttttttgtgaggttgaggtaggagaattgtttgagtttaggtgtttaagattagtttaggtaataaagaatgtttggaatgattgtggtatttgaattaatatttaggtttaataagagataattgattattattttattttagaggttttatttgaattagatagaaatttattttttatagttattattgtttgttatttataatttaagggggttggggaggaagtgagagattttttgttagggttaatagggatttgttagatatttttttattttgggaatggtgtatggaattttagtgtatgttggagttattattattatatttgtttttttattttatttttttgtttatatagattaagttttatgttttatttttaagtttaaattgaaaatatttatagagaataatgtagtgaaatgaaaaaattatagattgttggtatttgtatttttatgtagttttagtgattaatttttttttattgtatagtattgagaaaattttagtttatataattagttatagtttatatagatttatataattagttttaagtgataatagttttttttttttttttttttattatttaattagatgaagataatagtttttaatagtttattgtaaattttaaggtatttaagttaaattgatttagatgtttgagttgaaatttttttattaaagtttaataatatgtttatattttttattaaagtataaaagttttataaatatataaatttgagtaagtattaaaattagtattagtattgttataatataatatgttatattgtaataagagtatttgttgagaattgtgtttgttattttagaatgttgtttttatggttgtattttttaattttgtagattatttggaaggaggagagatttggggtggagataatttggtattttatttataggatgtaaggaggattaagtaaaataatgttggttaaaagtttttatttagtatattgtttaatgtttattaaattataatagttgtttttaatatttggtgaagaatttatttaataggagtgagttgaggggtataggagattatgtgagtgtttaaagtagaagtagtattttttattaagaagagaaatattgtggaagagtaaagattttaaaatatttgggtttaaattttatttgttatataatggttatttttaatttattgaatgttagtttttttatttgtaaaatagggataatatttaatttatttataggttgtgagagaattaggtatttagtatagggtaatgttggtatatggtaatttttaataaattgttgttatttaataagttattagatgttattaggtagttaagtaaaggaagatagtttttgtttggtgtgataatgaaaatttttttgattttttttttggaagagttttttgaagatatgttattgtattgatatttttatttttgttaatttatttttttaaattttggatattgtgtgtgttatagtttttttttttttatatttttgtatttatttggtatttgttgtgttagtaatagataaggggttgttaagggaggaggtaatttgtattggtttatagttgttaatgttagtttttatagtttattgttagtgttatttatgtggtaaaagggtgagaaagtattggagtttaaagaaataagtagaaattagtttgtagttattattgttttatttgttaataatttttgtttttaagttattatgtataattttaggtagtttttttagttttaattgtggtttttttgtattgagattatttttgaattttatgaagtatagttttagatgtataggttattttaaatttttgtttaaaataaaaatattttttttaattatatatgttggggaggaaatatttgtttttgataggtttaaagtttggttttggattttttgtgagagttttttatgtgtgtagtaatttaaaatttgtatagttgttttttataaaagtatattaatttagtagataaatttttatgtaatttaattatatggtattttttaatttttttgtgataagtagaaatgtaaagttttatttaagttaaggtaaattaatttgtatatattttttattttgtgttttttttgttgttgttaagtaggataagttttgaatgttgaaaagaaaagttttgagatgtagttagattttggtgaagtaaagaatttgaagttttttatgagtttgtttattagttgttatttttatataatgtgagtttgtattttgataaggtttttgtgatgaggtttattattagttatttgtgtgtgaggaaatttttggatgttggtgagttattttataagggtataaataggtttgaaaattagaagttagaagtaaatagaaattatttttagaaggtggttgtaatgttttgattttgtatatttttttatattgtgatatgtatatgtttaaaaatttttttgtaatttttattatttttattaagttttattttttttttattagttattttttgaaataattattttttatgtatataatttgttttgttttatttttttaaatatatttttaatttttttttaatataatattttttttattatttgtttttaaagttttagttaggaataagatattggttttttttttttttttttttttttttgttttatttatttttttttttttaaaaaatatgatttaggttgggtgtggtggtttatgtttgtaattttagaattttgggatgttgaggtgggtggattatgaggttaggagtttaagattagtttggttaagatggtgaaattttatatatattaaaaatataaaaaattagatgggtatgttggtaggtgtttgtaattttagttattagggaggttgaggtaggagaattgtttaaatttagagggtggagtttgtagtaagttgagattaagttattgtattttagtttgggtggtagagtgagattttattttaaaaataataaaataaataaataaataaaaaatattatttttttttttttttttatggtttgttttgttgtattattttaattatgaaaagtagttggtatatttaattatagtttttttagtttttggtttgtatttttttgtgttgaaatggttgtatatattaaataaagtgtttgtgagaaaattttgtaaaaatatttaaatattatattatttaagtataattttttaattaattatttttttttttttgtgttttttttaggtgatttggatattgaagatgatatgaaagtatagatgaattgtttttatttgaaagttttggatggttttgttatggtttttatagatgatggtgatatgatttatatttttgataatgtgaataaatatatgggattaatttaggtaaaatgtatatatattaagagtttttttatatgtttttatgattttatgatttagttttaatttttaaaaatgtgtttatagtttgaattaattggatatagtgtgtttgattttatttatttatgtgattatgaggaaatgagagaaatgtttatatatagaaatggtaagaaaagtttgttgtttgatttaatgtgataggtggttttatataataagatattattgttaattattaaattttgttattgtatttatttaaggtaaaatgttattttatgtttaataaaatgtttattttttgttaaaattattattttagtttttaggaattttattttgaaagtttatttaattgtataaataattgtgtgggtgtgagaaataaaatggaaaagtaaaattatgattaagagagttataaataattttttttttttttttttaagatggggttttgtttttttgtttatgttggagtgtagtggtataattagttgattgtagttttgattgttgggatttaagtgatttttttattttagttttttaagttagttgggattatagatgtgtgttattatgtttagttaaatttttaaaaattatttgtagagataaagttttattatgttgtttaggttggttttgaattattgggtttaagttatttttttattttggttttttaaagtgttgggattataggtatgagttattatgtttaggttattttttttttttttttttttttaaattgtgataggggtttttgttgtattgtttaggttggttttaaatttttggatttaagtgatttttttggtttagttttttaaagtgttaggattataggtatgtgttattatatttggtggagttaaaaattaaaatatattattaaggtaaggagaaattataatataaatggtagataataggattttagatagttattaaagttgaggtgttagtttgagtttaaggtttaataaaaaaagtttattagaattttaagataaataattgtttatttgatttttttggatgtttttaataatttgagattgtgtagttagattataaagtattatattgtggatgtttatatattaataaaaatagagagtaagatttttaatttttaggaattaattgttaaaaataattaagtgttttaagattttttggaaattattttttgaattaaaaaattaaagtttttttatatttttattttgttaaatagtgtatattgattataattatttaaaaaattatgtgttttaagatttttggaaagtattttttgaattataaaaataagaaagtttttttatatttgtgtttttttaagtagtgtatattgattataattgaatttttttttatgatggaaagttattataaggaaaattttttatgttttgttgttttttgttgttttttaatttaagtgtatatgtttgtttgtttttatattataaaattttaaatttattttttgtataatttttgaggtttttttttttattttatttattataataatagttaatttttattgagagaatgttgtgtgttaggatattgttttttttattttatatgtttttaatttttttattttttataataattttgtgaagttaattgttagataatttttattttattaggaaattgaggtatagagttattaagtaatttttttaatattatttggttagtaaatggtagagtttgggttgaattttagtagattggttttagagtttatgtttattagttttttggagtgttttttatatttttgaatttttatattttgtttttttttattttgttagtaggatttgatttttgtttttaaattttatattgtgtttttattgttaatttggaaaataaatgtatattttttagaattttgtataaaggaggagtaaatatgttgtgaataaggatttaagtgggttgttaatgagtttaatatatgagttttaatgtgtagagttgaggtttatattgattgtttagtgtttttttggggttagattataaatggatggatattaggaagttttgttttgatttggtaatgatgttaatgtattattttaaattagatagttttaatatagtttaaatgtatgttttgaattaaatgtttttttttaaagtatataaatattttgaaattattattaatgtggttaatgaattattgatgttttattgggaaattaaaatgtagattttttttttttagaaattagggattattgtaaagtattatattttagtgatatattgagagttagtggtgtgtttatataaatagttttattttttaaataaattttagaaaaatgttttagaatttataaattatataaaatatgatttatttttagagagtttaaaatttaggtttttttaatggtttgtttttgtttgtttgttttttgttttttttttttttattaggaaaatattagtattttttagttattttgatttttaaattaatttgtaggtttttatttaaaggttttgggttttttttaaaggttagtataatttaagtttagtttatgaaggattgaatatatttaaaggattttgtatgtggatttttattgttattattataattattaatatttatatatatatgatatatatatatttttttttttttttttttttttttttttttttttttttttttttgtattttttttttttttttttttttgtttttatggtattttttaaaaatatatttttaaatttttttagggagggtaaatttattttttaatttaagtaaatttaaatggtatgtattagtattaggattgtttattttttttagttttattatttatagagtataggttggaatttattttgttttttaagagtttagtatttttagttaattatgtttatatttaaatttatttttattttttttttattttatagtgtttttttaatatattagtattatagtttttagatttgattttttttttgttttatttttattagtttttaagtttattaagattttatttttttatttgttttttgttattattttttttttttatattttattggtttagtttttttattatagttatttaattttaatatatatattgttgttaagttaattttttttaagttattgattgtgtttttttaaagttttttgttgaatatttaggtaggattttatgtggatatttatagttttttgtggtatagttttaatttttttttttagttttgttttattatttttttatgtgtattttatattgtggataaattattatatgttgttttttaaatatgttttattttttttatttttgtgttttttatttttttatttttttttggaatatttttttaatttatttttatttattgatattttaatgtttttttttttaagtaagattttttgattttttttgattagaaattattttttaagttttttttatttttttttaaagtatttttataagttttaagtattaattttatattgtgtttttgttgattttattatatttattatatttttaatttttttaggaaaggtggtgtattttatttatttttgtattgtttataatatttagtttaggttttgaataataaatatttttatatgtgttttgaagtatattgattaatgaagataagaaattaagaggttagttttttattttttttaatttttttttttgagatagtgttttattttgttatttaggttggagtgtagtggtataattttagtttattataatttttgttttttgggtttaagtgatttttatgttttaattttttaagtagttgggattataggtatgtgttattatatttagttgatatttatatttttagtagagatggggttttgttatgatggttagtatggttttaaatttttgtttttaagtgatttttttgttttagttttttaaagtgttgggattataggtatgaggtataagttattgtgtttagtaagatgttttttttttagttatttaaatataattttatttttagttatagaaggtttgaaattggagtgaatagattttatttaattttgattttatttttgtagttttttttttttgagatggatttttgttttatattttaggttggagtgtagtggtatagttttagtttattgtaatttttgttttttatgtttgagtgatttttttgttttagttttttaagtagttgggattataggtatttattattatatttagttaatttttgtatttttagtagagatagggttttattatgttggttaggttggttttgaatttttgattttaagtgatttttttgttttagttttttaaagtgttgggattataggtatgagttattgtgttttgtttatttttgtaatttttgataagttatttgatttgttgttgttgtttttttatagtaataaagtagaagtaattttttgtttgttttattagataaattaaggggaaaaaaataagatatgtaaaaatgttatttgttattaaaaagaaagttgttattttaaaggttttataaagatatagagtgtttattagaaattgagttaatatatttaggaaaggataggaagagtttgttgaagttttttttttagggatttttgtgtattgatagtatagttaaagagtaaatttatattatttttatatttttgtgtatttgattaagtttattggttttaatgattaattgttattttaaatatggattattttttagttaatttagggaattatagttattgagtagtgtgtgttagattttttgggtgtgttggagtgagtaaaaggggaatgaattattgtgtttatgttgagatttaattgaatgggtatttagttgatttaggtgatgggtattttgttatttttattgtaataaatttgtatatttagttgttttaaaattttattttatgtttttattaggttttgtgaaaaagggtaaagaataaaatatatagtgaagttttttttttagaatgaagtgtattttaattagttgaggaagaattatgaatataaagtttgtaatatggaaggtaagtgaaaattatttgtgattgattatatattttatttatatatagatattgtagtattaagataattttagaattgtgagggaaggtttatagttttatggtgtttggttatgtaatatttatatttttaatttatttgtatgtgatttttaaaatgtagaattgtgtagtaatttgttaatttgaggtataaatttaaattatgtgaattgtggtattggtgttttaggtttaattagttggttttgttagttatataatatttgaattttgatagggtttaattttttattaattatggttttatatttttgtttaatgttgaaatatagttattagtgtaagaaataattattaaatagttatgatgatgagatgaatgaaaaagtagtttagattttatatgaggggaattttttaaagagtaatgtataggttttgggtaggaagtaggttataggtggtattataggaaaaatgtttattgatttttaaaaatgtgattaatttattagtgatagtaaattttattaaagtttattggttatgttagatttaattatttatttttgttttttttttttttagtattgtaaatattttttttaattgttttgttttttatatataggtattgtattgtataggttatatttatgtatatgatattaatagtaattaattttagtgtgggtataagaaattatttatgatttgtttggtgttgatttgtgaatttattttttatttattaaatattgaaatttttttagatagtaagattttttttagttgatatagtttggatatgaaatttttttattgtgatgaaaggtaaattagatttaaaatgtgaatttgaaatttttaattagtttatagtattattgaatatttattatagtaaagatttagtgttggttatgtatggtggtttatatttgtaattttagtattttggaaggttgaggtaagtggggggtggattatttgaggttaggagattgagattagtttggttaatgtggtgaaattttatttttattaaaaaatataaaaattagtgggatgtggtggtaggtattatttaggaggttgaggtaggagaattgtttgaatttgggaggtggatgttgtggtgagttgagtttatattattatattgtaagtttggatgatagagtaagatttttattttaaaaaaaaaaaaaaaaattatttaatgttaaattatattttttattaaattgaatagaatgatatattttataatattagattaattttgtaaattaatttagttatatttattgaatatttattttgtattatgaatatttattttattaggtgttatttagaagttaagatgagtttttttttttttaataggggttttatttatttagagaattttaaagatatgtagtgtgtattttgagtaaagatagattattttaggttggggattagaaagttaagtgtttgtatatttttttattttatatattttttttgagaagttttaattttgtttatggtttttattattattttttatatttttttttgtaattaattttatttaattgttaatttaatatttttatttggatatttttttgtattgtaaattaagtattattgtaataattgtattattattgtttttaaataatattattattaaaaattgtttttttttttataatgtttattgtggtttaatatattattatatatatatgattttagtaaaattttggaagttatttgtaattttttttttatatttattggttatatatagttggtgtttaaattttatagatttattatttatatatattttttgatttatttttttttttttatttttgtatttttgttattgaatttattagtttattattatttttgatttgagttgttggtatagttgtttttttgttaatagatttgtatttttataattttttatttaagttgttagaaagtgggtgttttaatgtgaaaattagattatgttattttgttgttgaaaatgttttaaatgtttttttttatttttgtatataaaaatattttgtttataaaaatattagatgagggaagtaaattttttatttattaaaagaagatgtgtattttagaagattgaaaaaaaatagatttatataatataatttaaatttagtatggtaaataaagatatttatgttttggttttaattttgtttttggaattagatgttagatttatttatggtttgtagttttgatatttataatgtggttttggttttggtatttaattgttgtaaaatttatattttttatttataaaataagaattatggttgggtggggtggtttatgtttataattttagtattgtgggaggttgaggtgggtggattatttgaggttaggagtttgaaattagtttggttaatatggtaaaattttatttttattaaaaatataaaaattagttgggtatgggggtatatgtttgtaattttagttatttgggaggttgaggtaggagaattgtttgaatttaggaggtggaggttgtagtgaattaagtttgtattattgtattttggtttgggagatggagtgagattttattttaaaaaataaaaataaaataaaaaaaagattttagaaggatgttgttaggattaaaggagtttattgagtgtttagtatagatagtgaatgttttattattggtgttaattttaagaaaatgaatatagaaaagttaagaattattttaaggtgtttattattagtatgtaaatgtatgatgggatagagatttttattttattttgaggaattattttttatttttttgaaaatttaaggtaataaagtagagaggaggttagggagaaaggaaggtagtggagtaaaaatgagaaagggagtgatatttttttttagttatagtagaaaattagtaaaatgattatgataggaggtaatagtaaagatagttagtttatatattaattaagatagttttgagtttgattagtagattgttattttttggtttagagttttttttaggaattttttgtatttataatttttgagaattaagttatggaaaaaattttgtttaattttaagaaaatttaatatattaagttttttaattttaaaatattttataaatagttgttatttattatattgagtaataattatttaaaattatttaatattttatttgagtatttattatgtttatggtattaaagtagaaatgaagatgaatagtttttgttttaaaataaatgagtagtatattgttttagattatgggttttttagtttattaaaaatattttttggttatattttttggatattttgatttttttggtatagaatataatttatgtaattttttaaagttaaattaattttattttttttgttttaatatgtgtaaaattgattttttaggaaagtatatatagtttatatttttgattttttggtattttttagtgatagatatattttagattgagaagtattgattgatattagattaaattagagttttttatgataatataaataatatttttattaatttgatttttttatttatttttttagtattattttatatttgtttttattaattatattatagaatttttgttatttgtattatgttaagtatttttaaaaattttttgtttatattatattttttttttgaaagtggttttgttttttttttgtttttagttataagttttttataagaggttgttttttattttattatttttttgtatggataggattttatggaatagatttttattattgtatttattatattattttttaagtagtatagtatatttattggaagattagttatgtattgagttttgtttttgtatttttatgtttagaataatgttgggtatatataggtatattaagatttgaatagtgaaaaagtttttaattttatggggattttatttaaatagaaaaatataagattaattagaattatttttaaagtataattttaagaaatatgattgattttgtttaaaaatatgtttttttttataatgttgttatttggtgttgttgtgtttagagatgtttttttgtaaagaattgagggtttgagttgagtttggtttggtttttggtaaattagttttttttttgtatatttattttgtaataaattatggaagattttgtttttaagtgtgagaatataagtaatgttatttttatatttttatagaatattttgtttatgttttttttgtagttaggtagggttttttttttgatatatagtatgttatataaggtttgtttgtattttggtaggaaagttttttgaaatttaaaggttgagaatttaaaagtttaatttatgttttgtttttagaaagatttgagaagagagtatttttgtttagtatggtattaagaagatagtttttttttttttatgttatggttgttattttatattgtttatagagaataagatttagtttttgttttaaataaaggtttattttttgttagtgagttagatagggtaattggattgttttttaatttatttttatttgaaatattgttttatttgaaattatttttataattttatgtaatgttaaaaattaaattaagtataagagtatttttaaaaattaatataatttttttagtttttatttagtgtagatgttttttggttgatgatattagaattgtgtaatggttattgattttttaaagtgaggtgttgtttaggggtttaaaagttattatataaagaatttggttttatgaagaaatgttatagattttatttatattttaaaataagtgtaagtgattatttttataatttttattatgtagtttagtagtattttttatttgtttattaatattttgttttgttattaaaagtatgtataatgagatgtaataagaataggtaataagtaggttgggtatgttggtttatgtttgtaattttagtattttgggaggttaaggtgggtgaattatttgagtttaggagtttaagatgagtttgattaatatggagaaattttatttttattaaaaatataaaattagttgggtatggtggtatatgtttgtaattttagttatttgggaggttgaggtaggggaattgtttgaatttaggaggtggaggttgtggtgagttaagattatattttattgtgttttttagtttgagtaatatgagggaaatttttgttttaaaaaaaaagattaggtaataagtttgggtgaataggattaaagagttaaataataggaggaatttagaggatttaaagaaatgtgtggtgttggatttaataattgtagttgttaaaggtgaggtgtaaatttattttaagtaaaggaggatgtttatttttgaaaatttatttgtttataagattaatgtttattagttaatttgggaggagaaaaatttttttttattagtgtttttttttttttttttaaattttgtattttttattaatagaattattgaattgatgggatatgagttagaagaatttttaggttgtttaatttatgaatattattatgttttggattttgattatttgattaaaatttattatgatagtaagtataatggaagaatttagagatattttaattatttaattgttgtaatttttgtatagtttggttatttatttaattttttggttaaaagttttagattaaatgtgttaataggtttatttagtagagattttgattattttgtgttttgtatgtgttgtaataaatattagtaaaaatagaattatttaattatagaaaaaattttttggtattttaaatataaagatttttgaaaatttaaatattatagagtattgaatagtataatttttagaatttatataaatatttagaatagtggttggtatgtaaaaggtatttagaaagtatttgtataattaatgaatgtgaaggtggtgaatattatttttggtaataagtattattttaaaaaatgtttataagtgtatagttaggtatttatatttatgggtttatgaaatattttgatataggtatgtagtgtataaggataaatggagtatttattattttaagtattattttgtgtgataaataatttagttatatttttttggttatttttattttattttattttattttttttttttgagataggattttatttttgtttaggttggagtgtagtggagtaattttagtttattgtaatttttgtttattgggtttaagagatttttttgttttatttttttaagtagttgggattataagtatgtattattatgtttggttaatttttgtatttttagtatagatagggttttgttatgttggttaggttggttttgaatttttgattttaggttatttatttgttttggtatttggttttttttagtttttttaaaatgtataattaaattattttttattatagttatttaaaataagtatttttgatataagatttgattttgaattttatttaaatgaatgttaagatttttaagataagttaaattttggattattttatttgtttaatttgtatttatgtatgattttttattgtgtttgaggatatttgaatattattgagtttgtgtgattgattagttttgaatttaagagtaaatttaagtttgtagttaggatattttaatttttaaaataatattattattagtatttatttagtatttttttttaaattagtatttaatttaaattgttaaaagatttataatgtggtattaatttatatttaaatatgttatatatagttttttaaagtatttttggttttttggaaattatagttagaatttaaggaagttattgtggtattatttttttgaaaaaggttattgattattttttaatttgatattaatttaagttattaaaggaattttagttattgaagattgtatatttatgaattttttatttagtttattggtagtaaaggagttttatttagggggtttgaaaaaggaaatgggtatatttttagttattttgggatgtattgttagaatgtaagtagttataattgattttattaaataaatatttgttttttaaaataatgatgaatatttagtatttgtttatttaattgaaaatttaaagttaaaatattttttttgtatgattttttttttttttttttttagtgtttattaaaggataagttattataggatagtataggatgtttgttaaaagaggtggatatgtttgggttgaaatttaagtaattgttatatataatattaagaatttttaattatagtgtattgtatgtgtgaattatgttgtgaggtaagtaagtttgagaaataaatatttttggggaataaatagtaattttttttggatattttgtttatttataggaagataagataataaatattaattaaattttaatttttttatattgttattaaattattattttttatattttgatttaggtttttagtttagttattttatagtgatgttgttaaatattgttagtagttgtttatttttatatttttatttttatttttaaaaagattatgaaaaaaatattagatttattgattggtttggtttaattatatagatattggtatatattattttaagatagttgtgttttttttgtaggaagaattttggtttagatttgtattatagttttattatttattagttttttgattttggggaagtttttttatttttttgaattttatttatgtagataattttttagaaggttataatgaaaattaaatgaaattttatgagattagggaggggggagggatagtattaggagatatatttaatgtgaatgatgagttaatggatgtagtatattaatatggtatatgtatatatatgtaataaatttgtatgttgtgtatatgtattttagaatttaaagtataatttaaaaaagaaaagaaattttatgagattaataagttatatgatgtaatatatggtttttgtatatttatgaattttttatttagttttttggtttgtgaatattatgtatattaaaatttaattttttatttgatttattttattagatttttgttttatttagtttatttgtttatattattattatattttagtttattttgtttattattattaggttaagttttttagtgtggatatgttattattttattttttttagaattttagtgatttttttattatttttaagataaatatttgtttaggtgtatagtatttttgtttattattatatttatgtattagagatttagttttttttttaaaatttagggttattttttttaggaagattttgggtagtttttatttttgttatttttgatattattttttaatgttttaatattagtgttatagagtttttttgtgattttattattatgtaagaattttttatttggaatgttttttttttttttatattttagtttgtttagtaaatgttatttgattttaagtattagtttgttagttttttagtgaagtaagttttttttattttagtagttattatagtgtattttaattgtttatatatttatttttataatgggttataaattttttaaggttaagggttggttattttaatttttgtattattagtttattttagatagtgaatatttaatatgttaattaaaggaataatttatatttaagttaaatgtgaagataaattattgtttattatttttttttagttgtattttgtaggtggtattattttatatttttattattaaagaaaatatggttttttttttagaaagattttaattatttatttgtgtatttttaggattatttttagattatgttttatatattgatgttaaagagtttttttgtgttaattttataatgtgtgttagtataataattttgaagatttgttggtgttttttatgtatttgattataaattgttttgttattattattttttttaaaggatatttgaaatttttttttttttttttttttttgagatggagttttattgttatttaggttggagtgtagtggtgtgattttggtttattttattttttgagtttaagtgatttttatgttttagttttttaagtagttgggattataggtgtgtattattatattgggttaattttttgtatttttagtagagatagggttttgttatgttggttaggtttttgaatttttaggtttaagtgatttatttgttttagttttttaaagttttgggattataggtatgagttattatgtttagtttggatatttgaaatttttaattgaaattagttaaattattttgtattggggattttttttttaattttaatttttatttttgatttaggggatatatgtataggtttgttatatgggtatattatgtgatgttgaggtttggggtataattgattttgttatttaggtagtgagtataatatttaatagttgtttaatttttgttttttttttttagtagtttttagtgtttattgatgttatttttatgtttataagtaatttagtgtttagtttttatttataagtgagaatatgtagtatttggttttttgtttttgggttattttatttaggataatggtttttggatgtatttatgttgttgtaaaggatattattttatttttttttatggttgtatattgtggattttattgggtttttattttgtattagtattttaaaattttaaatgtgatatagtatgtatgagtgattatgtattttaagaaattttgaaatgtttttgtttataaagtagaattttttaagagattattttatagttttttttttttttattgtattaagtgtttatttgtgaattattaattttttttgttttgatagtggtattatttagtatgatttgattttttttttttaataaatagaatgtgtttttaaattggttgaatttttagatatgaaaatgatttagttatttattaaagttgaattagaagatataagtagtttttttgataaatttaagaaggaatttgatgttttaattttgttggttttagttgttggagatataattatatttttagattttggtagtaatggtgagtagttatttttgttaattttttaaattgtgtttgttgttataagttttattttaattaaatattattttatggtttttgttggtaattatttggatattataagttaatatatgtttatagtttttttaaatgtatttgtttaaatatttttgtttttgtaattttttattatttttgtttttttatattgttggaaattgtgttttaaagtgtttttaaggtattttttttttttatataaattttttttggttattttatttttgtattttgttgttagattttttttatagtttagtagagttatatggaagtaggtattgttgtattaaaggataaaaaagtagttatattataatattaagtattgaagatgaaaattgtaattttaaagtagagaatattttaatgtataaaaaggttggtattgttttttgttttttatgttatagagattaagatgtggtattaatagtggattgtaaaggtaatttagatttatggttatattatattattgtatgtaaattttttgatgaaggaaaatttggtgatattttgttgtttgatgaattagataaattttttgtgaaaaagaatataaattttttatatgtgaaaatttttgtggttgggtgtagtggtttatgtttgtaattttagtattttgggaggttgaggtgggtggattatttgaggttaggagtttgagattagtttggttattatggtgaaattttgtttttattaaaaatataaaagttagttgggtgtggtggtgtgtgtttgtaattttagttatttgggaggttgaggtaggggaattgtttgaatttgggaggtagaggttgtagtgagttaagattgtgttattgtattttagtttgggtaatagagtaagattttgttttgggtaaaaaaaaaaaaaaatttttttatattttagattgatttatattttttttttatagatatagaaattgatgattagtaatttgaggaagtattattatataatgatgtaatgttttttttatttaatgaaaaattatagaatataaatttggtaatgtttttattatttattgttgaaatgttaaagttattttgaagtagtgttgattttgtatttaattaagaagttgtattaaaattagaattaaatttagagttattggaatttttttttattatgttttagatttaggattagatatttagtttttttgatggaagtattagataaagtttatttgaggtaggtgttatgatataattagaaagggataatttttagattttaatatttaagaatgtatttataagtttgatttaaatatttatttgaattataaattatatttgtgtgtgtgtttgaattttagtattttaaaattattgtaagagttattgtttaatttagatttgagtatatgttttaggtttaaagatagttaggaatatgggaagaaattagtttaatataaattaaaaggtgaaatgtatattgtttttttattatttatattagtaggataaaaatattttgaatttggatatttaaagagaatagtattaagtgtgtttaaggtagttatagtttatatttgttattttttttagtttgttttattgtgttttgttttgttttgagaaagagttttattattatttaggttggagtgtagtggtgtaattatagttttaattttttaggtttaaatgatttttttattttagttttttaagtagttgggattataggtttgtattattatgtttggttaattttttaatttttttttgtgtgtgtgtgtggagttggggtttttattatgttgtttaggttggttttaaatttttgggtttaagtgatttttttgttttggttttttaaagtattaggattataggtgtgagttattatgtttggtttattatttttttgagttggagaattgtttggtagtaatagatttatgagggtttaaatgggaaaggattttataaattttttgtttaatttagtttaatttttattattattttgaaattttgggtaagtataatatgaaaataataagtgttatataaaataaatatttagtaattggttttttttattttggatttgttttgatattaattgttttatgaatataaaaataatttttaaaggttaggttggttaagatttagagatattatatagggttttatttttaaatttagaatgattttattttagggttttttatatttaaaaatatgtttaggagtagggtaatttagatttgaatattataatttgataaatgaggtataaataagttttaataagtggtaaataattttatattaggtatttgttgaataaaattgataagttaagagtaggggatttgatattttatagttttgtgttgaatgaatatatattttatgttttggttgtttaatttatttagaaaaaaaaatgtttgatttattttggtttttatttaataaaagtaaatttaataaaaatgttagaatgaggaaagtaaaattttttgtttagaatatatagttatagttttttgttaaattttttgtttagaatttttaaaatagtaataatgtatatttgtttaggtatatgtaggtaaaataatttaggtttttatttttatttttgatagtaatagtgagatttttaggtagtttagttattataggagtgtgtttttttagtttaaaggtaaattttagtgaatgtagtatttagttaattggttaattaggtattattgtgggatgtgaattattaaataggttttattttttagaataaggtgtttttttttattttaattttgtaaatgatgttatattatatagttagaaatatatatattggtaaaattagttattagtataagttttaaaatgttattatttttataaatttttttttttttttttttttttgatatggagttttattttgttgttaggttggagtgtagtggtatgattttggtttattgtaatttttgttttttaggtttaagtgatttttttgttttagttttttgagtagttgggattataggtgtttgttattatgtttagttaatttttgtatttttagtagagatgaggttttattatgttggttaggatggttttgattttttgattttattatttttttattttggttttttaaagtgttgggattataggtgtgagttattgagtttggtttagttaaataaaatttgataaatatgatggatttggttgtgtgttttttggtttttttgagatttagtttgaaaattttgataattagtaaagtatatggaagtttttttaggaaatagtaaatatatttttttttatagtttaatagttttagtgaatattgtttttatgtggatagtgatatggttaatgaatttaagttggaattggtagaaaaattttttgttgaagatatagaagtaaagaatttattttttatttaggtatatgaatttatttgttttatattaaattttattaatttttagtttgaagtgattttgagttttatttgttttttatttataaggtgtggttattgtaaaaatttatgtatttgttgttttaaaggatatagatttagatttggagatgttagttttttatattttaatggatgatgatttttagttatgtttttttgattagttgttattattagaaagtagttttgtaagttttgaaagtgtaagtttttaaagtatagttatagtattttagtagatttaaatataagaatttattgttaatgttattattattattgttattattgatgaattaaaaatagtgataaaagattgtatggaagatattaaaatattgattgtatttttattttttatttatatatataaagaaattattagtgttatattattattatatagagatatttaaagttggatagttttattaaatagagtaggaaaaggagttatagaatagatagaaaaattttatttaagaagttttaatgtgttatttgttgttttgagttaaaggtatttatatgtaatatttaagttatagtttttttattatttttgagataaatgtatgtgatagtatatgatttttaaatttatagtaaattttttgatatatatgttttaatgtaaatttttgagaatttaaaaaattttttaaattaattttatatatttttttttttttttttttttttttttttttgagatagagttttgttttgttgtttaggttggagtgtaatggtatggtattattttagtttatggtaatttttgttttttgggtgtaagagatttttttgttttagttttttgagtagttgggattataggtatgtattattatgtttggttgatttttttggtattttttatagagatagggtttttttatgttggttaggttggttttaaatttttgattttaggtgatttgtttgttttagtttttgaaagagttgggattataggtgtgagttattatgtttgtttttattttttttaaaataattataaattttaaaattatttatttaaatggaggagggttttttgatatttttaaaataaaatttagtttagtattgtaaatgtgtttatagaatttgtttaaagtttttatagttgtttaaattagattagttaattatttttattatttagatgtttttattttttagagtttttttttaagtttatttgaagaaaagtttttttaatttaagggttatttttaattgtatattttaaattgagttttttatttttagtatttaatatagatatttataggttttttttttaaaattttattatagttaatttgtattaaagttgtttttattttttattatgtatttgtagaatattagttatatatatattgtaggttatataggtttttaaattgtataataggaatttaagtatgaattgttatttttatggagttagtttaaataaatatatggatatgatttaatttttaagttatattttttgtatataatttgtaaggggattttatatattttaagtttgaggttatagttagaagaaattaagttttatttaataagtgtgtggaaaagggaaatgattttttttttattatgtttagattaagttagatattaatagtaataggaaagaattattgttgtagttagaatatatagtttttttttttgtttaatatttttattttgatttagagtgttgggagaggttttttttttaagtttggaaaagatattggggttttagatgaatttagaagtattttatattattttatttattgtgttatttatttatttttgattttgagttttatgagggtaattatagtgttttgggtattttagtgatattaatatttagtttatgatttaatgtgtagtatttttttaataaatggttgttgaggtagggtgtagtggtttattattgtaattttagtattttgggaggttgaagtgggtggattatttgaggttaagagttttagattagtttggttaatatggtgaaatttggtttattaaaaatgtaaaaattagttgggtgtggtggtatgtgtttgtaattttagttattttgggaggttgaggtaggagaattgtttgaattttggaggtggaggttgtagtgagttgagattgtgttattgtattttagtttgggtgagaagagtgaaatttggttttaaaaaaaaaaaaaaaaaaaaaagttgttggattgatagatgtatgaatatagtagtaaaaatgataattatttataagttatagtttattattagttatagaggatgggatatttagttttttgaataattgtttttttgtatttgttaaagttaaagtgtaataatatattaagttattttagtaatttatttttgagatggagttttgtttttgttgtttaggttggagtgtaatggtgtgattttggattttggtttattgtaattgttgttttgttggtttaagtaaattttgtgttttagttttttgagtagttgggattataggtatgtattattatatttagttaattttgtatttttagtagagatagtgtttttttaggttgattaggttggttttaaatttttgattttaggtgatttatttgttttagttttttaaagtgttgggatgatagttgtgagttattgtgtttagttagtaattgtttttaaatattagttttaatgtagtgtatattgaaaatttttatgaaaggaattttaaaaattaagataaattattaaaaatgtaattattaagtattattattattataatgatatttatataatagattgagttatattttataaagataatatatttgtataagaatttttaaatttttttgtttatataatagaagttttagagaaattttttaaaaattaaagaaaattgtaaaataagattatttatttatttggtatttttaattgtttggaatagtaaggagttattatgattatgtatttggtttgtggggtgttttgaaaagttaaaataatgtaataaagttgatgtattttatttattagaataattttttataatttaatattaattttagatatatatagtttatgtttgataattagattaatattgagtgaaaaatagtatagtgggaagagtaggggaggggaggtagggatttggagatttagagtgtatttttatattgtaattagtgagtagtaggattttgagaaagttatttaataggttttagggttttaatttataaaatgggtatgatatgtttgttttatttgttttgggaatttaagtaaggttaaaatgaattaatgaatttgaaatgttttataaattgaaaatgttatatgaatgtgagattgattttgtattttaatagttttaataatattattgtattgttatattaggtggaataaaaggataatatttaattgttttgattttataatagtgttaatttagttgtgtttagttttattttataaaatagggatatgtatattgtagaaaattttttgttaaattaagttttgatggttaggtgtttatgtttgtaattttagtattttgggaggttaaggtgggtagattatttgtgtttaggagtttgagattagtttgagtaatatagtgaaattttgtttttataaaaatatgtatatataaattagttataattttagttatttgagaggttgaggtgggaggattatttgattttagaggtagggtttggttgtagtaagtagagattatgtttttgtattttagtttggttgatagagtaagattgtgttttattaaaaaaaaaaaaaaaaaattaagtttttatttttaagatgataaattttagtgattaggaaagttattttatgtatattatattttttaatattggagaattaaagaattatgtattttttttaaaagtgtttattggatattttttttaaaaatgttatatttttatttagaatttttttttttttagaattatagtttttgaggaagaattaaatttaaagatattagttttgtagaatgtttagagaaagtgaaaaatggaatatgatggtttatttttttaagtagtaggaattgtaagtatgagtagtaggttttgtttttttagttaatgtgttattttgtgtgtgtgtgtgtgtgtgtgtgtgtgtgtgtgtttttatgttttttttaaatagtaaagttatatttttagaagttatatattgggtttttttattttgtatgtattggtttttaaaaatataaatgtttaatatatatatttttggtataaaaattttaaataattttagtgtattttgagttaaaaagtgaagttttttttttattttattttgaatattattattaattttatttttttttttttaagttattttgttttattaaaagaattgttattggttaggtatagtgttttatgtttgtaattttagtattttgggaggttaagatgaggattatttgaggttaggagtttgagattagtttggttaatttggtgaaattttgtttttattaaaaatataaaaattagttaggtgtgttggtgtataattataattttagttattttggaggttgaggtaggagaatagtttgaatttgggaggtggaggttgtgatgagttgagattaggttattgtattttagtttgggtaagagagtgagagtttattttatatttaaaaaagaattgttatgttttggggtaagttaatggtggtataatatattttgatatttttaaattaaattaattggaaagtatttatagatagaatggttataatggatgataaataatttaagaaagaatttaaaataatttagggtagtatttaagaaattgtttataatgttattaaatttatattaattttaaggtttttggttgtttaaaaaaaaaatttaataaattaaatttgaaataattttattgtttatagggaatattattatagtagttagatgattatgtagttattatattatttttttggaaatgtgtaaaaggatgtaaatttagtgaatagaatggaatggagtaaaagataattattttaatattttttggttagtttattttttttgattttgaatattataaagataaaatatatgaaatatttttatttaggagttttaatttaagtgagaatgattttggttttttagtaagattaaaaagtaaagttgtggttgggtgtggtggtttatatttgtaattttagtattttgggaggttgaggtagttagattatttgaggttaggagttggagattagtttggttattatggtgaaattttgtttttattaaaaatataaaaattagttgggtgtggtggtgggtgtttgtaattttagttatttgggaggttgaggtatgagaattgtttgaatttggaaggtagaggttgtagtgagttaagatggtattattgtattttagtttgggtgataagggtgagattttgttttaaaaaaaaaaaaaaaaaaaagtatagttgtattttatgtgatggttttaatatagagattaatattttaaggtggagttttttatttttagtaattttttttgatttttttatgtttatgtgttgttaatattgatagaagttgaaatttgtgaatttttatgattttttttttttttttttttttttttgagatagggttttgttttgttgtttaggtttggagtgtagtggtatgattatagtttattgtagttttaaatttttgtgtttaagtttaagtaattattttattttagttttttgagtagtttgtattatagatatgttttattatatttggttgttttttgtagagatggggttttattatgttgtttaggttggttttaaatttttggttttaagtgatttttttgttttagtttgtgttaggattataggtattagttttgatgtttattatatttatgtttttttttaaattgttatttttttgtgtttttattgtattttgtaaatatttttgatatagtaatagtattattggattatatttattttttaatatagttgtggttttgttaggtaaattaaaaatttttttagaattttgttttattttttatgatatttaatatattgtgggtgtttaataaatatttattgattagatgaatgtatatttaggtattttttttgttttttagatttagtatgtagattgttggggtaattaatggatgaaagtggattattatagttgattagttatgattgtgaagttaatgtttttatataaggtagtagaaatttattgtagggtgaagaattatttagagttttggattaagttaattgagtttttttttaattttatttttttttttggatattggtggtttattatttaaagtagtttatttatattttttatatttaattttagaagtttggttataatattgtataaatttggttagtttaattttgattttttttttatttaatttatattaatgtttttttttagtatgttttttaatgttggattatagatagtttatttttttagttttttggtatttaaattattgtattgtagtagtattattttaaaaaatgtatttttttatttatttatttttggttagggagtttattttttttttgaattatttttaagaagatgttaatataatttttgtaagaaggtagtaattttttattatgattataggtagttgaaaaatttttatatttttttttttatattttatataaataataatgttttgttagtagtatgtggtagttataattgtataatatatttttttaaaaaatattagtagttatttatggaatatattttgtgtttataaaattagtttttaagaagaaattttttttggtttatgaaattgttaaatttggaatatgatattgttaattatataataatgatttttaaatgttgtatggtttattatttaaatgggtaaagttatttatataatatagaaagatatgtatatatttagaaggtatgtggtatttatttggataaaatttttaatttagagaaattatttgatgtttttatagttattttgttagtttaaaagaaaataatattttatgtagttgtggaagtttatgttaatattgtgtaattgatattaaatttaaatgttttgtttattttgttggtataaagatattttgagtagattgtaaataagaaaaaaaaaattatgtatttttagtaaaattgtttagtatgttaatttgtttaaaatataatgtttgattttatgtattttgttgttattaatatttttttttttatgtagattttaataattgagtaattttagaagtattattttaggaatatatagttgttatagtaaatattttgttttttttatgtatattgtataaattttttattttttttgttttttgtggttggatttaatattaattgtattgttttgttatattaaataaatattttttgtggattaggtttttttgattagtttttatgtttaaatattaataatatttgttttaatatttttaatttataaaattgtttattaataatttaagtatttatgaaaattatatggtattggttatttttatatttattttagtgttattattttaatgtatgttgagtttttaaatgttatgttaaataataataattataatatttta

SEQ ID NO: 48 - DNA, 5779 bp, Homo sapiens
atttttaatatatatatataggtatatatatatataggtatatatatatataggtatatataaatatatatatatatatatatatatatatatatatatatatatatatacgtataataaattaggttttagattagatgtaggagttgaaattgttttaaaaatattttaagaatttaattataaatttatattttttatgtttttggggtttaagatttttgagtttattttttagtattttttttcgggaaagtggggtgggttgttttatgaggtggaggtgaagatttttgagtttgtttcgtggagggggaggttttttaagtttagagtttcgttgtagggttttgtgttaggagttttcgtgagttatggtttcgaaagggtagcggtgattttttttatataaatatatcgtatttaaatgagtttagatagtatgatattagagagtaattaaattggtttgggttggaatttcgtttttaatttttgagtttaggtttgtaaaagatttttttgagtatttgtaggtttgtgagtgtgtgtgtgtgtgtgtgtgtgtgtgtgtgtgtgtgtgtgtgtgaagtatttttattggaaaggatttaaaattagggggaaaaaaaaattggagtatataggtagtattacgttattttttttttttggaaaaattttttagttttatataagttttttttaagtttttagttagttgtgtaggagaaagggggcggttggttttttttttttaagaacgagttatttttagttgttgattggagacggtgtacgtttggatacgagagtatttttattatgggattggatataaatatatattcggtagattttaagagttttagattgaggagaaagtttttttttttgttgttattgttgttgtcgttgtttttgaaagtttattttttttatggttttttttgttaaattagaggtatttttgttgttgtcgttgttttttttggtgttatttagcggttggttagaggatgagattttttaaattttttatttttttgttttggtatttggtttggttggatttggaatttatttgtattgtgttgggtgtttttgatttgggttagagattttaggggattaggttaggattggttaaagtagaggttaaggagaggttttttttggttcggaacgtttttaggttagggggttatagttatggtgggggggttattaatgttaatgttagggtaaagggaggtatcgggtagataggaggtttgatatagtttaagaaggatgaatttaaaaagttgttttttagatcgggcggttttgaatttaagttaggatattttttttaaataaggtaggttatagttcggattgtgattttaaaaggatagtttttcggaggtaaggtatttttaaaagtaggatttgtttttagtttttttttgttgaagaaggttagggagttcgggtttttacgagagtttaaggagtcgtttcgtttattttttattatattttacgagtatatgttttcgttgtataggacgttgttcgatgttgatagaaagggaggtaatagtagcgtgaagttggaggttggtttggttaatattattattagttttattgataaagggtaaggtgagggggcggggtggtaggggtacggtttagagggaggggtatttgtatgaatggaggggtttttaaagttttggtattgttttggtgggagatattgtgtgtatttggttcggggtgggtgtttggggatattgatatatattttatatatagtagattttaggttgtttatatattagggttggagggtatttaggaagtattaggtttaacgtttgtaaggtgtagagtgggtattaaagtttagagaagagataagatttgttagttcgtggtagagttggagattagatttcgagatttgattgtttagttgtgtatttgtatttgttgggttggtcgaattttttaagttttataggtttgtaggcggttttagacggtagagaaagaaatgaattttgaggtttttatgtttttgtaattttgtttttaggtaaggggatagaggaggtaagagaggtgtatatagtaaatggggtattttggagttatggaatgatgtttagatatatggggagggagtagatttagggtttaattcgtagtatgattttgggaaagtttttttttatttggggttttcgtttttttatttgtatatttatatggggttggatagggtggtttttgagagtttttttaatatgaaaattttagatgttgttttgaatatgttttattttttttattaattttagagattatttgtttttttttgtttttttcggtttatttaatgttattgttgtagttttttttttttatttgttgtgtgatttaagtaagttttttttttttttagggttttagtttttttttagtgtgaagagggaggtgggttgttggtcgtttaagttgtttgtagtttatttgttttggttttaggttggtagggtgggggaggggttagagggtgggagaggttttttattagagttggtttggagggggttgttagggggcgggggaggtatagaggtagtaggtttggttgaggtgggggaggtggtttggttgtttgtttagttagggaaagttgtgattttttgggggtttataaaataagttcgtgtgttttttagtattaagggagtttggagagggggagacggggagtttaaaggtttaattagttattttttagagtaatatatgaaagttttttaatggtaaattgtaatttaggaaggagggtatgttgattcggagatattattgagttttttatatatatatatatagttttatgtttatatatatatgttgaattatatatgtatatgtatgttgatttatatatatacgtgttgaattatatacgtatatatatgtcgaattatatatatatgtatgtgtatatatatttttttatatatatatataagattaattatgtatatatagatatatatgtgttttttaaatagttatataagtttaattatttatatatataatgcgttattaacgtatatatttttttatatttatatatgaatttaattatatatatgtatataattgtaatatatatatatgtttaggagagtaagatatataggtaataaaatttttgtattggaaagttaggaaaattgggttgtaggttagtgtggattagttttgttattaatttgttgtgtgattttagttaagttattttttatttttgtgttttatttgtataataagagtattaaggttttttttaagggatggtggaagtagttgagaatttgagtaagttatttaatttttttgaattttgggatttttttttggaaaagcgtgtattttttttttttttttttttttttttttttagttagggtttttttttgttgtttaggtcggagtgtaatagcgaatttacggtttattgaagttttgatttttttggggttaattaatttttttattttagttttttgagtagttgggattatatgtgtacgttattatgtttggttaatttttgtattttttgtagagatagagtgttattatgttgtgtaggttggtttcgaatttcggagtttaagtaatttatttattttagttttttaaagtgttgggattgtaggtgtgagttattgtgtttagttaataggagtaattttaatgtttattttatttattttataaatgagatattacgttagtttatggttgggagagagataggtagaaggtagttataaagttgataaatttttgataatacgtatattatgatataaatattagaattacgtaaattatttttagttatatttttaggtgaatatttttatttggtcggttatgtaggaaatgtttttatttttaaaaaggtttttagtggtttggtttttggtttttgttagaatggggtagaggtgaaagaaagttttttggacggggagagagttggggttttttttcgtagtttcgaagtgattggtttttttggtgaggttgtagggaatgatttttgggtgttttttttagatgatcgaggtttcgtggttaggaagtagaggtacgtgtttgatattagtgttttggagaaggatgggttgttgggggtcgagttgcggattttgcggaagaagttttcggatacggttaagttagcggttttcggaggcgggcgggttgtttagttgaagttgtttagttgttttagcggtcggtagtcggtttttttgttggatgtgcgtttcgtgttaggtttggacggatttggttgggaggtgttcgatatttggaagttttttcgaaattttaagaattcggtttagttgtgtttggagttggaggtttgggaacggggtagggtcgtggattttcgtggtttgggtttcgatcgcgtcgttcggtaggtttacgagaaggttttgtttttggtgtttggtcgtattaagaaacgggatttgttttttaatgagattaaggttcgttttggttaggacgataagatcgtgtatgagtatttgtttagttagcggcgaaaacggcgggttttattggttattcgttagggtaagcgatttagtaagaattttaaggttcgttgtagtcggaaggtattgtatgttaattttaaggatatgggttgggacgattggattatcgtattttttgagtacgaggttttttattgcgaggggttgtgcgagtttttattgcgtttttatttggagtttacgaattatgtagttatttagattttgatgaattttatggatttcgagtttatattatttatttgttgtgtgtttacgcggttgagttttattagtattttttttattgattttgttaataacgtggtgtataagtagtatgaggatatggtcgtggagtcgtgtggttgtaggtagtagtattggttttttgtttttttgggtggtatattttaagagtttttttttgtatttttggaattatagaggggttaggaagttgtggtaggagtatttatatagtttgggtgaaaggggattttaataagtttgttcgttttttgagtgtgatttgggttaaaggtttttttttatttataagtttttttggttgaggattgttgttcgtttgttgatgtgattagtggtaggtataggtttagggagatagattttgaatgggattgagttttaggaaatagtgtttttcgatgagatttagtttattatttttttttatttgggtttttttagtttttggatttttttaagtattttttaggagagttataggtgttattgtttttttaaattatatttgtgtttggtgattttttgtttttgggatagttgagaagttgattgggtaagagtgggagagaagaggagagggtttggatagagttgaggagtgtgaggttgttagattgttagatttaaatgtatattgatgagataaaaagtaaaattgtgtttaaaattgtggtaaattttttgtttattttaggggatttagtgattttttgaagaattattgatttagggtagggaggtgggttgttttatgtataaatttagtttttagagttttatttttatttttatttttggaaattgaagtataatgggatagagagtgtagttaagtagggttagtgtttatttttaatcgtatt

SEQ ID NO: 49 - DNA, 5779 bp, Homo sapiens
atttttaatatatatatataggtatatatatatataggtatatatatatataggtatatataaatatatatatatatatatatatatatatatatatatatatatatatatgtataataaattaggttttagattagatgtaggagttgaaattgttttaaaaatattttaagaatttaattataaatttatattttttatgtttttggggtttaagatttttgagtttattttttagtatttttttttgggaaagtggggtgggttgttttatgaggtggaggtgaagatttttgagtttgttttgtggagggggaggttttttaagtttagagttttgttgtagggttttgtgttaggagtttttgtgagttatggttttgaaagggtagtggtgattttttttatataaatatattgtatttaaatgagtttagatagtatgatattagagagtaattaaattggtttgggttggaattttgtttttaatttttgagtttaggtttgtaaaagatttttttgagtatttgtaggtttgtgagtgtgtgtgtgtgtgtgtgtgtgtgtgtgtgtgtgtgtgtgtgtgaagtatttttattggaaaggatttaaaattagggggaaaaaaaaattggagtatataggtagtattatgttattttttttttttggaaaaattttttagttttatataagttttttttaagtttttagttagttgtgtaggagaaagggggtggttggttttttttttttaagaatgagttatttttagttgttgattggagatggtgtatgtttggatatgagagtatttttattatgggattggatataaatatatatttggtagattttaagagttttagattgaggagaaagtttttttttttgttgttattgttgttgttgttgtttttgaaagtttattttttttatggttttttttgttaaattagaggtatttttgttgttgttgttgttttttttggtgttatttagtggttggttagaggatgagattttttaaattttttatttttttgttttggtatttggtttggttggatttggaatttatttgtattgtgttgggtgtttttgatttgggttagagattttaggggattaggttaggattggttaaagtagaggttaaggagaggttttttttggtttggaatgtttttaggttagggggttatagttatggtgggggggttattaatgttaatgttagggtaaagggaggtattgggtagataggaggtttgatatagtttaagaaggatgaatttaaaaagttgttttttagattgggtggttttgaatttaagttaggatattttttttaaataaggtaggttatagtttggattgtgattttaaaaggatagttttttggaggtaaggtatttttaaaagtaggatttgtttttagtttttttttgttgaagaaggttagggagtttgggtttttatgagagtttaaggagttgttttgtttattttttattatattttatgagtatatgtttttgttgtataggatgttgtttgatgttgatagaaagggaggtaatagtagtgtgaagttggaggttggtttggttaatattattattagttttattgataaagggtaaggtgagggggtggggtggtaggggtatggtttagagggaggggtatttgtatgaatggaggggtttttaaagttttggtattgttttggtgggagatattgtgtgtatttggtttggggtgggtgtttggggatattgatatatattttatatatagtagattttaggttgtttatatattagggttggagggtatttaggaagtattaggtttaatgtttgtaaggtgtagagtgggtattaaagtttagagaagagataagatttgttagtttgtggtagagttggagattagattttgagatttgattgtttagttgtgtatttgtatttgttgggttggttgaattttttaagttttataggtttgtaggtggttttagatggtagagaaagaaatgaattttgaggtttttatgtttttgtaattttgtttttaggtaaggggatagaggaggtaagagaggtgtatatagtaaatggggtattttggagttatggaatgatgtttagatatatggggagggagtagatttagggtttaatttgtagtatgattttgggaaagtttttttttatttggggtttttgtttttttatttgtatatttatatggggttggatagggtggtttttgagagtttttttaatatgaaaattttagatgttgttttgaatatgttttattttttttattaattttagagattatttgtttttttttgttttttttggtttatttaatgttattgttgtagttttttttttttatttgttgtgtgatttaagtaagttttttttttttttagggttttagtttttttttagtgtgaagagggaggtgggttgttggttgtttaagttgtttgtagtttatttgttttggttttaggttggtagggtgggggaggggttagagggtgggagaggttttttattagagttggtttggagggggttgttagggggtgggggaggtatagaggtagtaggtttggttgaggtgggggaggtggtttggttgtttgtttagttagggaaagttgtgattttttgggggtttataaaataagtttgtgtgttttttagtattaagggagtttggagagggggagatggggagtttaaaggtttaattagttattttttagagtaatatatgaaagttttttaatggtaaattgtaatttaggaaggagggtatgttgatttggagatattattgagttttttatatatatatatatagttttatgtttatatatatatgttgaattatatatgtatatgtatgttgatttatatatatatgtgttgaattatatatgtatatatatgttgaattatatatatatgtatgtgtatatatatttttttatatatatatataagattaattatgtatatatagatatatatgtgttttttaaatagttatataagtttaattatttatatatataatgtgttattaatgtatatatttttttatatttatatatgaatttaattatatatatgtatataattgtaatatatatatatgtttaggagagtaagatatataggtaataaaatttttgtattggaaagttaggaaaattgggttgtaggttagtgtggattagttttgttattaatttgttgtgtgattttagttaagttattttttatttttgtgttttatttgtataataagagtattaaggttttttttaagggatggtggaagtagttgagaatttgagtaagttatttaatttttttgaattttgggatttttttttggaaaagtgtgtattttttttttttttttttttttttttttttagttagggtttttttttgttgtttaggttggagtgtaatagtgaatttatggtttattgaagttttgatttttttggggttaattaatttttttattttagttttttgagtagttgggattatatgtgtatgttattatgtttggttaatttttgtattttttgtagagatagagtgttattatgttgtgtaggttggttttgaattttggagtttaagtaatttatttattttagttttttaaagtgttgggattgtaggtgtgagttattgtgtttagttaataggagtaattttaatgtttattttatttattttataaatgagatattatgttagtttatggttgggagagagataggtagaaggtagttataaagttgataaatttttgataatatgtatattatgatataaatattagaattatgtaaattatttttagttatatttttaggtgaatatttttatttggttggttatgtaggaaatgtttttatttttaaaaaggtttttagtggtttggtttttggtttttgttagaatggggtagaggtgaaagaaagttttttggatggggagagagttggggtttttttttgtagttttgaagtgattggtttttttggtgaggttgtagggaatgatttttgggtgttttttttagatgattgaggttttgtggttaggaagtagaggtatgtgtttgatattagtgttttggagaaggatgggttgttgggggttgagttgtggattttgtggaagaagtttttggatatggttaagttagtggtttttggaggtgggtgggttgtttagttgaagttgtttagttgttttagtggttggtagttggtttttttgttggatgtgtgttttgtgttaggtttggatggatttggttgggaggtgtttgatatttggaagtttttttgaaattttaagaatttggtttagttgtgtttggagttggaggtttgggaatggggtagggttgtggatttttgtggtttgggttttgattgtgttgtttggtaggtttatgagaaggttttgtttttggtgtttggttgtattaagaaatgggatttgttttttaatgagattaaggtttgttttggttaggatgataagattgtgtatgagtatttgtttagttagtggtgaaaatggtgggttttattggttatttgttagggtaagtgatttagtaagaattttaaggtttgttgtagttggaaggtattgtatgttaattttaaggatatgggttgggatgattggattattgtattttttgagtatgaggttttttattgtgaggggttgtgtgagtttttattgtgtttttatttggagtttatgaattatgtagttatttagattttgatgaattttatggattttgagtttatattatttatttgttgtgtgtttatgtggttgagttttattagtattttttttattgattttgttaataatgtggtgtataagtagtatgaggatatggttgtggagttgtgtggttgtaggtagtagtattggttttttgtttttttgggtggtatattttaagagtttttttttgtatttttggaattatagaggggttaggaagttgtggtaggagtatttatatagtttgggtgaaaggggattttaataagtttgtttgttttttgagtgtgatttgggttaaaggtttttttttatttataagtttttttggttgaggattgttgtttgtttgttgatgtgattagtggtaggtataggtttagggagatagattttgaatgggattgagttttaggaaatagtgttttttgatgagatttagtttattatttttttttatttgggtttttttagtttttggatttttttaagtattttttaggagagttataggtgttattgtttttttaaattatatttgtgtttggtgattttttgtttttgggatagttgagaagttgattgggtaagagtgggagagaagaggagagggtttggatagagttgaggagtgtgaggttgttagattgttagatttaaatgtatattgatgagataaaaagtaaaattgtgtttaaaattgtggtaaattttttgtttattttaggggatttagtgattttttgaagaattattgatttagggtagggaggtgggttgttttatgtataaatttagtttttagagttttatttttatttttatttttggaaattgaagtataatgggatagagagtgtagttaagtagggttagtgtttatttttaattgtatt

SEQ ID NO: 50 - DNA, 27489 bp, Homo sapiens
agtcgtataggcgtaagcggggttttggttaaggatggggaaggggtgcgggaggcggttgtcgagggtttgggattttaggaggtcgaacggtcgggggttggcggtcggaatatttaagggtttagtgtggttgtaaagttgagatcgtattttttaattgtacgtttcgcgcggtttagaacgcgttttttgttcggttttgattttttacgtcgaaagtcgcggagttaaaaataatagttttgcgcgtttttcgtagatcgcgatttcgatttttttttcgttttttttttttattgggcgtggggcgaagttatagtttttatttttttaaaagaaaaaaaaagaaagaaagaaagaaagaaagaaagaaaaggcggcgcgggaggggggcggggggcgggtcgggggcggggggttcggttatatggatgtgattttttcgtttcgaggtagacgggtcgtttcgtagcgttcggcgttcgttcgtcgttcgttcggttttcggtttttttttttttttttttgttttttttttttttttttttttgcgttgttcgttcgttcgttcgttcgttcgtttttagcgtatgggtttcgcgtcgggtttcggggtttcgggtcgtcgggacgtcggggttttataggtcggggcgtgggcggggcggttagtttgacgtagttttgtattttttattattattagggtcggcggcggcggttgtttcgagggacgcggttttaggcggtggcgatggggatcgttcggatcgtattcggtttggcgtttttgttttgttgtttcgtgtttagtttcgcgtacgcgttggtgagtttttcgtcgttaatatttcgggataggttgcgggtttattttagggttcgcgggataggtttaaggtacgtagttttgagtttttttagtagttcgaattttgggtgagagttttttttgatttaggattttgggtgtttgttgtttttgggatgtttggattgtgggttttagttgtttgaagtttttttatttttgaagtttcgtttggggttttaaatttggtaatttgtggttgagtttttattattttttgtttttgtgagtattatggttgtttttttttggaagatgatagtgtgatttaatagaaggttgggttttggttttgttgcgtatttttatagattttgttttggggatttttgttttttgtaagttttgttgtagtttcggatatagggaatgtaggtttgaggttagaattatttaggtagggggtaggatttaggggttttttttagtttttatatatatatatgtatacgtttggttttatttagggtagaagttgtttttttaaggaggtgggtgtggtgtggtatggagaagggatggagttttttgaaggagattgattttatagtgtatttttgtaggagaagtatagtatattttgtggggaagtgaggagatttttggaaagattgttattttttgagagtgatttaaaagtagaatggtagggaaggttagagggagaggagagatagagataaagtcgggtggggaggagagatttttttagttggaggggtggatagattaagaatagtaaaaaaaatagggagataggtaaaggtagaaagttggagatatagagtgggtagtattttttttttttgggttagggtttggggtttatttgttgggaagggggttgttttagttttttagttttattttatagtaattttattttttgggacgagttcgtttttggggaggttgtttgtttgtgcgtttaattttaaagttttttttttttgttttttagtgggggtatttgtttgttagagagtagggtagttaggtagttttttttttttgattagtagtagttttttatacggggtagagttttaggtagttttaatgagtttgggatttttttatttttgtatgatgtttgtgtaagtttgggttgttttttttcgtgttttagttgttttatttgtaaaagagagggtttggaagaaatatttgtttgagaattttattattagaggttttttttttttttgaggtttttagtattttttatttatttgtgtttatatttttataattttggttttagtaaaggttttttattaaagatagttttatataaggttttgtggatggggaaattgaggtttagaggagtttaatattttttgtagagatattttaagtattgacgaatgttaggggatagaattattattaattttattttcggagtttggtgtgtgacggtttgaggggtagatagggtgatgggtgtgggtgttttgagagtaagtttatgtgttagagtagggttttgtgggattttgggtatggtgtttatttgggtttgtgtgattgtgagtgtttgagtttttgtgtgagtttacgtgtttgaagttgtggtgtatgatttggaggcgtagttgtgtgtgtttgtgtgtgtttttgtgagcgtttgtgtattcgggtttgttgtttttttatgtgtattttataaatgtttttgtagggttttttatttgttattgttttaagtaatttacgtatattagttagtttaatttttttaattatttttagaggaaggttattgtttttatttttaattggttcgaattatataattataatgattattatttattttatgttaagttttgtgtttttatgtgtgtgtggagtatgggtatttagagttttattgttttttagggaagttgagatatatgtagagaatttttttggttttgttttggtttatgtttgagagtagaaggatagatgttagtgtttagtttgtttaggattttgttggggtatgtgagtttattggatattttttggtttcggggttagaagattgggattgaagggcgggggtagtttatttatttatttaatattttatgggttttttggatttatttggggttagtaagaagttggtagtttgttagtttttttttttgagtttagagggttattgtttttttttagatttgtatttatgttttttaagtttattaattttattttatggtcggttattaaatttgtatgttatttgtttagttggttttaagattaggtttatatttttagtgattttatatttggggggttaaagagtattttatttggaggatattggttgtggttagatttagttggtttattttttgttgtataggaaatagttatttgggagtttggagtttggggcggggtggagtttggaggaagtgatagatttatagattgtgagtaggaggtaaaggggtatttttgtttttgaggatgcgtttttttaaggatttttttagtatgtatatatgtggaggagaaattgtaataagagaagttggagtttagtatggggtaggttttgagtgtgaagatgtgattattgggtaggatttataagagattgtggtgtggatttataggttgggagtgtgtgggattttttttagtttgttttaggggtagtttggttatgttgtttgtttgtttttttttttgagatagagttttattttgtcgtttaggttggagtgtagtagtgcgatttcggtttattgtaagttttgtttttcgggtttacgtcgtttttttgttttagtttttttagtagttgggattataggcgttcgttattatgtttagttaattttttgtatttttagtagagatggagttttatcgtgttagttaggatggtttcgattttttgatttcgtgattcgttcgtttcggttttttaaagtgttgggattataggcgtgagttattacgttcggtcggttgtttgtttttaaagataggaagaagttaatatgtatagaatagtggttgtttttagattttgagttagaaattgttatagattgtttttttattttatttatttatttagtgatttttacgttaaagggttttgagagttatatagtgagtttgtggtatagtaggatttgaatttagatttttagatttttgtattgaattttttttttaaaagtagtacgagatttgttgttggtaggagatttttatgttttattttgggttttttttttttttttttttttttaaaaattaaattatggtcgagtgtagtggtttatatttgtaattttaatattttgggaggtcgggtagattatttgaggttaggagttcgagattagtttggttaatatggtgaaatttttatttttattaagaatataaaaattagttacgcgtggtggtacgtgtttgtaattttagtttattggaaggttgaggtaggagaatcgtttgaatttaggaggtagaggttgtagtgaatcgagattacgttgttgtattttattttgggcgatagaggttttgtaaaaaagaaaaaaaaaattaaatttttttgttattttgttaatttttaattttataattgatatatgaatatgtttttataaaagagttaaataagtttgtaattttagatatttgagaggttgaggagggagaattgtttgagtttagaagtttaaggttgtaatgagttacgattatgttattttattttagtttgggtgatagagtgagtttttgtttttgaaaaaaaaaaaaaaaaaaaaagagagagagttaattaataaaaattaaatagaagttttttttgattatttttaagttttagtttttttttagggaaaattatttttagtagtttgggtagaggggcgtttttttttttttttttgtgtgtttttaaatggtatttttttgtgtatatattaagtagataattttgttattttttatttgtttggttgtttttaaataaatggtatcggtttttagatagggttttgttatatatatattttgacgtaaatgtgtgttttagagatttttattttagtaaatatgaatttatatttttaaatgttgtatagtattttaaaatttgggatttattaagtagtttataggaatgtatatttagattatttttgtataatttgtgtgtgtgtttatatgtgcgtgattttagatggtggtagggaagttttttgaaatgttttttagtgtttttatgtgattattttttagtaggatatttttagattttgttattgttgggtttgagaatatatatattttttattttaatagtatggttaaattgttttttaaaaagtttgtgttgttttgtatttatataatattaagattaattaggagggtttttttgtttatatttattgttttataggatgttaagaggattttttgtgttttatttttgtttggataggtgaaaatggtgttttttgttattttaatttgttgattattagtgatttttgggttttatagtgagagtttgttcggggttattaattattattttatgggttatttgtttttttcgtattgatttgttgaagttttttatattatttgtttttaaatatatttattttagtttttgaaacggtttatggatagagtagtaggagggtgtcgagtttttcgaggaattggggtttttttcggaatgttttaatgaggcgttaagtagttttttttagatttttgttgtgggttttttggggatattttttggtttagttattatattaggaaggtagttattttagaaggagagtttttaggaaaaagaaaaggtggggcgagggttttgtagatttttgaaattgtttgtaaaatacggtgtgattgggagaagggcgtaaatttttgtttaggtttgtagaaatattagagatttttaaatttttaaaagttttaattttggggttagttttatgttcgaggtgagatttagtgggattttattttgttgagtaggcgatggtttagattaggttatattgtttttttgggttttgattttttaatttaagtagggtttgtttatgaagatttattaggtcgtagtagttaatttcgttattttaggttgtattttattgtttgtttcgaaggcggttacgttggttggttaggatgagaggcgttatagtgtttttttttttttagttttttttagttttaaatataggtagtttgtttaggaaagtttggcgaaggggaggaaaagttagtatttgttagcggtggcggggtaggacgaggagtttgtttaggttagtcggatagagagagggtagtaggggtgggggagtagttttagttagttggtacgggagatatttaggggtgttagtatgggttttagtagtagaatttggaggagggttgtaggaaggttaggaggttatgaaggggttttttgttagttagggttttttttttttggttgtgttggaggtattaacggtttggtttttaatattagagtttaattgttttttatttagttatagttggggataagtcgttattattggtattatcggtatttttatgtttatatatttttgtttttaaatcggtttcggggaggttgttttaggggatttgtaaagggagatttgtttaatgtagtagttaaaatttaggattatggaaagatgatatcgtggttggtgttagggtattcgtgtggttgggtatttttttttttttttttttttttttaaggttgttgttttagtgttaagtagattttagttttatttttggtttttttttttttgtgatttttggttttagtgtttttgtttgtaaaatggggatgtggtagaaggtgtaggaggtatgggttttaaagttttttgttgattatggggaggatgtgttatagtggagggtattgaagttaagtattatgatggttgggttgggggagttaagttagttttaattaggattataggaggagtgttggggggatatgggatagttggtgtagggttgggtggtttgtaagtggtgggtatggattaagtgatttttggttatagtttagttttagttttttagtttttatttttgagatttaagatttgtagattcgttggatttaaggggacgtaagtttgagttttttgtattttggcgttgagttaagaagataggaattttttaagggagagagggttggaggggcggggagaagggagtagtagatagggggtatgttaggttgagaagagatatagttgttagtattttttttttatttttaggagataaggtttttttagttagggtagaggtagaggagggggttttttttttttttaagtttaagtttggggtttttggtagtaattttgaattttaatgtaagtttagagtggatttagaaatgtaaggagttattgggatatttttttattttaaaagtttgttaggaatattttatttagtaggtttttttgtagtttttgtttttagtttattttggggttttattttttatttgttttttattgttatttgttggatttagttatttatttagataattttttttagttattttgggtttttggtttggttgggagtatttatgttattaggtagtaggggtgtatatggcggggatgtgatttgttgttgttgttgttgtttatagtattaataatagtaattagttttttttgagttttatttttgtataggtttgttgtgaagtattttatttaatttttatagtagtttttttttttttttttttttttttgagatggagtttcgtttttgttgtttaggttagagtgtaatggcgcgatttcggtttattggaattttcgtttttaggtttgagcgattttgttgtttcggtttttcgagtagttgggattataggcgtattattatatttagttaattttgtattttttagtagagataaggtttttttatgttggttaggttggtttcgaatttttgattttaggtgatttatttggtttggttttttaaagtgttgggattattggtgttagttatcgtgtcgggttaataatagttttattattattttgattttataggaaaattgaggtatacgggttaagtaatttttttagatacgaagttagttaagggtggaggtgggatttatattgtggggttggtggtagaatttttttgaagaggagggtatagttggagggaggagtgaataggagtgggggtattttaggtacggagttgtgagttaacgtttggaggggtagcgtatttggtgtggggttgtttttttttttttgggaaagtgtttttttaattttaatatgagttatttttgttgtaatggttgtgttaatagataaataggttttaaagtttagggaggttagaggtggggttattatttttatggatgaatgaaggagtgtgggagttatgcgtgttggaagtatatattttttttttttttgaatattttaattttagaaaaaggggtgtgtttttttttggttatggagaaggtgaagttaatagttggaggtagaggttgagttaattttttgagttagtgaggggtgtgttggttagttttcggtggttaggttgtttaatggttatttagtttttaatttatgattgtttgtttgtagtttaggttattaggggtgatttttagttatattagtaggttggtttgtttgttgggaggtttagggagttagtaagtttttaaggatgtgtgggagttttcgttagttattttagagttttttattagttggagaaaatatagtataatgggtttgttttgagaggggtggaggtggtagaagaagaaggatagtggggagggggtaagataataagatggtaaaggtagtgtagatggtagttgttgggtaggtggtagtattgttgatggtgttaatgttgttttggtgatgttggaggtggtggtagtggtgttggtgttggtgatgtattagttgtgatggtgtagatggtggtgatggtggttatatggatggttatagtagtgtttatggtggtaacggtgatgttagtggtggtggtggtagtattgggagggattggtgatgttggtgttggtgttagtgatagtaatgatggttattgatggaggtattagtagtaacgatggaaatggtagttaatgggtgttgtaaatggagtgaggtggatagggattagtttttttattagtatggattttttatgttagaggtatagggagagttttaggttagttttggaggtttttggattttggtaagtttaatttgtttttttttaagttattttattattttgtgtttatttttgttttagttagtttagttatagttggggaagtaaagagattaggatagaggagtttaggttagtcgttagtacgtgaggatttgttttagttttttttggggtttatagtattagcggagattttagggtttattttagtttttagagatattagaagtacgggttatttatagacgtaaaggttaaggagttgtcgttttatttatagacgtatatacgtcgttttatgtttagaaatatatgtgtacgtgtatgtttataaatacgttcggttcgcgttttatattgataggttggatagtttttatgtgagaacgcgtacggacgggtatatataagtgtacgcgtcggttattcgagaatgcgttgttattcgcgcgcgtacgtatagggacgcgtacgcggtttcgttaagtggaattagtagaatttaaggtcggtcgagttaattggagattttttggttttggaagttttcgttgttgtcgttaagagacgcggttaattaatttttttttgtagttaggttttttgattcggtttgttcgtttttttcgtcggtgttcgttttatgttcgattcgtttttttttttttttgttttttttgggttttttcgttttttatagttatgttcggattgtagggtttcggtttcgttttggcgcgtttgaaggatgtagttttgtcgcggagttgaggagacgtagttttttggggtagggatggagggggtcgttttaggggatatatttttgtttaggggtttgaggaaatacgattttgaattaagagggatggggttgagggttttatagtttcgttttggggaggttttagagatcgttttaatttttgcgggttatatttacgggaatggttgggttaggtatattaggttgtttttaagttagaggatagaggttgagattttttagtagttatttgttttgggtgagtttttattcgtatgatattttatttttttttttataatgaggttagtgagtttcggtgggtggtagttagggtttagggtgtgtaggttggagggaagggaaaggatattttaggtagagaatagtaggagtgagggtttgagtgttattagaatttcgagtttggatggagggagtttttagataagtagtggaatgagagggatttttatttttagttagtattagagtgtttagtttaatttaggtcgtatgttaatagtttttttatttttttttttttttttttgggattgtaaggaggggaggtattgaggtatttatcgtttattggggatagtattgattggggagttgggttaagatggaaattggtgatttttaagattttttagggtgttaggatttgaaggattttaggttgggtttgtttttttatagtttattattttttatttattttttgttttcgatttatgtttttagtaggtagttaggattttgtgtggatttattttgggatattttattttagttttatgtatttttggggaaaggattggatagagaatattagtgattgtagtttatagggttattggcgggtaggtaggagagagtttttgtttttttttttcgattaggtaggttttattttttagagttatagttttttatttgtaaggtgtgagttttatagagtagattttttatatgtaggggaaattttattttttttttagagttagggttttttgaaagggggtagtttttttgggaaattgggatgtttttgggatttgttgttgcgtcggaaagttttgtttgtggtttgattttcggtttggtaggtggatgtagatgacgttatgattaaagaggaatagatttttttgttgtatcgtgtttaggtttagtgcgaaaaacggtttaaggaggttttgtagaggttaggtgggggttaaaggaagagggtttggggatgaggttaggtgagggaggggttagttaagggcgggatttaggatatagagttaggtgaaggttttttgtgggggcggatttaggtaaagggggttaggttaaagtgagaattaaagtggggtgcgtggtgtaagagtggagttagtaggttcgggtatttatggtttgttttaagtttcgagtttaggtttttgtgttgtttataattagtatttagattgatagttgtcgggttaattttattaattgaagaggtttagattttaattgattgaaggagaggagtcgtttttttttttgataagtttttagggttttgtaggggttgaggttggtgatcgtttagaatataagtatataatgataaatatattttgtggtatatagattttgtttatatttatagagatttatatggtttttgtagttatagttttatcgatgttagttttaatagtggtttttagttatatcgagatttggggggttagatgggtttttttattttgggttttgaatttagtttttttttttaattgtgaaagtttggaggagtttttttttgttttttattatttattatggagtttttcgttttttattgtattttattttgttatttatatttttatattgaggttcgagggtggaggtaggaaaatgagtatagttatttttattttagtttaggttgtttggatttagttttttattattgttatagattcgatatgtaaggattaggggggtttagtttgggcggtggttgaaggaatataagttagaaaatgaggaagattttgtggttaggaagaaagatttttttagtttgggtaatatagtgagattttatttttaaaaaaaaaatttaaaaattagcgaggtatggtggtgtatatttgtagttttagttataggggaggttaaggtgggaggattatttgagtataggaatttgaggttgtagtaatttgtgattatgttattgtattttaggttgggcgatagagggagattttgttttaaaaaaaaaaataaaaaaaataaataaataaaaaaaaaaaacgtttagtatttttttaatgagaagagaggttaggttttattttagattaggtattttaacggttattgtggaagttgtgaattatatatttgaggatttagggtaggggatggggtggttttttttgtttatttttgattgtattattttgtttttgtttttttattattagtttttttatttgtatagtatttaggttagatttaattttcgttatgtaatttgtttattgatattatttattttgtttgtttttatcgtgcgttttttggtggggtttttattgttgcgtggttttggtttttatttatttttgatttttgggtgggaggatattatttttgttttgttttgtttagtttagtgtttattttattagttgattttgtatttttattttaattttgggggataatttttatttttttttattattttatttggtaagtattttatattttgttaaatatttttttatttatcgttttagattttttaatagtttaggtgttattagggtaggagataatttttttattgtataaagggggagtttgaggttaaagagtattttgggttttttgttgtagtatagttgatagttattattattattttggtttttttagttagtataatggaattagataagggatggatatttgcgtttatattagggaagtttaggaaagataaggtatttgggaagttttattttgagtttgaggaggataaggaggtatttattggtagtaggtatcgaggtacgtttttgtttttatgtatttagttggtatgggtttggatttatttatttttattgtattgtttttttgatgtgagtttatgttttttggtttttatagaaagtaaaaggttgtagttatatttttaggtaaggggttgggagaagatagagtgtagtgggaaggaaggggagttagatggtttaggttttagaaagagatgaatagagaattttttagtattatattaagagtggatttagggttacggttttatttatggagagaaagagagatgatagagaattttgggggatagagaggtagggagagatatataaagatagatagatagtgatagagaaagacggggagaggtatggagatagagattaatagaggtagggagagatagttatagagatagaggggattaggaggtatatattgaagtttgggtttagtgtgttagaggaggtatatggggatatatagtggatagggttatagaaatagagaaggagaggagggtagtggtagagggtggggttagaggtagtgggataaggaggggagaagagaagggagggaagtagatgaggaaaggtagatagagtttaggttttggttatagggtcggttttagtcggtcgggtgggtagtagattttagatgggttatatttgggaggttgtggttattttgtggttttttggggattagagggaattgtgggtttggttgggtggggttgggaatatggcgtttaggatagagagttttttattaagttagggcgggtttagttattaaggtagttttttagggtggttggagagttttgtggttggagttttatagagggagagaagggggttgtaagttgggagtggaatgtggaagatatagaggttggggattttttaaggttatttagtttttttgtagtgaggttggggttttaaagtgggatgttattttattttgaattttattattagtatttagatttggggaatcgattttttttagtagtggtcgtgggagttttatagtaggtatttagggtaggtattgagtggtggtagaagtatgggttaatgtggttaattttaattttttaatgaggaaatggaaatagaaagatttgggatatttgcgtgaggttagtagttttttggagtttagttggtattagaaattagattttttgttttttgtttatgattttaggggaaggggtatatagggagttttttagttgagggagagttagtttgggtatttgtttttttttagagatatttggaaggtggttttaagagtagagagaaaggcgagaggtttggtttggggttgagtatttgaagaggatagggttttgtgttgtatgattttagtaagttgtttattttttttggtttttgttagtttatttggaaaatggggttagtgttagtatttgtatcgtagaggttatagtaaattttatgaggtgggtatagtttatagaaatatattttttttagagtgttttaaagtttgaatttttttgtttggggtatatttgtttttgtaggaattaataattattgatgggtcgggtgtagtggtttatgtttgtaattttagtattttgggaggtcgaggtaggtagattatttgaggttaggagtttgagattagtttgattaatatggagaaattttatttttattaaaaatataaaattagttaggtatggtggcgtatgtttgtaattttagttattcgggaggttgaggtaggagaatcgtttgaatttgggaggcggaggttgtagtgagttgagattacgttattgttttttagtttgagtaataaaagcgaaatttcgttttaaaaaaataaaataaaataaaaataaaaataaataaattatagatgtatttatttttttgggttattaattatggttttgatttttttttggtattttttattttgtttgtttttgggtatagggcgtttttgtttgtcggaatgggattatattttgtgttggtcgttgggggtattaggtgaggtggtggttgtgttttgttcggattatatttatgattttaattataaaggtgaggtttgttggaaggggtggggattataaggaggttgagatttggagttaggggtttagtgtttcgagatttttttgtcggttttgattttttatggatttgtaggttatgtttatcgacgttgtgatcgtaatggtagttgggagttggtgtttgggtataataggacgtgggttaattatagcgagtgtgttaaattttttattaatgagattcgtgaacgggtgcgagttttttttttttttaatttgattaggataaatttatttttattttacgggtgatttttgatttagttttgatttttgattttgatttttttagtaattttattttggttttttgtttttattttgatgttttttttgggttttagggttttgattgtgttttttttcgtttcgtataggaggtgtttgatcgtttgggtatgatttatatcgtgggttatttcgtgtttttggcgttttttatcgtagttgtgtttattttggtttattttaggtgggcggggcggggcgagaggcggcgggatatggtggagggggggcggtggtcgaggtttgatgcgattttttttttgtatttattattttcggcgggtgtttttatttacggcgtataatttagttttttgtttatttatcgcgcgttttcgtgtttttatttacggttatgtcgcgcgtttcgtaggcggttgtattgtacgcgtaattatatttatatgtatttgtttttgttttttatgttgcgcgtcgtgagtattttcgttaaggacgttgtgttttattttggcgttacgtttgatgaggttgagcgttttatcgaggaggagttgcgcgttatcgtttaggcgttttcgtcgtttgttatcgtcgttgtcggttacgtgagtatttttttgttcgttcgttttcggtgtcgttattggtttcgtggggtttcgtttcgtttcgttttagttcggttttcgttttgttcgttttttgttagcgttattggttttagttatttaaattcgttttatagggtttttcgtaatttttagttttgtcgtcgattttgttgttaagggtttcgagtgttttatacgtttcgcgttgttattaaggtttttattttaatttagtattttttagttattttatttttttattttgttttttgtttttgatatcgtatttttttgagagagttttttaaacgaagtttgtttttttttggtttgtttggtcggtattatttgtttttttttgtcgttttagttttttagtttagttttgatttttcggaggtaggttttgttttttgattaatattagttggttttttaggcgggttgtagggtggttgtgattttttttttttattttttggttattaattattattggattttggtggaggggttgtatttgtatagttttatttttatggttttttttttagagaagaagtatttgtggggttttatagttttcggttggggtacgcgggtatagcgggtagcgaggtgtcggtaggggtgggatcgtgggtgatagggagagggtagtttttggggggaggcgtttatatagtatatttcgttttaagtggaatagtaggagagaggtttgtcgtttttttgtgattttgattttattttaggtttaggaaatagtagggtttggttagggattaggtttatttgaggttagatttatttgaattgaggttcggtttaggagagggaaaggaggaattattaggttaagatttagtttaggattagagtaggatattgggttagaggttagtttggggttggaattgggattcgggattttttttttattttgagttttatggattaggttagtatttattattttattagtttttttgttgggatggggcgcggggttgtttatattattgttagttttagtaggtttgcggggtttatggtttagagtcgtgggtttagtattttagtattatttgagttttatagtatttttgtagaatgggttgttggagttgcgtattttttttagttttttataggttttgggatttagttatcgataattgtttattattgttggtagttgtagagtttggttgggtttcgggataattggttagattgtagaggggtgggtcgggtggttggagttttttttgtatttagtatttagaggtttataggttaatagttatcgtttttttgtttttcgatatatattttgattttgattttattatgataagttttagagttggggagatttgggtttagttttaggaatagatgtaggttttggggttaggaggtgttttagtggattggcgatatgtagattgggagtgtatagaattttggggtataggaatgttatagtttttttttttatcgtaaagttaggttatattttatttttttaagggtgtattaggtttagagttaagttggtggtatgtggtcggggaggatttggggttttttttttagaggtatagtttatttaaatatattatgtgttttttgagttggcgtaggttaggatatattgatatatcgaggtttttttgtggtttttgtttgggataaaattttttattttatttagttttatttacgagggttaggattttttaaattaggttgtggggggtgttgtgttggggtaaaaaaaaatgcggaaaataggttgtttttttatgggagttgtaagtttaaagtagtgttttttgtagagggagtggatagggtatggattagttagtgatattttattattatattatgttttgtattttatatatgtgtatatgatatggagttaagatgagggtagaggttgagttgggttttgagggttggagttttaaggggaagttgttagggtattatatggtagagtgtggttttgttattaagtggattaagtgtttagtgttaggggtttagggtaatggtggggtaagttgggggttatcgaggatgaggggggaatgattttgtggatagtagttatagttttgtatattgtttttttttgtgtttataggtttgttcgttgttttcgtggttgtgtgggttagtgttagagttattttggttaatatcgggtaggtttaggtggagaaggggtttaggtaagaagtatttttgggtttttttttttttaggaagtatgtgagagggttttttgtattttggttttaaacggtttagttttaggagtttttagtttagttttaagttaggagtatttttagggttataggaggttatttttaaagaggtttgtgagggaggttttaggtttggttatatttagtatttttgttttgtgtttttaatagttaatgttagattagattaaatttgggtttttgtgggtagttttaggatgggaataggagggatgggagttaatgttttaattttttttaggtgttgggatttgagtttcgggaataaaaagtggattatttaggtgtttattttggtttttattgtggtgagtaggggtgggttgttggttataggggtgggtgggatgtgcgtttgcgttttttggaattagtttttgatagggatttaggaggtttttttggattttagtgttagagttatagaggtcggaggattagttgatttatattttagtttagaaaggaaaattaagggtttaaggagttatttagagatgtagtgatagagtagagtttatggtcgtggttgttaggttttgtttcgttttattagggtgtagtttttagacgtagtttttttatttttatagtttaattttattttttttattaatatcgttcgggtgttcgttattaagttgcgggagattaacgtcggtcggtgtgatatacggtagtagtatcggtgagtttattatgtttgttatgttttggttttttaggggtttttgagttttggtattatgtattttaggaaagatagtggttttatgaatgattttggggtaagggaaaggatttagcgtttgattttttggttgtttttatttatttggtttgtttagtagtgatgggaggttttagggtattttaaagttagtttgtttatttgtattaggttttgtattagagttggagtttgtgagtgtgtaacgaatttgaatttttttttaaagagttggttgtagggggtttgaggaataggtaggcggtgagtggtttcgggaaggttgtagtttagttgaaatttgaggagcggattgtgggatagtgaggttcgatcgtggaggggagtgtttgttagttgagggttttataggtgcgaagggtttagggatagggggattgttatttgaagttcgtttcgggatatcgttgagaattaacgggttttattagtatttagttaggatagtagttatgtaggtgaattgggttgtttttttatggtgattggagttttgggtttttttgagttttcggagtttggggttcgtagggtggggggtggtataatgtttgttgaaggggaagtggtttggttttgatttatttgtttcgttggtttaggaagttgtttaaatttacgttggtgtttatgtttttttttggcgtttattatattgtttttatggttatattatatatcgaggttttagggacgttttggtaagtttagatgtattatgagatgttttttaattttttttaggtgcgtagtgttggttcgggtttggttgagggtgggaggggtttcgggggtaggtttgattcgagatatttttttttatagggattttttgtcgtaattatatattgtttttgtaatggcgaggtaagtaggagatagtgttggtatagggtagggtggggtagatattttagaggtttttttaaggtttatttttttatttttttattttgttatttttttgtttttttaagaatatttttgaggatattttgaaagtagagaagtttttttagatgatgtaggtttaggatgtgttaggatgtggggattttttagttattggtatagttaagtgtttttttagttttatggtttaattatttgtgatttagattggaggatttagttatttttggggtaatttgagttttgtagattttgggtgtgtcggttgtttgtagttaaatattttgttgtgaggatgggattttatttggttttggagttttttaggagttttttatttttatttttatttcgtgttgggtgtttaggggtcgggatggggtatcgttggggttgggagatatatttgattgtcgtatttttattgttttaaggtataagttgagattaagaaattttggagtcgttggatattggtattggattttaagcgaaaggtacgtagcgggagtagtagttatagttacggttttatggtgttttatataagtgtgattaatgtcggttttcgtgtgggattcggtttgttttttagttttcgtttattgtttattgttattattaacggttatttttagttgtttggttatgttaagttagggattttagttttggagattttcgagattatattatttgttatggttgtttttaaggacgatgggttttttaacggtttttgtttaggtttggacgaggaggtttttgggtttgagcggttatttgttttgttataggaagagtgggagatagttatgtgattaggcgttgggggttggatttgttgatatagtggatggatagatggattaaaagatgggtggttgaatgattttttatttagggttggggttaagaggaaaaatagggaaaaaaagaaaaaaaaaagaaaaaggaaaaggaagcggtgtgtggttttttgtggtttaaattggggatttatttcgagagggtggggttgggagttagggaaagttgtggcgggagggttatgagttatggaggaatttttaggttttattttagaatggggagggatttggggtttgtggtatttagtagaaagggtttagagtggtttaagtttgtaggggttatatagtagttaagtggatttatgtggaaatttagttttagttttcgttgttgttagttgtggagttgttttttatatttgtatttagattttatgggggatttaggtttttttgggttaatttttttgattgttgtttttattattgttatttagggttgttggtagatttttcgggtttttggttatatttttaagtttacggttttgttatagaatggattttttttggttgtttagtggttatttagggagttttttacgtaggagttttagtatttattcgtgatttgatatgtttttgtgattgaggttgtagtaggagtattaggttagtaggtgaagggtgggttgggtttttgttttggtttaggatttgtggggagttaggagtttgagtttagagggttggttgggtaggggtttgtaaggtgggatatatttatttattatgtatttgggatagttattaagtgtttttatttgatatttatttattattttatttattttttcggatcgtgtttttttttattttgggttattcgtgggttttagagtggtatagagttttttagttcgatattttgaggattgattttatagtatgtttatttcgggttttggtttgaacgagttttttgtttttgttttagtttaaagatagtttcgtacgagttttgttttgtttttttatttttcgtttagttcgttttatttttttttacggattcggtatttaggagtgtattttatttttagtagtttatatatattttatagggtataggggaggggttaggaggtttaagataaaaaatttaggtgggcgttaggaggtgtgggtgtttgttgagtagttttatatttagttttgtttgtttttttagatgacggataggattaaaggttgtttaagggtttggtgtattcgtggagttttatgtaatggttgagggaggtataggttagttttgaagggttgtagagttaggttgggagttattggaagtttaagagggagagtaataaggtttgaatgtttaaaaagtttttatagtaatgtggagacgagaggaggttgtataggggttggagaagaggtggtttggtaggaggcgggtggtttcgtagggagatggtgatagggagggtagtaagagttagttgggggaaggagattttagtagggtagatttttatttttttttttagggatgttcgatgttattttttagggtttgaattgaggtttttgaagtaataagttaatgaggtttatttatttagaagtatttagattgggtatttcgtaatagggttgtggttttttttttagattgggtgtttttttaggtggaggtgggtttttttttttagattggattttttttaggatagggtttggtttttttttataattagggagttttaatttttatttatattttaggatagggttgtgtttttttatttagtttgagtattttaaggttagggttgagtttttgttttaggtagggtgttttttagggtagaggtgcgttttttttttgttttattgggttattttaagatagggttgttatttttattagatttgtttttattttttttttagatggaatttttttttagatagggttgttttttttttttgaattaatgtttttaggatatattgggtatttttattttaggtttggtgtttttaggttagggtcgggtattttatattagttggatgtttttaagaggaggattgttttgttttgaggatatttgtatttagggtagtgttaggtttttttttttagattaggtattatttttttttttagtttggatgtttaagatagaattggattttttattttagtttaagttttttaggttaggattagttttttttttttagattaggagtttttaggttagggttggtttttatttagagaggttttagagttttatttgggttatttaggtattggtagtggaagtggagtttttagtaggtttggtaggtaggtaggattttgtttgttttgagtaggggttggatttaggtggttatttttttttttaaggttttatagtaaagttaagttatagggaatacgtaaatattagtagagttgggcggggtggttagtagggtggagggtatttagagattttaaatttttagtttatttggttatgggattcggtattttgtaggttgttttagattttaaggtaggttagtatagtggttagtttttgtttttatttgttttgagtacgtggacggttttatttttcgttggtttgttttttttagtttaggttgcgagaagaatcgttgaaggtttttggaaggaatggatttttcgggggtgttcgtttagttttggaatataggtttagttttaaggggaagttgagtggatgtaaagtttttagtttagaatagggtcgagttttgttatttattatttgttagtttttgtcgagagtaaggattgagttgggttttaagtgtttggagtgggtaggttttgaggggttataatttttagtttttattttgggaggtggttagagggggtgtggatagataggaaagggggttgagttttttggaggtttaagagggatatgattttgtttttttttttttgggatttgggaggatatagttttgttttgggggtttgaggggatatggatttattttggggatttgagagtgtattgtttttgcgtggatttttggaagagttgtttggttgtagggattcgttgcggggggttggggtgagggggtataattttttgtttttggtttttttttagttaattttaggagaatgattttagtttaaggttgttatggttaattgaaataaattttgtttgagggattggttttattggttgggagggatagaggaggaagttattttagagttaggtaggggtttgagttttggttggttttaggtgtgtgttgtgtggttttgggtaagttattttttttttttgagttttaatttttttttataggttaagtttttgtttaggttttatgatttgagtggatttaggattttatttcgttttttaataaggatagggataggatttttattttttttttaggtaggcgtgatagtttaaggattttttttttagttttaaatatgtttatttgtgtatgtttgtgtgtgtatttatatgtgtgtgtttgtgtgtatgtttatttgtatgtgtatttgttgtttatgtgtatttgtgtgtgtttatttgtatgtgtttgtgtatttgtgtgtatgatcggttttttttttttttagtgttacgggtatgtaggtaatggaggttaggtgagggtggattttttttgttttagcgtttttaataggtagggtaggagtagttttggtatggttcggatattggcgtttgttcggaggttatagttagataatttgtttataataaatttatatttatatattagtaagatagtggggcgtgttgggtgttattttttatgtgcgagcgtttgtatgcgcgtgttgtttgtgtatttttttgtgtttgtgtatacgagtgtttatgtgtttatttatgtgtgtttgtgtttgtgtatttgtgtgtgtgtgtgtgtgtgtgtggttatgtgtgtttttatgtgtgtgtgtttggatatgtttgtatgtttatttgtatgtgtttgtgttttttggtatgtttatgcgtgtgtggttgtaggtttgtgtattagtgtgtttatgtgtgtatttgtgtgtgtgtgtgtatttgtatgtttatttgtgtatttttgtatgtgtgtttatttgtgtgtgtgtatttgtgtttatttgtatatttgtttgttatgtgtatgtgtgtgtgtgtatgtgtttatgtttttgtgttggtgtacgtatgtttatttgtgtgtatttatatgtattgtgtatgtttgtgtatgtgtatttgtgtatttgtgtaaatatgtgtgtttgtatatgtttatttgtgtatgtttgtgtgtgtatttatgtgtgtgtatgtttatttgtatgtgtatttgttgtttatgtgtatttgtgtgtgtttatttgtatgtgtttatttgtgtgtatgtttttgtgtgtgtttatttgtgtgtgtttgtgtatttgtgtatgtttttttgtgtgtgtttatttgtgtatgtttttacgtgtgtatgtgtgtttatttgtatgtgtttgtgtgtttatgtgtgtatgtttttgtgtgtgtgtgtttatttgtgtgtgtgtggattcgtggtttaagaacgtcgtttgtgggtggaatttggtttatagatatgtttggtttggtatttatagtatttttaatattttgagttaatatttaaaaattaggatattttatataaaaatttagttttttaattttttttaaaaatttagaagttttggtagttttgggtttgcgtttttttgaggttacgtttttttcgaattgtgtagggttgttttttttcgtgtattttttatagtttcgtttatttgtttcgtttagtagtgttttgaggatggttgagtttgtgaatttagtgtgtggttataattacgtgtgagtttggttgttagggaatacgtgtatgagtggggtgtgtgtgtatgtgtgtgaatgtgtgtgtgtatgtgtaaagtaattttgtgtatgaggtaaatttgagtgtgtgcggtgcgtgtgaatgtttgtatgtgcgcgtgcgtgtgtgaagagtttgcgtgggggaatacgtgtgtaaaggtatggatgtgtacgtgtgtgtgtaggggagtggttatatttgtggttgtgtggagtgtgtgggttatagcggattggtatgttttgtttaggggtttttttcggtttttgagggggaattggattttcggtttttggttgggtcgttttgcgggatttatttttgttttagtgtttattggagttttgagtaatgggaatatttaaagaaaattagtaaatagatatagaaggggtaggttggttgggaaatttagtttagatatttttgtttagtttatagttgttagagtttttgggggtaggtttgagtttagggagaaaggagttttagtatgcgatagtatttttttattttgtggggtgtttattgttatttatgtatgtttttattatttggatggatggtttttgggttaatattgggtattttgagagtttttttggtttcgagtagtagatgtttaggagatttaggggatgttagtttaggtttggtttaggggttaagaggatttgattttttaggggtgtttttttttagttaggttataggtattttgtttatatatattttttgtatatgtagacgtatttatagtttaaggaggggagaggttgtgttgatttggtagggttgggcgggtattcgatattttattcggattttatatattcggtagtgttttggaattttatttgttaggatacggtttttgttgttttgggttttaggttgattggattttattttttggatcgtttttgatgagtagttatttataaatgatataaattttataggaaaggataggcgtgcgttatgcggtggggtgatttgttttatagaagattcgttgttggtaggagttgtttggattaacgcgttttgttagggattttatcggggattttttgttgttttttagtggttatgggaggatatggggaaataaaagttaatagttgtatggagttgtttattcgcgtttgagtggattttgagggttttacgtggtttttagttagatagttatggggaagtaaggttttttaattggtttgagggaaggggtttggattttagtatagatttggagattatttggaaggttagtttttcgaaggtagaattatcgttagttatagttgtattttcggatatagtgtttagtatgatatgggttttcgggaagtatgttatattaatggtttattttttaggtttttgggggtgggtagcgttgtagtaagttttgggtttagtttagagttttatggagaggtcgtttgaaggtgagcgggtattttatatgttgaagtttttaaggtagtgaggggtttgggtttgaggttggatagtagtttttttttgtgattttaggggttgtgtttatttttgattttaagtttatagttttttattgtggttataaggttttgttttggttggtgatttgtttggtttttgattttgtaagtttaggtgggatt

SEQ ID NO: 51 - DNA, 27489 bp, Homo sapiens
agttgtataggtgtaagtggggttttggttaaggatggggaaggggtgtgggaggtggttgttgagggtttgggattttaggaggttgaatggttgggggttggtggttggaatatttaagggtttagtgtggttgtaaagttgagattgtattttttaattgtatgttttgtgtggtttagaatgtgttttttgtttggttttgattttttatgttgaaagttgtggagttaaaaataatagttttgtgtgttttttgtagattgtgattttgattttttttttgttttttttttttattgggtgtggggtgaagttatagtttttatttttttaaaagaaaaaaaaagaaagaaagaaagaaagaaagaaagaaaaggtggtgtgggaggggggtggggggtgggttgggggtggggggtttggttatatggatgtgatttttttgttttgaggtagatgggttgttttgtagtgtttggtgtttgtttgttgtttgtttggtttttggtttttttttttttttttttgttttttttttttttttttttttgtgttgtttgtttgtttgtttgtttgtttgtttttagtgtatgggttttgtgttgggttttggggttttgggttgttgggatgttggggttttataggttggggtgtgggtggggtggttagtttgatgtagttttgtattttttattattattagggttggtggtggtggttgttttgagggatgtggttttaggtggtggtgatggggattgtttggattgtatttggtttggtgtttttgttttgttgttttgtgtttagttttgtgtatgtgttggtgagttttttgttgttaatattttgggataggttgtgggtttattttagggtttgtgggataggtttaaggtatgtagttttgagtttttttagtagtttgaattttgggtgagagttttttttgatttaggattttgggtgtttgttgtttttgggatgtttggattgtgggttttagttgtttgaagtttttttatttttgaagttttgtttggggttttaaatttggtaatttgtggttgagtttttattattttttgtttttgtgagtattatggttgtttttttttggaagatgatagtgtgatttaatagaaggttgggttttggttttgttgtgtatttttatagattttgttttggggatttttgttttttgtaagttttgttgtagttttggatatagggaatgtaggtttgaggttagaattatttaggtagggggtaggatttaggggttttttttagtttttatatatatatatgtatatgtttggttttatttagggtagaagttgtttttttaaggaggtgggtgtggtgtggtatggagaagggatggagttttttgaaggagattgattttatagtgtatttttgtaggagaagtatagtatattttgtggggaagtgaggagatttttggaaagattgttattttttgagagtgatttaaaagtagaatggtagggaaggttagagggagaggagagatagagataaagttgggtggggaggagagatttttttagttggaggggtggatagattaagaatagtaaaaaaaatagggagataggtaaaggtagaaagttggagatatagagtgggtagtattttttttttttgggttagggtttggggtttatttgttgggaagggggttgttttagttttttagttttattttatagtaattttattttttgggatgagtttgtttttggggaggttgtttgtttgtgtgtttaattttaaagttttttttttttgttttttagtgggggtatttgtttgttagagagtagggtagttaggtagttttttttttttgattagtagtagttttttatatggggtagagttttaggtagttttaatgagtttgggatttttttatttttgtatgatgtttgtgtaagtttgggttgtttttttttgtgttttagttgttttatttgtaaaagagagggtttggaagaaatatttgtttgagaattttattattagaggttttttttttttttgaggtttttagtattttttatttatttgtgtttatatttttataattttggttttagtaaaggttttttattaaagatagttttatataaggttttgtggatggggaaattgaggtttagaggagtttaatattttttgtagagatattttaagtattgatgaatgttaggggatagaattattattaattttatttttggagtttggtgtgtgatggtttgaggggtagatagggtgatgggtgtgggtgttttgagagtaagtttatgtgttagagtagggttttgtgggattttgggtatggtgtttatttgggtttgtgtgattgtgagtgtttgagtttttgtgtgagtttatgtgtttgaagttgtggtgtatgatttggaggtgtagttgtgtgtgtttgtgtgtgtttttgtgagtgtttgtgtatttgggtttgttgtttttttatgtgtattttataaatgtttttgtagggttttttatttgttattgttttaagtaatttatgtatattagttagtttaatttttttaattatttttagaggaaggttattgtttttatttttaattggtttgaattatataattataatgattattatttattttatgttaagttttgtgtttttatgtgtgtgtggagtatgggtatttagagttttattgttttttagggaagttgagatatatgtagagaatttttttggttttgttttggtttatgtttgagagtagaaggatagatgttagtgtttagtttgtttaggattttgttggggtatgtgagtttattggatattttttggttttggggttagaagattgggattgaagggtgggggtagtttatttatttatttaatattttatgggttttttggatttatttggggttagtaagaagttggtagtttgttagtttttttttttgagtttagagggttattgtttttttttagatttgtatttatgttttttaagtttattaattttattttatggttggttattaaatttgtatgttatttgtttagttggttttaagattaggtttatatttttagtgattttatatttggggggttaaagagtattttatttggaggatattggttgtggttagatttagttggtttattttttgttgtataggaaatagttatttgggagtttggagtttggggtggggtggagtttggaggaagtgatagatttatagattgtgagtaggaggtaaaggggtatttttgtttttgaggatgtgtttttttaaggatttttttagtatgtatatatgtggaggagaaattgtaataagagaagttggagtttagtatggggtaggttttgagtgtgaagatgtgattattgggtaggatttataagagattgtggtgtggatttataggttgggagtgtgtgggattttttttagtttgttttaggggtagtttggttatgttgtttgtttgtttttttttttgagatagagttttattttgttgtttaggttggagtgtagtagtgtgattttggtttattgtaagttttgttttttgggtttatgttgtttttttgttttagtttttttagtagttgggattataggtgtttgttattatgtttagttaattttttgtatttttagtagagatggagttttattgtgttagttaggatggttttgattttttgattttgtgatttgtttgttttggttttttaaagtgttgggattataggtgtgagttattatgtttggttggttgtttgtttttaaagataggaagaagttaatatgtatagaatagtggttgtttttagattttgagttagaaattgttatagattgtttttttattttatttatttatttagtgatttttatgttaaagggttttgagagttatatagtgagtttgtggtatagtaggatttgaatttagatttttagatttttgtattgaattttttttttaaaagtagtatgagatttgttgttggtaggagatttttatgttttattttgggttttttttttttttttttttttttaaaaattaaattatggttgagtgtagtggtttatatttgtaattttaatattttgggaggttgggtagattatttgaggttaggagtttgagattagtttggttaatatggtgaaatttttatttttattaagaatataaaaattagttatgtgtggtggtatgtgtttgtaattttagtttattggaaggttgaggtaggagaattgtttgaatttaggaggtagaggttgtagtgaattgagattatgttgttgtattttattttgggtgatagaggttttgtaaaaaagaaaaaaaaaattaaatttttttgttattttgttaatttttaattttataattgatatatgaatatgtttttataaaagagttaaataagtttgtaattttagatatttgagaggttgaggagggagaattgtttgagtttagaagtttaaggttgtaatgagttatgattatgttattttattttagtttgggtgatagagtgagtttttgtttttgaaaaaaaaaaaaaaaaaaaaagagagagagttaattaataaaaattaaatagaagttttttttgattatttttaagttttagtttttttttagggaaaattatttttagtagtttgggtagaggggtgtttttttttttttttttgtgtgtttttaaatggtatttttttgtgtatatattaagtagataattttgttattttttatttgtttggttgtttttaaataaatggtattggtttttagatagggttttgttatatatatattttgatgtaaatgtgtgttttagagatttttattttagtaaatatgaatttatatttttaaatgttgtatagtattttaaaatttgggatttattaagtagtttataggaatgtatatttagattatttttgtataatttgtgtgtgtgtttatatgtgtgtgattttagatggtggtagggaagttttttgaaatgttttttagtgtttttatgtgattattttttagtaggatatttttagattttgttattgttgggtttgagaatatatatattttttattttaatagtatggttaaattgttttttaaaaagtttgtgttgttttgtatttatataatattaagattaattaggagggtttttttgtttatatttattgttttataggatgttaagaggattttttgtgttttatttttgtttggataggtgaaaatggtgttttttgttattttaatttgttgattattagtgatttttgggttttatagtgagagtttgtttggggttattaattattattttatgggttatttgttttttttgtattgatttgttgaagttttttatattatttgtttttaaatatatttattttagtttttgaaatggtttatggatagagtagtaggagggtgttgagttttttgaggaattggggttttttttggaatgttttaatgaggtgttaagtagttttttttagatttttgttgtgggttttttggggatattttttggtttagttattatattaggaaggtagttattttagaaggagagtttttaggaaaaagaaaaggtggggtgagggttttgtagatttttgaaattgtttgtaaaatatggtgtgattgggagaagggtgtaaatttttgtttaggtttgtagaaatattagagatttttaaatttttaaaagttttaattttggggttagttttatgtttgaggtgagatttagtgggattttattttgttgagtaggtgatggtttagattaggttatattgtttttttgggttttgattttttaatttaagtagggtttgtttatgaagatttattaggttgtagtagttaattttgttattttaggttgtattttattgtttgttttgaaggtggttatgttggttggttaggatgagaggtgttatagtgtttttttttttttagttttttttagttttaaatataggtagtttgtttaggaaagtttggtgaaggggaggaaaagttagtatttgttagtggtggtggggtaggatgaggagtttgtttaggttagttggatagagagagggtagtaggggtgggggagtagttttagttagttggtatgggagatatttaggggtgttagtatgggttttagtagtagaatttggaggagggttgtaggaaggttaggaggttatgaaggggttttttgttagttagggttttttttttttggttgtgttggaggtattaatggtttggtttttaatattagagtttaattgttttttatttagttatagttggggataagttgttattattggtattattggtatttttatgtttatatatttttgtttttaaattggttttggggaggttgttttaggggatttgtaaagggagatttgtttaatgtagtagttaaaatttaggattatggaaagatgatattgtggttggtgttagggtatttgtgtggttgggtatttttttttttttttttttttttttaaggttgttgttttagtgttaagtagattttagttttatttttggtttttttttttttgtgatttttggttttagtgtttttgtttgtaaaatggggatgtggtagaaggtgtaggaggtatgggttttaaagttttttgttgattatggggaggatgtgttatagtggagggtattgaagttaagtattatgatggttgggttgggggagttaagttagttttaattaggattataggaggagtgttggggggatatgggatagttggtgtagggttgggtggtttgtaagtggtgggtatggattaagtgatttttggttatagtttagttttagttttttagtttttatttttgagatttaagatttgtagatttgttggatttaaggggatgtaagtttgagttttttgtattttggtgttgagttaagaagataggaattttttaagggagagagggttggaggggtggggagaagggagtagtagatagggggtatgttaggttgagaagagatatagttgttagtattttttttttatttttaggagataaggtttttttagttagggtagaggtagaggagggggttttttttttttttaagtttaagtttggggtttttggtagtaattttgaattttaatgtaagtttagagtggatttagaaatgtaaggagttattgggatatttttttattttaaaagtttgttaggaatattttatttagtaggtttttttgtagtttttgtttttagtttattttggggttttattttttatttgttttttattgttatttgttggatttagttatttatttagataattttttttagttattttgggtttttggtttggttgggagtatttatgttattaggtagtaggggtgtatatggtggggatgtgatttgttgttgttgttgttgtttatagtattaataatagtaattagttttttttgagttttatttttgtataggtttgttgtgaagtattttatttaatttttatagtagtttttttttttttttttttttttttgagatggagttttgtttttgttgtttaggttagagtgtaatggtgtgattttggtttattggaatttttgtttttaggtttgagtgattttgttgttttggttttttgagtagttgggattataggtgtattattatatttagttaattttgtattttttagtagagataaggtttttttatgttggttaggttggttttgaatttttgattttaggtgatttatttggtttggttttttaaagtgttgggattattggtgttagttattgtgttgggttaataatagttttattattattttgattttataggaaaattgaggtatatgggttaagtaatttttttagatatgaagttagttaagggtggaggtgggatttatattgtggggttggtggtagaatttttttgaagaggagggtatagttggagggaggagtgaataggagtgggggtattttaggtatggagttgtgagttaatgtttggaggggtagtgtatttggtgtggggttgtttttttttttttgggaaagtgtttttttaattttaatatgagttatttttgttgtaatggttgtgttaatagataaataggttttaaagtttagggaggttagaggtggggttattatttttatggatgaatgaaggagtgtgggagttatgtgtgttggaagtatatattttttttttttttgaatattttaattttagaaaaaggggtgtgtttttttttggttatggagaaggtgaagttaatagttggaggtagaggttgagttaattttttgagttagtgaggggtgtgttggttagtttttggtggttaggttgtttaatggttatttagtttttaatttatgattgtttgtttgtagtttaggttattaggggtgatttttagttatattagtaggttggtttgtttgttgggaggtttagggagttagtaagtttttaaggatgtgtgggagtttttgttagttattttagagttttttattagttggagaaaatatagtataatgggtttgttttgagaggggtggaggtggtagaagaagaaggatagtggggagggggtaagataataagatggtaaaggtagtgtagatggtagttgttgggtaggtggtagtattgttgatggtgttaatgttgttttggtgatgttggaggtggtggtagtggtgttggtgttggtgatgtattagttgtgatggtgtagatggtggtgatggtggttatatggatggttatagtagtgtttatggtggtaatggtgatgttagtggtggtggtggtagtattgggagggattggtgatgttggtgttggtgttagtgatagtaatgatggttattgatggaggtattagtagtaatgatggaaatggtagttaatgggtgttgtaaatggagtgaggtggatagggattagtttttttattagtatggattttttatgttagaggtatagggagagttttaggttagttttggaggtttttggattttggtaagtttaatttgtttttttttaagttattttattattttgtgtttatttttgttttagttagtttagttatagttggggaagtaaagagattaggatagaggagtttaggttagttgttagtatgtgaggatttgttttagttttttttggggtttatagtattagtggagattttagggtttattttagtttttagagatattagaagtatgggttatttatagatgtaaaggttaaggagttgttgttttatttatagatgtatatatgttgttttatgtttagaaatatatgtgtatgtgtatgtttataaatatgtttggtttgtgttttatattgataggttggatagtttttatgtgagaatgtgtatggatgggtatatataagtgtatgtgttggttatttgagaatgtgttgttatttgtgtgtgtatgtatagggatgtgtatgtggttttgttaagtggaattagtagaatttaaggttggttgagttaattggagattttttggttttggaagtttttgttgttgttgttaagagatgtggttaattaatttttttttgtagttaggttttttgatttggtttgtttgttttttttgttggtgtttgttttatgtttgatttgtttttttttttttttgttttttttgggtttttttgttttttatagttatgtttggattgtagggttttggttttgttttggtgtgtttgaaggatgtagttttgttgtggagttgaggagatgtagttttttggggtagggatggagggggttgttttaggggatatatttttgtttaggggtttgaggaaatatgattttgaattaagagggatggggttgagggttttatagttttgttttggggaggttttagagattgttttaatttttgtgggttatatttatgggaatggttgggttaggtatattaggttgtttttaagttagaggatagaggttgagattttttagtagttatttgttttgggtgagtttttatttgtatgatattttatttttttttttataatgaggttagtgagttttggtgggtggtagttagggtttagggtgtgtaggttggagggaagggaaaggatattttaggtagagaatagtaggagtgagggtttgagtgttattagaattttgagtttggatggagggagtttttagataagtagtggaatgagagggatttttatttttagttagtattagagtgtttagtttaatttaggttgtatgttaatagtttttttatttttttttttttttttttgggattgtaaggaggggaggtattgaggtatttattgtttattggggatagtattgattggggagttgggttaagatggaaattggtgatttttaagattttttagggtgttaggatttgaaggattttaggttgggtttgtttttttatagtttattattttttatttattttttgtttttgatttatgtttttagtaggtagttaggattttgtgtggatttattttgggatattttattttagttttatgtatttttggggaaaggattggatagagaatattagtgattgtagtttatagggttattggtgggtaggtaggagagagtttttgttttttttttttgattaggtaggttttattttttagagttatagttttttatttgtaaggtgtgagttttatagagtagattttttatatgtaggggaaattttattttttttttagagttagggttttttgaaagggggtagtttttttgggaaattgggatgtttttgggatttgttgttgtgttggaaagttttgtttgtggtttgatttttggtttggtaggtggatgtagatgatgttatgattaaagaggaatagatttttttgttgtattgtgtttaggtttagtgtgaaaaatggtttaaggaggttttgtagaggttaggtgggggttaaaggaagagggtttggggatgaggttaggtgagggaggggttagttaagggtgggatttaggatatagagttaggtgaaggttttttgtgggggtggatttaggtaaagggggttaggttaaagtgagaattaaagtggggtgtgtggtgtaagagtggagttagtaggtttgggtatttatggtttgttttaagttttgagtttaggtttttgtgttgtttataattagtatttagattgatagttgttgggttaattttattaattgaagaggtttagattttaattgattgaaggagaggagttgtttttttttttgataagtttttagggttttgtaggggttgaggttggtgattgtttagaatataagtatataatgataaatatattttgtggtatatagattttgtttatatttatagagatttatatggtttttgtagttatagttttattgatgttagttttaatagtggtttttagttatattgagatttggggggttagatgggtttttttattttgggttttgaatttagtttttttttttaattgtgaaagtttggaggagtttttttttgttttttattatttattatggagttttttgttttttattgtattttattttgttatttatatttttatattgaggtttgagggtggaggtaggaaaatgagtatagttatttttattttagtttaggttgtttggatttagttttttattattgttatagatttgatatgtaaggattaggggggtttagtttgggtggtggttgaaggaatataagttagaaaatgaggaagattttgtggttaggaagaaagatttttttagtttgggtaatatagtgagattttatttttaaaaaaaaaatttaaaaattagtgaggtatggtggtgtatatttgtagttttagttataggggaggttaaggtgggaggattatttgagtataggaatttgaggttgtagtaatttgtgattatgttattgtattttaggttgggtgatagagggagattttgttttaaaaaaaaaaataaaaaaaataaataaataaaaaaaaaaaatgtttagtatttttttaatgagaagagaggttaggttttattttagattaggtattttaatggttattgtggaagttgtgaattatatatttgaggatttagggtaggggatggggtggttttttttgtttatttttgattgtattattttgtttttgtttttttattattagtttttttatttgtatagtatttaggttagatttaatttttgttatgtaatttgtttattgatattatttattttgtttgtttttattgtgtgttttttggtggggtttttattgttgtgtggttttggtttttatttatttttgatttttgggtgggaggatattatttttgttttgttttgtttagtttagtgtttattttattagttgattttgtatttttattttaattttgggggataatttttatttttttttattattttatttggtaagtattttatattttgttaaatatttttttatttattgttttagattttttaatagtttaggtgttattagggtaggagataatttttttattgtataaagggggagtttgaggttaaagagtattttgggttttttgttgtagtatagttgatagttattattattattttggtttttttagttagtataatggaattagataagggatggatatttgtgtttatattagggaagtttaggaaagataaggtatttgggaagttttattttgagtttgaggaggataaggaggtatttattggtagtaggtattgaggtatgtttttgtttttatgtatttagttggtatgggtttggatttatttatttttattgtattgtttttttgatgtgagtttatgttttttggtttttatagaaagtaaaaggttgtagttatatttttaggtaaggggttgggagaagatagagtgtagtgggaaggaaggggagttagatggtttaggttttagaaagagatgaatagagaattttttagtattatattaagagtggatttagggttatggttttatttatggagagaaagagagatgatagagaattttgggggatagagaggtagggagagatatataaagatagatagatagtgatagagaaagatggggagaggtatggagatagagattaatagaggtagggagagatagttatagagatagaggggattaggaggtatatattgaagtttgggtttagtgtgttagaggaggtatatggggatatatagtggatagggttatagaaatagagaaggagaggagggtagtggtagagggtggggttagaggtagtgggataaggaggggagaagagaagggagggaagtagatgaggaaaggtagatagagtttaggttttggttatagggttggttttagttggttgggtgggtagtagattttagatgggttatatttgggaggttgtggttattttgtggttttttggggattagagggaattgtgggtttggttgggtggggttgggaatatggtgtttaggatagagagttttttattaagttagggtgggtttagttattaaggtagttttttagggtggttggagagttttgtggttggagttttatagagggagagaagggggttgtaagttgggagtggaatgtggaagatatagaggttggggattttttaaggttatttagtttttttgtagtgaggttggggttttaaagtgggatgttattttattttgaattttattattagtatttagatttggggaattgattttttttagtagtggttgtgggagttttatagtaggtatttagggtaggtattgagtggtggtagaagtatgggttaatgtggttaattttaattttttaatgaggaaatggaaatagaaagatttgggatatttgtgtgaggttagtagttttttggagtttagttggtattagaaattagattttttgttttttgtttatgattttaggggaaggggtatatagggagttttttagttgagggagagttagtttgggtatttgtttttttttagagatatttggaaggtggttttaagagtagagagaaaggtgagaggtttggtttggggttgagtatttgaagaggatagggttttgtgttgtatgattttagtaagttgtttattttttttggtttttgttagtttatttggaaaatggggttagtgttagtatttgtattgtagaggttatagtaaattttatgaggtgggtatagtttatagaaatatattttttttagagtgttttaaagtttgaatttttttgtttggggtatatttgtttttgtaggaattaataattattgatgggttgggtgtagtggtttatgtttgtaattttagtattttgggaggttgaggtaggtagattatttgaggttaggagtttgagattagtttgattaatatggagaaattttatttttattaaaaatataaaattagttaggtatggtggtgtatgtttgtaattttagttatttgggaggttgaggtaggagaattgtttgaatttgggaggtggaggttgtagtgagttgagattatgttattgttttttagtttgagtaataaaagtgaaattttgttttaaaaaaataaaataaaataaaaataaaaataaataaattatagatgtatttatttttttgggttattaattatggttttgatttttttttggtattttttattttgtttgtttttgggtatagggtgtttttgtttgttggaatgggattatattttgtgttggttgttgggggtattaggtgaggtggtggttgtgttttgtttggattatatttatgattttaattataaaggtgaggtttgttggaaggggtggggattataaggaggttgagatttggagttaggggtttagtgttttgagatttttttgttggttttgattttttatggatttgtaggttatgtttattgatgttgtgattgtaatggtagttgggagttggtgtttgggtataataggatgtgggttaattatagtgagtgtgttaaattttttattaatgagatttgtgaatgggtgtgagttttttttttttttaatttgattaggataaatttatttttattttatgggtgatttttgatttagttttgatttttgattttgatttttttagtaattttattttggttttttgtttttattttgatgttttttttgggttttagggttttgattgtgtttttttttgttttgtataggaggtgtttgattgtttgggtatgatttatattgtgggttattttgtgtttttggtgttttttattgtagttgtgtttattttggtttattttaggtgggtggggtggggtgagaggtggtgggatatggtggagggggggtggtggttgaggtttgatgtgattttttttttgtatttattatttttggtgggtgtttttatttatggtgtataatttagttttttgtttatttattgtgtgtttttgtgtttttatttatggttatgttgtgtgttttgtaggtggttgtattgtatgtgtaattatatttatatgtatttgtttttgttttttatgttgtgtgttgtgagtatttttgttaaggatgttgtgttttattttggtgttatgtttgatgaggttgagtgttttattgaggaggagttgtgtgttattgtttaggtgtttttgttgtttgttattgttgttgttggttatgtgagtatttttttgtttgtttgtttttggtgttgttattggttttgtggggttttgttttgttttgttttagtttggtttttgttttgtttgttttttgttagtgttattggttttagttatttaaatttgttttatagggttttttgtaatttttagttttgttgttgattttgttgttaagggttttgagtgttttatatgttttgtgttgttattaaggtttttattttaatttagtattttttagttattttatttttttattttgttttttgtttttgatattgtatttttttgagagagttttttaaatgaagtttgtttttttttggtttgtttggttggtattatttgtttttttttgttgttttagttttttagtttagttttgattttttggaggtaggttttgttttttgattaatattagttggttttttaggtgggttgtagggtggttgtgattttttttttttattttttggttattaattattattggattttggtggaggggttgtatttgtatagttttatttttatggttttttttttagagaagaagtatttgtggggttttatagtttttggttggggtatgtgggtatagtgggtagtgaggtgttggtaggggtgggattgtgggtgatagggagagggtagtttttggggggaggtgtttatatagtatattttgttttaagtggaatagtaggagagaggtttgttgtttttttgtgattttgattttattttaggtttaggaaatagtagggtttggttagggattaggtttatttgaggttagatttatttgaattgaggtttggtttaggagagggaaaggaggaattattaggttaagatttagtttaggattagagtaggatattgggttagaggttagtttggggttggaattgggatttgggattttttttttattttgagttttatggattaggttagtatttattattttattagtttttttgttgggatggggtgtggggttgtttatattattgttagttttagtaggtttgtggggtttatggtttagagttgtgggtttagtattttagtattatttgagttttatagtatttttgtagaatgggttgttggagttgtgtattttttttagttttttataggttttgggatttagttattgataattgtttattattgttggtagttgtagagtttggttgggttttgggataattggttagattgtagaggggtgggttgggtggttggagttttttttgtatttagtatttagaggtttataggttaatagttattgtttttttgttttttgatatatattttgattttgattttattatgataagttttagagttggggagatttgggtttagttttaggaatagatgtaggttttggggttaggaggtgttttagtggattggtgatatgtagattgggagtgtatagaattttggggtataggaatgttatagtttttttttttattgtaaagttaggttatattttatttttttaagggtgtattaggtttagagttaagttggtggtatgtggttggggaggatttggggttttttttttagaggtatagtttatttaaatatattatgtgttttttgagttggtgtaggttaggatatattgatatattgaggtttttttgtggtttttgtttgggataaaattttttattttatttagttttatttatgagggttaggattttttaaattaggttgtggggggtgttgtgttggggtaaaaaaaaatgtggaaaataggttgtttttttatgggagttgtaagtttaaagtagtgttttttgtagagggagtggatagggtatggattagttagtgatattttattattatattatgttttgtattttatatatgtgtatatgatatggagttaagatgagggtagaggttgagttgggttttgagggttggagttttaaggggaagttgttagggtattatatggtagagtgtggttttgttattaagtggattaagtgtttagtgttaggggtttagggtaatggtggggtaagttgggggttattgaggatgaggggggaatgattttgtggatagtagttatagttttgtatattgtttttttttgtgtttataggtttgtttgttgtttttgtggttgtgtgggttagtgttagagttattttggttaatattgggtaggtttaggtggagaaggggtttaggtaagaagtatttttgggtttttttttttttaggaagtatgtgagagggttttttgtattttggttttaaatggtttagttttaggagtttttagtttagttttaagttaggagtatttttagggttataggaggttatttttaaagaggtttgtgagggaggttttaggtttggttatatttagtatttttgttttgtgtttttaatagttaatgttagattagattaaatttgggtttttgtgggtagttttaggatgggaataggagggatgggagttaatgttttaattttttttaggtgttgggatttgagttttgggaataaaaagtggattatttaggtgtttattttggtttttattgtggtgagtaggggtgggttgttggttataggggtgggtgggatgtgtgtttgtgttttttggaattagtttttgatagggatttaggaggtttttttggattttagtgttagagttatagaggttggaggattagttgatttatattttagtttagaaaggaaaattaagggtttaaggagttatttagagatgtagtgatagagtagagtttatggttgtggttgttaggttttgttttgttttattagggtgtagtttttagatgtagtttttttatttttatagtttaattttattttttttattaatattgtttgggtgtttgttattaagttgtgggagattaatgttggttggtgtgatatatggtagtagtattggtgagtttattatgtttgttatgttttggttttttaggggtttttgagttttggtattatgtattttaggaaagatagtggttttatgaatgattttggggtaagggaaaggatttagtgtttgattttttggttgtttttatttatttggtttgtttagtagtgatgggaggttttagggtattttaaagttagtttgtttatttgtattaggttttgtattagagttggagtttgtgagtgtgtaatgaatttgaatttttttttaaagagttggttgtagggggtttgaggaataggtaggtggtgagtggttttgggaaggttgtagtttagttgaaatttgaggagtggattgtgggatagtgaggtttgattgtggaggggagtgtttgttagttgagggttttataggtgtgaagggtttagggatagggggattgttatttgaagtttgttttgggatattgttgagaattaatgggttttattagtatttagttaggatagtagttatgtaggtgaattgggttgtttttttatggtgattggagttttgggtttttttgagtttttggagtttggggtttgtagggtggggggtggtataatgtttgttgaaggggaagtggtttggttttgatttatttgttttgttggtttaggaagttgtttaaatttatgttggtgtttatgtttttttttggtgtttattatattgtttttatggttatattatatattgaggttttagggatgttttggtaagtttagatgtattatgagatgttttttaattttttttaggtgtgtagtgttggtttgggtttggttgagggtgggaggggttttgggggtaggtttgatttgagatatttttttttatagggattttttgttgtaattatatattgtttttgtaatggtgaggtaagtaggagatagtgttggtatagggtagggtggggtagatattttagaggtttttttaaggtttatttttttatttttttattttgttatttttttgtttttttaagaatatttttgaggatattttgaaagtagagaagtttttttagatgatgtaggtttaggatgtgttaggatgtggggattttttagttattggtatagttaagtgtttttttagttttatggtttaattatttgtgatttagattggaggatttagttatttttggggtaatttgagttttgtagattttgggtgtgttggttgtttgtagttaaatattttgttgtgaggatgggattttatttggttttggagttttttaggagttttttatttttatttttattttgtgttgggtgtttaggggttgggatggggtattgttggggttgggagatatatttgattgttgtatttttattgttttaaggtataagttgagattaagaaattttggagttgttggatattggtattggattttaagtgaaaggtatgtagtgggagtagtagttatagttatggttttatggtgttttatataagtgtgattaatgttggtttttgtgtgggatttggtttgttttttagtttttgtttattgtttattgttattattaatggttatttttagttgtttggttatgttaagttagggattttagttttggagatttttgagattatattatttgttatggttgtttttaaggatgatgggttttttaatggtttttgtttaggtttggatgaggaggtttttgggtttgagtggttatttgttttgttataggaagagtgggagatagttatgtgattaggtgttgggggttggatttgttgatatagtggatggatagatggattaaaagatgggtggttgaatgattttttatttagggttggggttaagaggaaaaatagggaaaaaaagaaaaaaaaaagaaaaaggaaaaggaagtggtgtgtggttttttgtggtttaaattggggatttattttgagagggtggggttgggagttagggaaagttgtggtgggagggttatgagttatggaggaatttttaggttttattttagaatggggagggatttggggtttgtggtatttagtagaaagggtttagagtggtttaagtttgtaggggttatatagtagttaagtggatttatgtggaaatttagttttagtttttgttgttgttagttgtggagttgttttttatatttgtatttagattttatgggggatttaggtttttttgggttaatttttttgattgttgtttttattattgttatttagggttgttggtagattttttgggtttttggttatatttttaagtttatggttttgttatagaatggattttttttggttgtttagtggttatttagggagttttttatgtaggagttttagtatttatttgtgatttgatatgtttttgtgattgaggttgtagtaggagtattaggttagtaggtgaagggtgggttgggtttttgttttggtttaggatttgtggggagttaggagtttgagtttagagggttggttgggtaggggtttgtaaggtgggatatatttatttattatgtatttgggatagttattaagtgtttttatttgatatttatttattattttatttatttttttggattgtgtttttttttattttgggttatttgtgggttttagagtggtatagagttttttagtttgatattttgaggattgattttatagtatgtttattttgggttttggtttgaatgagttttttgtttttgttttagtttaaagatagttttgtatgagttttgttttgtttttttattttttgtttagtttgttttatttttttttatggatttggtatttaggagtgtattttatttttagtagtttatatatattttatagggtataggggaggggttaggaggtttaagataaaaaatttaggtgggtgttaggaggtgtgggtgtttgttgagtagttttatatttagttttgtttgtttttttagatgatggataggattaaaggttgtttaagggtttggtgtatttgtggagttttatgtaatggttgagggaggtataggttagttttgaagggttgtagagttaggttgggagttattggaagtttaagagggagagtaataaggtttgaatgtttaaaaagtttttatagtaatgtggagatgagaggaggttgtataggggttggagaagaggtggtttggtaggaggtgggtggttttgtagggagatggtgatagggagggtagtaagagttagttgggggaaggagattttagtagggtagatttttatttttttttttagggatgtttgatgttattttttagggtttgaattgaggtttttgaagtaataagttaatgaggtttatttatttagaagtatttagattgggtattttgtaatagggttgtggttttttttttagattgggtgtttttttaggtggaggtgggtttttttttttagattggattttttttaggatagggtttggtttttttttataattagggagttttaatttttatttatattttaggatagggttgtgtttttttatttagtttgagtattttaaggttagggttgagtttttgttttaggtagggtgttttttagggtagaggtgtgttttttttttgttttattgggttattttaagatagggttgttatttttattagatttgtttttattttttttttagatggaatttttttttagatagggttgttttttttttttgaattaatgtttttaggatatattgggtatttttattttaggtttggtgtttttaggttagggttgggtattttatattagttggatgtttttaagaggaggattgttttgttttgaggatatttgtatttagggtagtgttaggtttttttttttagattaggtattatttttttttttagtttggatgtttaagatagaattggattttttattttagtttaagttttttaggttaggattagttttttttttttagattaggagtttttaggttagggttggtttttatttagagaggttttagagttttatttgggttatttaggtattggtagtggaagtggagtttttagtaggtttggtaggtaggtaggattttgtttgttttgagtaggggttggatttaggtggttatttttttttttaaggttttatagtaaagttaagttatagggaatatgtaaatattagtagagttgggtggggtggttagtagggtggagggtatttagagattttaaatttttagtttatttggttatgggatttggtattttgtaggttgttttagattttaaggtaggttagtatagtggttagtttttgtttttatttgttttgagtatgtggatggttttattttttgttggtttgttttttttagtttaggttgtgagaagaattgttgaaggtttttggaaggaatggattttttgggggtgtttgtttagttttggaatataggtttagttttaaggggaagttgagtggatgtaaagtttttagtttagaatagggttgagttttgttatttattatttgttagtttttgttgagagtaaggattgagttgggttttaagtgtttggagtgggtaggttttgaggggttataatttttagtttttattttgggaggtggttagagggggtgtggatagataggaaagggggttgagttttttggaggtttaagagggatatgattttgtttttttttttttgggatttgggaggatatagttttgttttgggggtttgaggggatatggatttattttggggatttgagagtgtattgtttttgtgtggatttttggaagagttgtttggttgtagggatttgttgtggggggttggggtgagggggtataattttttgtttttggtttttttttagttaattttaggagaatgattttagtttaaggttgttatggttaattgaaataaattttgtttgagggattggttttattggttgggagggatagaggaggaagttattttagagttaggtaggggtttgagttttggttggttttaggtgtgtgttgtgtggttttgggtaagttattttttttttttgagttttaatttttttttataggttaagtttttgtttaggttttatgatttgagtggatttaggattttattttgttttttaataaggatagggataggatttttattttttttttaggtaggtgtgatagtttaaggattttttttttagttttaaatatgtttatttgtgtatgtttgtgtgtgtatttatatgtgtgtgtttgtgtgtatgtttatttgtatgtgtatttgttgtttatgtgtatttgtgtgtgtttatttgtatgtgtttgtgtatttgtgtgtatgattggttttttttttttttagtgttatgggtatgtaggtaatggaggttaggtgagggtggattttttttgttttagtgtttttaataggtagggtaggagtagttttggtatggtttggatattggtgtttgtttggaggttatagttagataatttgtttataataaatttatatttatatattagtaagatagtggggtgtgttgggtgttattttttatgtgtgagtgtttgtatgtgtgtgttgtttgtgtatttttttgtgtttgtgtatatgagtgtttatgtgtttatttatgtgtgtttgtgtttgtgtatttgtgtgtgtgtgtgtgtgtgtgtggttatgtgtgtttttatgtgtgtgtgtttggatatgtttgtatgtttatttgtatgtgtttgtgttttttggtatgtttatgtgtgtgtggttgtaggtttgtgtattagtgtgtttatgtgtgtatttgtgtgtgtgtgtgtatttgtatgtttatttgtgtatttttgtatgtgtgtttatttgtgtgtgtgtatttgtgtttatttgtatatttgtttgttatgtgtatgtgtgtgtgtgtatgtgtttatgtttttgtgttggtgtatgtatgtttatttgtgtgtatttatatgtattgtgtatgtttgtgtatgtgtatttgtgtatttgtgtaaatatgtgtgtttgtatatgtttatttgtgtatgtttgtgtgtgtatttatgtgtgtgtatgtttatttgtatgtgtatttgttgtttatgtgtatttgtgtgtgtttatttgtatgtgtttatttgtgtgtatgtttttgtgtgtgtttatttgtgtgtgtttgtgtatttgtgtatgtttttttgtgtgtgtttatttgtgtatgtttttatgtgtgtatgtgtgtttatttgtatgtgtttgtgtgtttatgtgtgtatgtttttgtgtgtgtgtgtttatttgtgtgtgtgtggatttgtggtttaagaatgttgtttgtgggtggaatttggtttatagatatgtttggtttggtatttatagtatttttaatattttgagttaatatttaaaaattaggatattttatataaaaatttagttttttaattttttttaaaaatttagaagttttggtagttttgggtttgtgtttttttgaggttatgttttttttgaattgtgtagggttgtttttttttgtgtattttttatagttttgtttatttgttttgtttagtagtgttttgaggatggttgagtttgtgaatttagtgtgtggttataattatgtgtgagtttggttgttagggaatatgtgtatgagtggggtgtgtgtgtatgtgtgtgaatgtgtgtgtgtatgtgtaaagtaattttgtgtatgaggtaaatttgagtgtgtgtggtgtgtgtgaatgtttgtatgtgtgtgtgtgtgtgtgaagagtttgtgtgggggaatatgtgtgtaaaggtatggatgtgtatgtgtgtgtgtaggggagtggttatatttgtggttgtgtggagtgtgtgggttatagtggattggtatgttttgtttaggggttttttttggtttttgagggggaattggatttttggtttttggttgggttgttttgtgggatttatttttgttttagtgtttattggagttttgagtaatgggaatatttaaagaaaattagtaaatagatatagaaggggtaggttggttgggaaatttagtttagatatttttgtttagtttatagttgttagagtttttgggggtaggtttgagtttagggagaaaggagttttagtatgtgatagtatttttttattttgtggggtgtttattgttatttatgtatgtttttattatttggatggatggtttttgggttaatattgggtattttgagagtttttttggttttgagtagtagatgtttaggagatttaggggatgttagtttaggtttggtttaggggttaagaggatttgattttttaggggtgtttttttttagttaggttataggtattttgtttatatatattttttgtatatgtagatgtatttatagtttaaggaggggagaggttgtgttgatttggtagggttgggtgggtatttgatattttatttggattttatatatttggtagtgttttggaattttatttgttaggatatggtttttgttgttttgggttttaggttgattggattttattttttggattgtttttgatgagtagttatttataaatgatataaattttataggaaaggataggtgtgtgttatgtggtggggtgatttgttttatagaagatttgttgttggtaggagttgtttggattaatgtgttttgttagggattttattggggattttttgttgttttttagtggttatgggaggatatggggaaataaaagttaatagttgtatggagttgtttatttgtgtttgagtggattttgagggttttatgtggtttttagttagatagttatggggaagtaaggttttttaattggtttgagggaaggggtttggattttagtatagatttggagattatttggaaggttagttttttgaaggtagaattattgttagttatagttgtatttttggatatagtgtttagtatgatatgggtttttgggaagtatgttatattaatggtttattttttaggtttttgggggtgggtagtgttgtagtaagttttgggtttagtttagagttttatggagaggttgtttgaaggtgagtgggtattttatatgttgaagtttttaaggtagtgaggggtttgggtttgaggttggatagtagtttttttttgtgattttaggggttgtgtttatttttgattttaagtttatagttttttattgtggttataaggttttgttttggttggtgatttgtttggtttttgattttgtaagtttaggtgggatt

SEQ ID NO: 52 - DNA, 8856 bp, Homo sapiens
tagtttgtttttgttgtttggtgtattaggttaaaagatttaggtttaatagatggaaaagatggtaggatgttttggttttgttttgatagttgtttttttgattttagatattttttattttttgtaatttgtgttttatataggaagtagtttttgttttttaaatatcgaaggtgtataaacgtaaagtttttatagatgagttatttagggttaatatttgtttaagtaaagatttaaatgttttgtagagatagtaaagtgttatgtttgttttagggaaagaaatttaggataggaaatgtttagttttttagtatttttttggttatttggagtttaggttatgagttttaatttttttttgaagtattagttttggagtagaggttgtgatttattttagagatttgggtaagtttttttaatttggtagttttgtttttttttgtttgtaaaatagagagatgaggttgatagtttttttatagttttattagaggtagtgtgtgaaattagtttttgtttgggaaggtttaaaagttattatattttatttttttgttaatatgattattaaaatgtttttatatgaaagggttaattttttattttttttttttttttaaaaatagattaaggggtatttttttttgtttttttgtggtttaaaaggttattgtttttgtggttatttttttggaaagatagagtgttaggatttttaggtatattaaaaatgaataaaaaaattaataataattataatattaataaaaataattgttgtgtcggtttttaagacggtttttgagttagaaatagatttttttaattgtaaaaaacgtggttttagtttgtttgtaggttatttttgtttttaggttttggggggaggagggaagtgagtttatttattggggtttattttagggttattattaaggtgttttataaaacgtattttaagaatgttttggaaggaaatttattttttaatagtttaagaggtatttttttttggtatatagttttgtatatagtttgttttttaacgtttggaaattttttaatagtttatggaaggttattttttaaatcgatttaatagtttttttttttataatttgattttagaggtgttttattatttttaattatttagggtaaatggtgattatttagtgttttaattattagtttgggtagtagttatattaaatttagggaagtttagatttttatgggtatttttggaaggtacggcgattagtcggtgtatgttttttagtattttcgtacgtggtttttaggtgagttttagtcgttttttagagttggaggtagcggcgttttagtttcgacggtagttgcggattcgggcgttgtttgggttttcgggattcgggtttgttaggcgaggtcgggcggttggaggggaggatgtgggcggggtttttatttttagaaagggaggcgagcgagggaggagggaaggagggaggggtcgtcggggaagaggaggaggaaggaaagaaagaaagcgagggagggaaagaggaggaaggaagatgcgagaaggtagaggaggagggagggagggaaggagcgcggagttcggttcggaagttaggtgagtgtggtattcgagttgagggacgcgagtttgagacgtcgttgttgtttcggttgagtatttagtttgttttttcgatgggattttcgtttaagttatttcgagtttgtagcgttatagttttcggttttcgtttaggtttattgtaatcgtttagaggtttttaggagttgttgttggcgagttcgttattgtagggatttatggtgagtaaggttatttggtgaggggagataggtagagggggtttaggagtttttttggggggaagaagttggttataggttgtgatcgaggtaaaaggtggtttaattattttttaatagtggtgttggaggtggggatgttggcgttgaaagatttttaaatatcggttattgtttttgtttaggttttttttgtttagtagtttttgggagatttttatttttgggaagtgcggggtaggagagtagaaataagagaagtttttggtaggggggtcgttgggaaaaattgtggggttttgggttgaacgcgttgtttacgggttggaggttgcgattttcggacggaaagcgcgggaggaggaaggagagaatcggttttgaggtttagagagagtgagggggtagagcgacggcgagatggggagagaatatttagttggagtaggttttgcggtagagagcgtagttttgttggtttttggagagtgcgcgtcgtttcggaggttgcgtcgaggggagtgttatttaatttggtttttagttggcggggcgttttgagagtttgcgaattgtagttgtaggacgcgttttttttacgagttattttcgtcgatttgcggaatttaaggaatttcgtttttattattttacggtgtagggtttttagagacgatagttaagattttaggggtttttaggacgtttgtttttgcggtgtcgtgttttatggggagtttttggcgggacgaaaggcggacgcgcggttttttttggttttttaggttcggaatcgacgggaaaggttttcgtgattttcgagtttttgtaggttttttttagcgggagttggttcgggggttttagaggtttttaagtattgttttggaggatggtttttaaggatcgcggtttgtgagttgaaggttttgtgagaggttaaatttttaaaagatatatatttggtaaattgaggttatttgtaaatatatttcggtattaggagaagattcgagtagggaagtgaaggataattatttcgagttatattttttttttttaataaaaagttttggggatgaaagtttttttggtttttattttttcgatttaaaaatttgagaagaaaaatgtgattagagatgaattttggtgaattcgaaattgaaatataattttttttttttttttttattttttcggttttagaatcgcgttttttcgttttaggagattttttggggtcgagggtttttcggggaattcgggcgttcgttttttttattgtttttttgtttcgcgggtatagtttgttttcgtttgttttttttatttttggattttttttcgtcgggttttttaaagggtttttgcgttttaaaataaaataaaaaaattttttgttttttttaattttttcgtagttcgttttagcggtggcgcgggattagtaaaggcgaaagtcgcgcggtttttgtcgggcgcggacggtcgcgtaggggcgttcgcggttttcgtattcggatttgaggtgttggtcgatttcgggtatttacggtcgggagggagggttgagttgttcgattttttattttttttttttaaagtttatttgttaatgtttttaagaagaaaattaagtatgtgcgtggagagtggggcggtaggtaattcgagtttttgagtttcggagcgatttaaagtagtaattgggaatagttttaggaaagggaggtcgggtggagtgggttttggggtaggagttatggggttcgggtttcggggacgatttggcgttttcggttttgttgaacgttgagttgcgtttagtcgggttttcgaagaggtttttgcgtagagcgatttacgcgcgcggtagtattttcgattagttaggatattttagtaattgtttgaattgtaggtaggtaaaatttttgaaggagtatttgttgcgtgcgattttgttgttggtgtaacggaggaagggggtgggggaaggaagtggcgggggaaggagtgtggtggtggtttaaaaaataagggaagtcgaggcgagagagacgtagacgtagaggtcgagcgtaggtcgaaagttgtttatcgttttttcgatttcggggaatatggtgggattttttttttgcgtcgggtcgggagttgtaaaatttcggttatattaagatttgaaaattgtgatgcgttttttttgtagcgacgtttttttttgaatttgttcggagtttcgagtttcggcgtttgttttttagtttggtatggttttttcgggggtttgttttgtatggggagaggggttacgtagcggcggattaggtttggggattttcggtaatggattcggagtaatgattaatagtcgtttttttttatttttttatagcgattattttttaatatttttttttttattttcggtttcgcgcgtgataaggtcggttgtttttagtcgggagttagatcggtggttcggtttttcggagttttagtaggcgttcgttaaggggtgattggttgttattgggagtaatatttggttttgaggagattttggggaggaagtggcggggagttcgtgtttgtttgtgtgtgtgtgggggggtgtgtgtgtatacgcgcgtgggtagggtttttttgcgtttttttttttaagtgtttttcggtggtgaggttttgggcgggtgagattttttcgatttcgttttcggttttatttaagtcgggttcgagttgggagacgtagtttttttagtgcgttttaaattttttggttttaggtggttcggcgcgggggtttagtacgacgtatcgcgtcgagaatcgggtttttcgtgcgttgcgttagtagttttgggagcgcggcggtcgcggggtatcggtcgagggttttgtcgagcgtcgtcgggagtttttttcggatcgttgaggttcgggcggcgggcgcggaggttggtttcgtttggaggggcgggttcgcgaggggcggggggttgtggaggaggggagggcgcgtaagttttttcgtcgtttgtcgcgggaggggtttcggcgtttacgtgatttcgaggggttggaagaaaaatagagtttgtttgcggtggagttttattatatttaaatattttttttaggagttatttcgtagtgttatttcgagtaacgtattgttgtagtttttttgagtttttttagtaagtttgtttaagattggttgttaagaattatggattgttattatatgttttgttttttgttagtgagtagatatttttttttttttttttttcggaatttattttgtttttattatttttgttcgtcggttgtttttttcgtcggattttttttataatatttatattttgttttttggtagtattgtcgttttttttttggttcggtagtcggggcgttggaagcgtacgggttttttttaaagtgttgttagcgcgtattcgtttttttagcgttgtaagaaaggggagcgcgagggagttaaagagatgaaagttcggggttgtattttgagggttaattattttttttttttatttaatttgtttgggagagtttttagtgttttcgtggcgcgtttttatttttttgttaaaatttatagaggttttttcggaatcgttttttattttttttttggggatgagcgggtacgattaggtatttttggttgaatattttaaatttatcggttataataaaataagtttttaagttattcggttagtttttagattattttttcggtttttggattttgtcgttttttgttttcgtttagtttttgttttttattttttttttttttggttttgaattaattggaagttgtgaaagttgggttttgagggtggaggaaaagggagagaagttgaaggtttaaagtggagagtaatgttattttaatttttttttttttatttttttttatttttttaatgttaattgtttattttttaagaagttacgttgagattatggtttagatagtagttaggataaaaaaagattaataggatggaggttatttgatttggggttatttgattgtaaataagttagattaagtaattatagggtaatttttatttttaggtcgtgtatggttgtagttggtgggtgggcgggtggtgtgagggagaagatataaatttgatttttttgatttgttttttattttgtttttttatttttagttttaaatgtatatgtagatatatttttatttttttttatttattggtgtttatttattttttaattttttatttttttttttttttttagagatattatgatttttggtaatcgaatgttgatggtcgttttattatgttaagttttgttaggaggcgcgagttatgttagtttgatatttgagacggggaagaaaaaagtcgtcgagatttagggttacgcgggaggacgtcgtttagggtagagttatgagtttttgcgggatttcgaggcgatatttttgtagatgtttgggttgcgtcgtcgttcgtagtttagtaagagtgtcgttatttcggattatatgcgggatttttatcggttttagtttggggaggaggaggaagagtagatttatagtattggttttgagtattttgagcgttcggttagtcgggttaatatcgtgaggagtttttattacgaaggttagtttttttttttagtttgcgtgggggagggttggtgggattggttagaggggtagtgaaagttttggggaagaagagttcgggttatattaaagttttagtttaggaggttgaggaatagagttgtttatttttaagaatttgtagagttgtcgtcgaatttattttttggagatagagggggaggtgtttaggggaaggggaatgatagtatttagacgtgggttagttttagcggtgtgtttttgttatattaaagttttttttgttaggttttttgttcgttttttttaaagtatttattgaatttaatattatagttgtgtgtttgtcgggtttatttaataggggttttgtaattcgatttgaatgttttttagcggatgttttttttttaaagtaaatttgagttattaatttattagtattattattgtgttggaatttatttttttttttgtaatatgattaataaggtatgttttgtgtttttaagatcgttggggaaatgtttagtaatatatttaatagtggaagagggagagggtggttgtttgtatgtttttttttgtttgtgttttgttggtttttttttttttttataattatttgtaaagaaaattgtggatataaagttaaggtggggggtttaaaagaggagtttgattgtggtgttatagaggagttgatatatagaaattattagatatattaaggaggttggatatagtttttgtttttggtgtttgagaaatgttagttatattttgttggtttgttagttgttttatttatttgtttttttaaattaaggggtatgtttatttttttttagtaggttttttttgtataagtagaatttattatttattgtttaattttgagttattttttgatttttttatttttgaaaaaagtttatatgttttttttttttttttttttttttaattgtgtttagaatatttggagaatattttagggattagtgaaaattttgtttttcgttttttttttaattttagtagtatttttgagaacgaggtgattttttttgtagagtttcggttttttcgggagtaggtggattagggttttgattgggaaaggggtttttatcgtataaatatttatgaggttatgaagtttttagtagaagtggtgtttgggtattttattatacgattattggatacgagattggtttattataatgtgatacggtgggaaatttttgatgtgagttttgcggtttttcgttggattcgggagaagtagttaaattatgggttagttattgaggtgatttatttttattagattcggatttattagggttagtatgttaggattagtcgatcgttattttaagggagtgggaattgggtttagtttcggttttttttggttatttttggttatgatggtcggggttatgttttgattcgacgtcggagggttaagcgtagttttaagtattatttatagcgggttaggaagaagaataagaattgtcggcgttattcgttttatgtggattttagcgatgtgggttggaatgattggattgtggttttattaggttattaggttttttattgttatggggattgtttttttttattggttgattattttaatttaattaattatgttattgtgtagattttggttaattttgttaattttagtatttttaaagtttgttgtgtgtttattgaattgagtgttatttttatgttgtatttggatgagtatgataaggtggtattgaaaaattattaggagatggtagtagagggatgtgggtgtcgttgagattaggtagtttttgaggatagatagatatatatattatatatatatattatatatattatatatatacgtttttatttatttatttatatattatatagattgtttttttatagttggatttttatttaaaaaaaaaaaaaaaaaaggaaaaaatttttaaatatttattttgattttatttatgattttacgtgtaaatgttttgattatattgattatatattttgataaaatatatttataattacgtattaaaagaaaaaaataaaatgagttattattttaaaggtaaattatgattttttttttttttttaatttttttttttttttttcgggtttattttttttgaatgaggtttttttttgtttaggtgagttggaggttggatggaagttaaaaggtggtatttggaggtggttaagttgtagggataggaagtaaattgttggtagagagagatggtaattgttagtatgaattgtttttt

SEQ ID NO: 53 - DNA, 8856 bp, Homo sapiens
tagtttgtttttgttgtttggtgtattaggttaaaagatttaggtttaatagatggaaaagatggtaggatgttttggttttgttttgatagttgtttttttgattttagatattttttattttttgtaatttgtgttttatataggaagtagtttttgttttttaaatattgaaggtgtataaatgtaaagtttttatagatgagttatttagggttaatatttgtttaagtaaagatttaaatgttttgtagagatagtaaagtgttatgtttgttttagggaaagaaatttaggataggaaatgtttagttttttagtatttttttggttatttggagtttaggttatgagttttaatttttttttgaagtattagttttggagtagaggttgtgatttattttagagatttgggtaagtttttttaatttggtagttttgtttttttttgtttgtaaaatagagagatgaggttgatagtttttttatagttttattagaggtagtgtgtgaaattagtttttgtttgggaaggtttaaaagttattatattttatttttttgttaatatgattattaaaatgtttttatatgaaagggttaattttttattttttttttttttttaaaaatagattaaggggtatttttttttgtttttttgtggtttaaaaggttattgtttttgtggttatttttttggaaagatagagtgttaggatttttaggtatattaaaaatgaataaaaaaattaataataattataatattaataaaaataattgttgtgttggtttttaagatggtttttgagttagaaatagatttttttaattgtaaaaaatgtggttttagtttgtttgtaggttatttttgtttttaggttttggggggaggagggaagtgagtttatttattggggtttattttagggttattattaaggtgttttataaaatgtattttaagaatgttttggaaggaaatttattttttaatagtttaagaggtatttttttttggtatatagttttgtatatagtttgttttttaatgtttggaaattttttaatagtttatggaaggttattttttaaattgatttaatagtttttttttttataatttgattttagaggtgttttattatttttaattatttagggtaaatggtgattatttagtgttttaattattagtttgggtagtagttatattaaatttagggaagtttagatttttatgggtatttttggaaggtatggtgattagttggtgtatgttttttagtatttttgtatgtggtttttaggtgagttttagttgttttttagagttggaggtagtggtgttttagttttgatggtagttgtggatttgggtgttgtttgggtttttgggatttgggtttgttaggtgaggttgggtggttggaggggaggatgtgggtggggtttttatttttagaaagggaggtgagtgagggaggagggaaggagggaggggttgttggggaagaggaggaggaaggaaagaaagaaagtgagggagggaaagaggaggaaggaagatgtgagaaggtagaggaggagggagggagggaaggagtgtggagtttggtttggaagttaggtgagtgtggtatttgagttgagggatgtgagtttgagatgttgttgttgttttggttgagtatttagtttgtttttttgatgggatttttgtttaagttattttgagtttgtagtgttatagtttttggtttttgtttaggtttattgtaattgtttagaggtttttaggagttgttgttggtgagtttgttattgtagggatttatggtgagtaaggttatttggtgaggggagataggtagagggggtttaggagtttttttggggggaagaagttggttataggttgtgattgaggtaaaaggtggtttaattattttttaatagtggtgttggaggtggggatgttggtgttgaaagatttttaaatattggttattgtttttgtttaggttttttttgtttagtagtttttgggagatttttatttttgggaagtgtggggtaggagagtagaaataagagaagtttttggtaggggggttgttgggaaaaattgtggggttttgggttgaatgtgttgtttatgggttggaggttgtgatttttggatggaaagtgtgggaggaggaaggagagaattggttttgaggtttagagagagtgagggggtagagtgatggtgagatggggagagaatatttagttggagtaggttttgtggtagagagtgtagttttgttggtttttggagagtgtgtgttgttttggaggttgtgttgaggggagtgttatttaatttggtttttagttggtggggtgttttgagagtttgtgaattgtagttgtaggatgtgttttttttatgagttatttttgttgatttgtggaatttaaggaattttgtttttattattttatggtgtagggtttttagagatgatagttaagattttaggggtttttaggatgtttgtttttgtggtgttgtgttttatggggagtttttggtgggatgaaaggtggatgtgtggttttttttggttttttaggtttggaattgatgggaaaggtttttgtgatttttgagtttttgtaggttttttttagtgggagttggtttgggggttttagaggtttttaagtattgttttggaggatggtttttaaggattgtggtttgtgagttgaaggttttgtgagaggttaaatttttaaaagatatatatttggtaaattgaggttatttgtaaatatattttggtattaggagaagatttgagtagggaagtgaaggataattattttgagttatattttttttttttaataaaaagttttggggatgaaagtttttttggtttttatttttttgatttaaaaatttgagaagaaaaatgtgattagagatgaattttggtgaatttgaaattgaaatataattttttttttttttttttatttttttggttttagaattgtgtttttttgttttaggagattttttggggttgagggttttttggggaatttgggtgtttgttttttttattgtttttttgttttgtgggtatagtttgtttttgtttgttttttttatttttggatttttttttgttgggttttttaaagggtttttgtgttttaaaataaaataaaaaaattttttgttttttttaatttttttgtagtttgttttagtggtggtgtgggattagtaaaggtgaaagttgtgtggtttttgttgggtgtggatggttgtgtaggggtgtttgtggtttttgtatttggatttgaggtgttggttgattttgggtatttatggttgggagggagggttgagttgtttgattttttattttttttttttaaagtttatttgttaatgtttttaagaagaaaattaagtatgtgtgtggagagtggggtggtaggtaatttgagtttttgagttttggagtgatttaaagtagtaattgggaatagttttaggaaagggaggttgggtggagtgggttttggggtaggagttatggggtttgggttttggggatgatttggtgtttttggttttgttgaatgttgagttgtgtttagttgggtttttgaagaggtttttgtgtagagtgatttatgtgtgtggtagtatttttgattagttaggatattttagtaattgtttgaattgtaggtaggtaaaatttttgaaggagtatttgttgtgtgtgattttgttgttggtgtaatggaggaagggggtgggggaaggaagtggtgggggaaggagtgtggtggtggtttaaaaaataagggaagttgaggtgagagagatgtagatgtagaggttgagtgtaggttgaaagttgtttattgtttttttgattttggggaatatggtgggattttttttttgtgttgggttgggagttgtaaaattttggttatattaagatttgaaaattgtgatgtgttttttttgtagtgatgtttttttttgaatttgtttggagttttgagttttggtgtttgttttttagtttggtatggtttttttgggggtttgttttgtatggggagaggggttatgtagtggtggattaggtttggggatttttggtaatggatttggagtaatgattaatagttgtttttttttatttttttatagtgattattttttaatatttttttttttatttttggttttgtgtgtgataaggttggttgtttttagttgggagttagattggtggtttggttttttggagttttagtaggtgtttgttaaggggtgattggttgttattgggagtaatatttggttttgaggagattttggggaggaagtggtggggagtttgtgtttgtttgtgtgtgtgtgggggggtgtgtgtgtatatgtgtgtgggtagggtttttttgtgtttttttttttaagtgttttttggtggtgaggttttgggtgggtgagatttttttgattttgtttttggttttatttaagttgggtttgagttgggagatgtagtttttttagtgtgttttaaattttttggttttaggtggtttggtgtgggggtttagtatgatgtattgtgttgagaattgggttttttgtgtgttgtgttagtagttttgggagtgtggtggttgtggggtattggttgagggttttgttgagtgttgttgggagttttttttggattgttgaggtttgggtggtgggtgtggaggttggttttgtttggaggggtgggtttgtgaggggtggggggttgtggaggaggggagggtgtgtaagtttttttgttgtttgttgtgggaggggttttggtgtttatgtgattttgaggggttggaagaaaaatagagtttgtttgtggtggagttttattatatttaaatattttttttaggagttattttgtagtgttattttgagtaatgtattgttgtagtttttttgagtttttttagtaagtttgtttaagattggttgttaagaattatggattgttattatatgttttgttttttgttagtgagtagatattttttttttttttttttttggaatttattttgtttttattatttttgtttgttggttgttttttttgttggattttttttataatatttatattttgttttttggtagtattgttgttttttttttggtttggtagttggggtgttggaagtgtatgggttttttttaaagtgttgttagtgtgtatttgtttttttagtgttgtaagaaaggggagtgtgagggagttaaagagatgaaagtttggggttgtattttgagggttaattattttttttttttatttaatttgtttgggagagtttttagtgtttttgtggtgtgtttttatttttttgttaaaatttatagaggtttttttggaattgttttttattttttttttggggatgagtgggtatgattaggtatttttggttgaatattttaaatttattggttataataaaataagtttttaagttatttggttagtttttagattatttttttggtttttggattttgttgttttttgtttttgtttagtttttgttttttattttttttttttttggttttgaattaattggaagttgtgaaagttgggttttgagggtggaggaaaagggagagaagttgaaggtttaaagtggagagtaatgttattttaatttttttttttttatttttttttatttttttaatgttaattgtttattttttaagaagttatgttgagattatggtttagatagtagttaggataaaaaaagattaataggatggaggttatttgatttggggttatttgattgtaaataagttagattaagtaattatagggtaatttttatttttaggttgtgtatggttgtagttggtgggtgggtgggtggtgtgagggagaagatataaatttgatttttttgatttgttttttattttgtttttttatttttagttttaaatgtatatgtagatatatttttatttttttttatttattggtgtttatttattttttaattttttatttttttttttttttttagagatattatgatttttggtaattgaatgttgatggttgttttattatgttaagttttgttaggaggtgtgagttatgttagtttgatatttgagatggggaagaaaaaagttgttgagatttagggttatgtgggaggatgttgtttagggtagagttatgagtttttgtgggattttgaggtgatatttttgtagatgtttgggttgtgttgttgtttgtagtttagtaagagtgttgttattttggattatatgtgggatttttattggttttagtttggggaggaggaggaagagtagatttatagtattggttttgagtattttgagtgtttggttagttgggttaatattgtgaggagtttttattatgaaggttagtttttttttttagtttgtgtgggggagggttggtgggattggttagaggggtagtgaaagttttggggaagaagagtttgggttatattaaagttttagtttaggaggttgaggaatagagttgtttatttttaagaatttgtagagttgttgttgaatttattttttggagatagagggggaggtgtttaggggaaggggaatgatagtatttagatgtgggttagttttagtggtgtgtttttgttatattaaagttttttttgttaggttttttgtttgttttttttaaagtatttattgaatttaatattatagttgtgtgtttgttgggtttatttaataggggttttgtaatttgatttgaatgttttttagtggatgttttttttttaaagtaaatttgagttattaatttattagtattattattgtgttggaatttatttttttttttgtaatatgattaataaggtatgttttgtgtttttaagattgttggggaaatgtttagtaatatatttaatagtggaagagggagagggtggttgtttgtatgtttttttttgtttgtgttttgttggtttttttttttttttataattatttgtaaagaaaattgtggatataaagttaaggtggggggtttaaaagaggagtttgattgtggtgttatagaggagttgatatatagaaattattagatatattaaggaggttggatatagtttttgtttttggtgtttgagaaatgttagttatattttgttggtttgttagttgttttatttatttgtttttttaaattaaggggtatgtttatttttttttagtaggttttttttgtataagtagaatttattatttattgtttaattttgagttattttttgatttttttatttttgaaaaaagtttatatgttttttttttttttttttttttttaattgtgtttagaatatttggagaatattttagggattagtgaaaattttgttttttgttttttttttaattttagtagtatttttgagaatgaggtgattttttttgtagagttttggtttttttgggagtaggtggattagggttttgattgggaaaggggtttttattgtataaatatttatgaggttatgaagtttttagtagaagtggtgtttgggtattttattatatgattattggatatgagattggtttattataatgtgatatggtgggaaatttttgatgtgagttttgtggttttttgttggatttgggagaagtagttaaattatgggttagttattgaggtgatttatttttattagatttggatttattagggttagtatgttaggattagttgattgttattttaagggagtgggaattgggtttagttttggttttttttggttatttttggttatgatggttggggttatgttttgatttgatgttggagggttaagtgtagttttaagtattatttatagtgggttaggaagaagaataagaattgttggtgttatttgttttatgtggattttagtgatgtgggttggaatgattggattgtggttttattaggttattaggttttttattgttatggggattgtttttttttattggttgattattttaatttaattaattatgttattgtgtagattttggttaattttgttaattttagtatttttaaagtttgttgtgtgtttattgaattgagtgttatttttatgttgtatttggatgagtatgataaggtggtattgaaaaattattaggagatggtagtagagggatgtgggtgttgttgagattaggtagtttttgaggatagatagatatatatattatatatatatattatatatattatatatatatgtttttatttatttatttatatattatatagattgtttttttatagttggatttttatttaaaaaaaaaaaaaaaaaaggaaaaaatttttaaatatttattttgattttatttatgattttatgtgtaaatgttttgattatattgattatatattttgataaaatatatttataattatgtattaaaagaaaaaaataaaatgagttattattttaaaggtaaattatgattttttttttttttttaattttttttttttttttttgggtttattttttttgaatgaggtttttttttgtttaggtgagttggaggttggatggaagttaaaaggtggtatttggaggtggttaagttgtagggataggaagtaaattgttggtagagagagatggtaattgttagtatgaattgtttttt

SEQ ID NO: 54 - DNA, 260116 bp, Homo sapiens
ttttaatttttttatgtggaattaagagcgtgttgttttattatttttgttttaaaagtgtaatttaaatgaattgaaatatttttatgttttaaagaggttaaagagtatagtttattagaatgaattaggattaagaggtatattgtaatttagatatttttatgaaagaggtaaaaattattgattatttggtttgaattattttttgatttagaatttggagtaggttttcgatgttagaaattgtcggattttttttaaaatatttaattaataattaaaaattttttttttttttggaatttgtttaaatgtttttttttgtaaagttggttatttgaagagatatttgtagacgtggttttaaaaagtaatgtgatatttgttttatatgatagatatagttgtaaattgagatttttatatcgtttgatattaaacgtttagtagggatttgggaaaagtattatgttatgggtatttttttcggtttttttttttgtttgtgtagagttttattggtttgttaaattttgagatttttttttttgttagaaaatttgtggagaagtgttatttatattttgaattttttaaagttttaggttttttttagatgataggtgaagtggatttttgaaagttttttttttttttttattattttggaaagttgatggttttgttgttttttttagggtatttttggtcgaagagagttgaagtaatgagaagatattatggaggtttagttttatagttttacgattattgaaaagaaaaaagttgagaattttatagtgaagtgttttattcgaatagatgtgagcgagaaagtcgttgtttttagtattatttttaatggtgagtagtatagggattattagtagtttagtttggagttatttttgtgttttttgtattttttgtgaattgagcgtttgtatttggattagtgtttgttttaggagacgttaaagaaagtaaatggagtaggggcggggggacggcggggggatatggaatgtagtaatttttattttggtatttaatttatacgttgatttttaaattttttaatttgagatgtaaatgtgataggttatttattattagaagtttttgttttggtattttggaaattattttgattagtttggtaagagtttaaaatgttttgtgttgtatatggattatttatattattcggaataattagtataaaagatataaaagttgttttgttaaaattagtgataggatagtagttttttttaattttaattttaagtagtttattttaaaggattttaagaattgttaatgattgaattttaaggtaatgttagtatttgagatgtaggttttgttgttagtttataaaaatttaatttatttatttgtgtttagagataatatagagttattgtttttgtattttgtgtttttaaagtttaagtaaagtgttgagaggtattttagtttaagtatggagtgttgaaaataaattttagagtatttttggtataaatagattgaatatgttaatggtaatttttattttttgtttttgttgtttttttattgtgggttattaatgttttttttttttgtagattttatagttatttttggtttttttgaatttttttgtttttttatgggtttttaggaagaatgagttggttcgtttttttcgtttttggatattgtttatttgggtatattgatttgtatgagttaatttgttatttttatattttttatattttaagataggttttatttgattgatttataagtttttatatttatttagagagttagaattttttttggaaggtaattgtagtttagaatattagattttaagggtatatatttttaagtagtttggttatttttttttgggtttttttatgtttgttgagagtttgtgttttttatttgtatttttttattcggttttatgagtgtgttttgttgattgtattgggtagggaaggagttggtttttaaatttgttggtaaatgattttagttttaaattgattttgagggagatatatttacgtttgagttaaaataatgaatttatatatatgtgaaaatatttttttttttattgatggtatttaaagttaagattggagtttattttaattgagttagaatatttgtattttttatttaatgtggttatagaaggtatttttttttagaaatatgttattttggttttttttttttggaattggtaaaatttaggtaaatttattattttagaaatagaattagtatatgtagtgttggttatttggtaatttttatggtaattttgtcggaataaatgttttttatgtatttggttttaggaatattagtttttggttatttttatagtttgcgtgagtgtatatgtttgtgtgtgagggtgtgagtgagtgtgagtgtgtgaggatatgtgtgagtgtaggtaaatgtatgcgtgagtgtgtaggtgtgtgggtgtgggtggtagaggtaattatgagtgtgtatgcgtgtgagtatgtatatgtgtgaatgtgagaataggtaagaataagtgtatggtagaagatgttgttgtattgtatggagtttgtagaagcgtttgttttgtttgttaattttagttgtatggttatagagttttatttttatgaagatgttgttgtttgtgttattattatatttggatatatttttaggaggttttttattgtagttgtatttgttttgagttggttttggatttcgggttttttttatgattttgttgagggtgattgggaatagaattaatttgattagttttataataattagaaagttacgagataaaattagttagagaaggagtagttatgatttataaatgtttgtgttgtagtgttaaataattatttgtttttttaattatatttttttggttttttgttttgattagtttgtgtttttgagtttatatttttttttaaatgtgtatgaattttgttttgtttggggatcgatattgattggttaaatttgtagggtatatgtttgagtgatagttgttttagaaatttggcgaattttggttagttttttagtgtttttgttttttttaagagatttattgttttatattttgggataaaaattaaataaaagaaaaatggaagtggtgtttttaaatatggattgtaagtcgataggtagatttttggaaaataaataaatttaaagagaggaataagtaaaagaaaggataataaattttttttttgtgtatgtgatgttaataattattatggttttttttatagagttttttatagtttttatttaattagtttagagtttttttatagttttaggattatgttgaggggcgtggattgttggaagcgtagaggtttttttttttgtaatttggttatttgttgtttttgtatttagttttgattatagggattggtgtgtgggttttggatttggttttgtttgggtttagagttcgtggggtgtaggatttttaagttgggatattattcgtgtgttggttggtggttgatatcgttatggttttttatttttttgtttatttatttgtttttttgtttttttttttattttttttttttttttttatgaatattttataaatgtttggatttttgtattgacgttattcgtagaaaggaaaatagaattatatggatgttataataggtagtttgattgttattgtttttagaaaggtttttgtgttttttttaataaagttttgaattatatttatttataattgaataattaaaaatgagtttagtttcggttaggttcggtggtttatatttgtaattttagtattttggtaggtcgaggcgggcggattattaggttaggagatcgagattattttggttaacgcggtgaaatttcgtttttattaaaaatataaaaaattagttgggcgtgtggcgggtgtttgtagttttagttattcgggaggttgaggtaggagaatggcgtgaattcgggaggtggagtttatagtgagttaagatcgtgttattgtattttagtttgggcgatagaacgagattttgttttaaaaaaaaaaaaaaaaaagagtttagttttaaaaattaaatgaatgtgatatttgtatttttttttttatttattattttatgattaaaattatataaatgaataaaaagttttgttattggttgagttattggtgaggttgttttaattaatttttttagttattttgtggtgtaatttgttttttattgtgagttttttagttaaattatttatattttattgtatgtttttgtagatttgttttcgtattttttttagttgagtatttgtttttggaataatatgcgtatagagttttgtttaaatatacgtagatttataattaaaaggtatagtttagaaaatttgaatagttttttaaagaagtatttgttatttaatattgaaatttaaaataatgtaagtgaaaaattgtgttgtagattttgtatgataaaaaaaaaaggtaagttaaatttgatttttgtaatatttaggaatttatattaatatataaagtttttggtaatttttatgtaggaagtatagtgtattcgtagttttatgtgtttatagtttgattttaaattttattgttatatttgaagtgtaaatgacgaaggagatgatatttagttttttgaattatttaaatgtaattgtggtttaagtgattatttgtggtattttatatattggtttttttatagaaagtatgtatgtagattttaggtataattgttgattttaaaatgtttaagtttattaatgtgtgaagattgtaagtaaaatgttttaataatttttttttgatgtagatgtattattttataagttatatgttgtgttttttaaataataagagttttttttatttaaattttttaatgttttatatgtttttatttttttataaaattttttttaataatttgtaaatattgattttttaatttgaagtgttttgttttatttttggtttatgatttcgttttaaaggagtaattcgatagtttttattaatttgtaattcggttttaaaaaagaaattaatgataaacgtatgtaggttgtggttttggggattttttattagatttgatagttattgggaatatattttaaagtgatagaaagtagaaattattattttaacgttgatgtaatgtgaaattaaagttgatagattaatgatgtaaaggaagttttttgtttattttgatttttttaaaaataagaatttggttttttgtttaaaaaattattttttttaaggttggtaaggggaaagtgttatggtttgtaaatttttaaggagttgtttttttttttgttttaatttttggttattttttggttttgtaatttgtttttaaattgtttattgtatgggtgttgttaggttggtgtaaaagtaattgcggtttttgtttttaaaagtaatgataaaaatcgtaattatttttgtattaattattgattgtgatgtttgttggttttttagttgggagttagatggttttgagttttgttggaagtttgaaatttatttgttattttttattataagtttttgtttttttgatttttttttaatggtaagagtatatgtgttagttttgttttgaaatgggtaggtagtttacgttataaagaatataggttgtgagttttcggttttttgtttttatagaggtttaattttttttttttgttatattttattttttggtatatgatagatacgtggaaaggatgtttagataaaatggattttagattataggatgtttatttgtagtatatataggttttgggatttgaaagtttggtttgagttttggtaatacgaaggattagttatgtgagtgtgagtagattaattttttagcgttttagtttttttattagtttcggaagataatagtaagatttattttatattttataggttgtcgtattataaatatataggaaggattttgtaaacgttagtttttgttattaggataaagtatgttggtgagttaaacgttatgaatttaaaataaaaagattttgtttttttgaatatatacgttagtttttaaattaagggaaatatgtttgttaaaagtaatggtgaatttgttggatttagatgtttgaaaaatagtttaagatgttttataaattttaaatgtgattaagtttgtatattttaaggagggatggattaaaaaaaataaagtttttgtaaatttttttgtaaatgtttttttaaatcggaaaatagggaagataattttgggaaaatttattttagtttttttaattttgaaagttagtgttgtattgattatatgttattgtattagaagtagtatatatatatttttttttttgattttttttttgggttgaattggtggtttgtgttgtattcgaattagattttattttttatagagagtttttatgtttttaaattaattaattgatgataaatattttgattttaataagagtttcgatttttttgagttttaaatttatatgttttgaattttggttattattgtgttttttattttggttaagtatattattttttttgtggttagttaggtttgaaatcgtattattatttttgattttttttttttttttgtttttatgttttatcggttttgaggttttgttagatttttttttgtaattattcgttcgtgtgtttttttaggttaatttattgtattgtgtggtgaaaatttttatattttatgtttagatgattaaaatgattttttgtttaattattttgttttttatttttatttttgttacgtatgggatttgtttttgttaaattaggtttattatagttttgtttatgttataattttgttttaaaagttttagtgatttttagttatttgtagaataaagtttaaagtttttgatttaatatttagatattttttaaaatttggttttagtttgatagtttaatttgatatgtttagaagtagatatgttattattttatcgtataatttatgttttagttaaatgtaagggtttttggttttttgtttatagaaatgttttgttaatattaatgtatgtttaaatttttaaatgtgaatatgtttttagtttttttttttttttataaggttttgtgttttttggggaattagtttataatattagatttttttatttttaaaattattattattttaagtaatagattttatgttttagagaggttttaggtttatagaaaaattgagtagaagatatagagagtttttatatatttcgttatatatattttttttttttattaatattttatattaatgtggtatatttgttataattgatgaattaatattgatgtattgttattaattttttattatttatatgggggtttattttgttgtatagttgtatgggttttgataaatgtatgttatatatttattattgtagtatgttatagaatattttgaatgttttaaagattttttatgttttattagtttattttgtttttttttttatagtatttaagttttatattttagttaaattttttgagagtagtatttggtttttttattttattcgttttttgtttatatttagtgtgtttgttgagagggttttagtagatattgaataaatttgtaaattataatattttgagataggagggtaggggatatgtgtaatagtattagtgttgtgtagttagaagttagggtttgagttttatttttattacgtaattgttgtgtgattatgggttaagtatttaatttgtttgattttggtatagagagtatttaaatatgttagttattgatagtaatagtaatatgatttttatgggtataatttgttaggattaaatttattgatgtattttattttattttttttagtataatattagttgttagtattttttgaatggttcggttttagtttgattgaggattggttaattgaggattgaggattgaaggattggttaataggagatttttatatgaggttggttattaggttttagtttaataggttagagttagggaataatattttaaattattggttttgaaattggtataagttgggattttagttattggatttttttttaaaaagaataatttttgggataaatgaatattagataaattaggaataaatattatttttattttttaaatttaagagtaaaaagaagttatagtatgatgttttgtttggatgggatgtttttgggttgtttttgattatatgtgattatggggtgtgaatattttaaatttttagaaataagttgtttagaattagaaataattattaaatagtggatgtttaagcggcgaaatggtgatgatgggaggaaaatttttttttggagaggtagttggtggttttttattattttttgttttgatttttaaggtcgaggagggtttgtttttttaggtagttttggggagattgggtgatagtaaaagtaaaaaattttttgttattttgtttatatagaaacgtttttagatatgtttgttttagtttattatttggtaaaatttatatatagtaagatttattttttgtggtgtgtcgttttatgagttttgaaaattcgtaagtttatatagttgttattattatcgagatatagaacggttttagtatttttttaaaattttgattattatttgtgttttaaatttagtttagtaacgtatatggtgtgagtttttagtaatgatagaaagtataggaattttagtagttgtttgatgttgtgtttattttatattaaaaataaataaataaataaaaaatttgttttttttgggttttgttagtaaaatttagtgttagttttttttttttatttaaatattttatgtcgaatttgtagtagaacgaaaatttttttgaaaattgtttagaaatttataatttaaagtatttgttattttgaatttttttttttttttttttttagtatttagtgaatgtatattttaggttaatttaaaatttcgttttatgtttaaaattataagatagttatattaaagggtttttagttattgtttttgttattttaaattaattatatgagaaaattagaatttgaatatttaatgtagttataatttaaagggaaaatagtaaatgttttgttattttttttttgttttttttttttttttttgaagtatttttttttttttttttttatttatatagattggattttgttttaggtagatagaatttttgtattaaagttatttttagtgtaatttaggttgttattttttttttttttgtttgttttttttttttttttttcgatttttttttttttttggtttttttttttttgttttttttttttttttttagttgtagaaagttgagttttattttaattattaaattttaggagattatttttatatggtttcgtaaatggtagttttatttcgtatttttttatttttttttttgttttttggtttgatagttgaaaaggtttgattgtgttatataatggtttgattggtttttttgggggagatttttttttgttttattattcgttaggtaggtggattagaaagttttttgatttttttgtttttttttaaagttcgaggtttttgattgaataaatttgtcgttatgggataatttgttaaaacgagattgaaagatgtgagagaaaagttttattatttgggtgttgtattaatgaaataacggggttttggagtttgtaattgaaaaattattaggaatgtaatgggtggagacgggttttttttattttttataataaatttttagttttattatttaaagtatgtttgtttttttgttcgtttgtaggttcgagtgtgtttgtatttgtatttatgtttaagggtttttggggatagttttgttcggttgaaagtcgtttgggtgttgtgtttagttagttattagattattattagtgggtggaaagaattttatatgatataattaaggttgagttaatataggacgaaaagtaatttatagataggttgtttttagttatttttgtagtttttgataaggttttattttagaatggataggcgatatttttatttacgggtttattttgcgatatttgtgataatagtttttggattttaattgaaattggttttaaaatggatttttatttttttttgtttgtggaaaatattgaatggatttagagttgttatagagaattttagattttggaaaatggagtagaaagttaggattattttttataatagtgtcgatgatatgatagttttgttatttgttttattaatgaaattattgattatttgatgagggagataataaattatattttattattagttacgaaatttaattagattgttattataaatagggagggggagaaaataattatggaataaatgtagaaaaggttaattaaaattttttattttcgaagtgattattttagaggagaatatgttgagtgattgtagtgtaagtattttgaaattgtagtggttagtattatatttaaggattttttttttggttaatgtagagtagttggtagttttattaagtaaaattttattttttaaatattatttgttttattatgtaaaatttagaagtagaaggggaagttttgttttgtttaagcgtattataatggggaaaatgggagaaaaaaatttatagattttttttttttttatatggtgacgggatttggggttagttttaggtaggtatgttgggtaaggaagaataaattgaaaggttcgtaatttaggttttttgaaagaaaagtagtttattattttttttttttttaaagtgttttaggaattttaggaagatgagacgggaattaggtttggatttaatgaggtggttttattgtttggtgttgggttgttttggaatgcgttttttgttttttttgaaggaagggaagagatgttgatgattttttatgttttatagtgaattgtatttttaggtgtttttttattttttgtgttagtaaggattaatttattttatttgagtttgaaagaggagttgtgattaaaggcgttaatgatgttattgatttttgttgattgattaggagtagaagttttggagaattcggtttttttttataattttaaatttattagcgtttattaggattgttagtttttaattcgtaaaattagaaaaatgaatgatatagataataattgtgtttttttttatttatgattgttttttaagtttattggaattatggttatattttataagtaattttttttttttaaatatattgtaaagaaatggagttttttttataaattgggttaaatattttggaatttgatatataaattgggaaaaatatgtgggtgtgaagatatttatattgtttttaaagtagtttaattatatatagattatatgttagataattttaaaatatatttaagtgttttattaatttggatatttaggagttttttatgtagattttaaaattttttgagttatttttgtggaattatttaatattttttttttgttatttaagaggatgagttatttttgtgtgtatatttatttttaaaaataaaaataaatgtattttatgttaagagatgatagttttataattgggaaagacgtaattggaaaggaaaaaataaaaagtaagagggagagagaaagagcgagatgtttttttttggaattgtttacgattgtaattattggtttatatttatttagagtagggattaattgtaaaagtattgggaaaaattttgttttggaaggtattgtagtttaagaaagaaaagttgaatggaaaatggagaatgtaaattattattaaggttattattattttattggtttgttgttggttttttaggatttttgttttatgtttgtttatggttaattttttttatagtaaatttattttgaggattgttttgagtagaattgataaatgtgtttgtggttaagggtgggtataataaagagaagagatggtgtaaatgaatttttgggaggatatggcgtggtagttatgaatattaggtttagttaatgtcgaagattttttttttatagaatattttttgttttagtggtaatgataagaaaaataatttgagatttttatttataattaaaagagaatttttagaaagatttagaataatggtatggttgaaataatggaatttatattaatgtaaatattttttggtaaaatatgaagttaatatataattgaagatttgttttaagtatttaaaaattagaaaatatacgttggtttattttatattaagtttaaatttaattttttttaaaatattaatgtttttaggtttgtttttaaattttggtaagtttgagagtagtagaaaagttttttttttataaacgttgatagtagtttttgtgtaggttaataatgttttataaatagagtttatttagtaaaaattatgtgtatgtttagtgaaataattttatatttatttattttttgatttatagaaaatatgtgttttttgataaagtttttcggttttttttcgtaattaaaaagaattatgtttgaaaaaaatagttatcgttttaatgggaaatttttttatataaatttaaagtattttttttgattagtttcgtataaaattagaatatttttatttatttgtttggtttaaaaaattggatgatttagggaaaaataaaagatatttataaattttttagttgtttgtttatatgtgtatttatatatatatatattagtatatatattggttgaatattggggaatttaaggattaaataggttggtgtagtgttatagtagaaaaattttttttgttgtttgtttttgttagtgattagtgttggtttagtataaggtagtttgttggtttttttagattgaagaggaaatatggttttatacgtatttattgttaggtttttatttggatatatgtaaagtatttttgttttgattttttttaataataatagattgtaaggagagagagagataagataatttgtaaattttttgttatttttttttttttgaaaaaaaaagatatgatttttaaaaagtatgttttattttcgtttattatttttttaaaaagtttagagttgcgagttaggggtagaagagaaaaatttttttttaataaagaagtgataatattagttgggattaggttataaaatattgttgagttattattttagattagatttttggtatttatattgttttgggggtagggaggttggtggtggggagaaagtgagtttttattaaatatagaaattttataatattggggtatattaataatataagtataagttttataggtaaacgttagtataattttgtattttattttaatttggggggggggggggggtttttatttttgaatagaagtgagggattatatgtgtttaaaaataagagtataatttttatagaaatttttttttgtggtgataatgttagtttttaagttttaggaaagtttagtttttattttcgtaaataaatattattgattatagtgataacgatttgaagtttaatatgaaatttaagggaaatgaattatgttcgatagcggggcgtttttattagtaattttaaaatttttgattttgatggagaggtatttgagaatgggtgaatttttttggaattattttatatggtattttatggatatgggtttatgttttttttttttttttttttttttttttttttagatttttaaagagatgtatgatttagtatttgttagaggtttttttttatagggagtatttggagttttaatttttatttggaaaatttaggttaaatgattagaattttttttggaggaatgatgatttgtaagagtaagattgttttaaaaaaaaaaaaaaagagagagaattttttagtgattaggaaacgtggagttgagttttttttatatataatatgatgtgattatatagttgtagtttagttaattttgtagttggttgtatattaagaatttaaaagattttgtttgtatattattttatttgtgaaaacgaaggatttgggttatatgatttaaagagtttttttttttttgatatttttgatatttaagtttttatgataggggttttaatttttataggaattttgtagaatgttaaatgaaaggaaagatgttttataaataaggggagttggagaagaatgagttaatataatttaagtttagaataggaaatttagaattttttttaaattaagttgtgtatattatatgtatgggtttattttgggttaaaagttattgaagattttgtttaggttaaaatgtattattatattgttgagttaaatattattttagagattaggtatggtggtttatatttgtaattttagtattttgggaggttaaggaaggaggattgtttgaggttaggagtttgaggttagtttgggtaatatagtaagattttgtttttataaaaaaattattaaaaaattagttgggtatggtggttgtagtattagttatttgggaggttgaggtgggaagattatttgaattaggagattaaggttgtagtgagttatgattatgttattgtattttagtgtgggtagtagagtgagattttgtttttaaaataaaaattaaaaaaaaaattgtaagtattttgaagggtattttatagataaaagttttaggtataaatttagggagattttgtttaattttggttgaattgttgataattataattagttgttataatagtagttgattttttgaaatttgaaatgtgtgtttttttgatttagatttggtattatttattatttattaggttttttatatttatttttttggaagaagatgtgtgtggtagttagaaggaatattttggatttttgtgtgattaattttttttagattatggtttttttttaaattttttgaatatttttatagagtgttttgtatagttttttgtttggtatttggttttatgtagttatagtttattatggttttatttagagtttttgtaaatttttttgatgttaatttagttgtattaaattttttggagtggaaaaaagaaataaaattaagagtataataaattttgattattagatttttaaatattgaattttttaagtaatttatatttgtaatttatttttttagattggtatttataggcgggagttggggaacgttgttattgaaaagttaggtagtagcgtttagatgtagttgaagtaagggtattaaatttttatagggatatttggagaaggtgttgtattatttaacgaagattagatggtttattatatagaaattattaaaataatttattttagaaagagttttagtaaaaatggagtttaaaggagttttaggaatgtaggacgtttttgattttattgaaggttatatagtttgtttattttagtttgagattttagatttatttatgttattttttgtttttttttgttttaaatgtgtttttatttttatttttatttatttatttattttttgagatggagtttttttttgtcgtttaggttggagtgtagtggtgcgatttcggtttattgtaatttttgttttttaggtttaagtgatttttttgttttagttttttgagtatttgagattagaggtacgtgttattacgtttcgttaatttttgtattttttagtagagacggggttttgttacgttggttaggttggtgttaaatttttgattttgggtgttttatttattttggttttttaaagtgttgtgattataggcgtgagttatcgtgttcggttgtgtttttatttttatgaaaggaatatttgtttattgggaaatttagaaaagtataaaagaaaaatacgaagttggtttggaattttattatttggaaaataaaagttaatattttggtatatttttagtttttttttttgtttaggtaattatatgttaggattattttttgtgttatgaattatttttttttaatttggttttaatagttatgaatttatttaattaattttttattattggatatgtatatttttttttaattgtgaataatgatgtgatgaaattttttttaaaaaaattgtgtgttttgattatattttatttaattagttttaagaaatatagtaatttatatttttattagttgtttatgtgagtgtttatttttagaaatacgtattaatattagtgaaatattttaaaagaagataggataggtgaaaattttatttcgttttttaaattttttaattgaaatataatatatagattaaaaagttatatagtataagtgagtagtttgatgaatttttttaaaatgaatatattatgtaaatagagtttaggttaagaaagaaacgttttgttgatttacgttattgttgatgggtatttgggtggtatttagggtttggttgttaggaatattggttgttaggtagttgttttttggtggatttgaatatatatttttattgggtataaatttaggagtggaattattgttttttagggtatgtatatattagttttagtagatattgtttaatattttttttaaggggttgtatagatttgttttttattcgtgttaatatttggtattttttgtattttttattgtagtttttttttgggttatgtagtggtatttagttgtggttttatttgtttttgatgattgagggatttaagtatttttttaagatatttatcggtcgtttggatatttttttttttgaagtgtttgttgaagttttttttttaaaaaattttttagttttttgtgggtagataattgtttattagtttttttattattgatttgaagtgatatttgtattggttattgttttaatatatattttaggttttttttttgtaaaattttattgtatgattaatttgtttatttttttgttgtattatatttttttagatgttatatatagagtatattttatttgataatgtatattattttttattattttttttttttaaatggtttttggtttttattcgatttttttttttagttgaatttgaggaatatttttgtagaattatgttatttattgaatttatatgtatgaagtgaaagtataaaaatatgtatggatataattatttttttaatagtggttaattttggggagagtggaaagggaataagatggagagggtttagttttatttgtattattttatttcgttaaagagaagaggttttaagtaaatgtaataaaatattaatatgtattaaatttgtgtggcggatatttagatgttgtttatgttattttttgaaatacgttatgattaaaagtatttttttagaatttattattattattattgttattattattattattattttttagatggggtttcgttttgttgtttaggttggggtgtagtagtgttattttggtttattgtaatttttattttttagatttaagtaatttttttgttttagtttattgagtagttgagattataggtatgtattattacgtttggttaatttttgtatttttagtagagatggggttttattatattggttaggttggtttcgaatttttgattttagatgatttattagttttagttttttaaagtgttgggattataggtatgagttattgtatttaatttttttagaatttagtttggtgttatattaagttaatttattgggttttattgtaattatattggttgtgggaagtaattttagtcgtttttttgtggtatttttataaggttattttttttttaggcgtatattaaagttatataaatgtatatttgttttggtgtttatattttgtatttatttttagaagtgttttaaaaaaatttgttatttataagaaaatacgtaggaaataatagttggtaagatttaataggtgtttgttgtgtttttattttttatattttaatatgttttggaagtaatttagttttatttttgttttatttgttttgaattgaaagttgtaggtacgttgatgagtattttggttaatgtaaatattttttatattggtttaggaaaagtacgattttttagtttttttatagtgggttgtatgtttattaagttatattagttgttttttttgttttttgagagtggtatttgttgtttggtgatttttttttttgaaatttgttagtgttaaggataaggattaggagtgggttgaggttgtttgttatttgtttgttgttgttgggagttatttaatagtggtggaaaaggttaaaggaatattggagtttttatttttgattttaagttattttaattttagggtaattttagttaattaatgatttataggtgttagatttaagataatgttggttgttaaattaaagagagaaggtatgtgtaggatgtggttttagtttcgtatatggtatgttgttaggatgcgtatgtatgaggtggatttttataaaaagtattataaatatttttaagaatattatatagtaggttatatatttttttaaagataagaagtgttatcgtttgaggtgtaattttagtagttttttaagttttaatttcgtatatttgaaagtatatttataatttgttgttgaaagtttttggaagttattgagagatatggtttttgtttattttttaaattttaaattatgtagcgtttggttggttttttgtttgaggagatataaatttattatagttatgttaataagtatagaaaatttgttagtttatagagaaatttgaattttttttttttttcgaaggagagtttcggggaagtcgtgtatataatagaattttttatgtttagatttggtttaggagaattttgttttataagaattttttttttttttttagtatatttaaatggaattaagtttagaaagaggttggggatagaatttagggaaataaaatatagaaaattttggattatttattttttgaatttttttgtagttataagtgtaaggattatttttattgatgtgtttttatagttaataaatatttattgaggttgtgttaagtgttaggtattttatttgattgtgaggataataaaatgtggggtttgttgttaagatatttataattggataagtaaattagtaaaatttagtatatttattaagtgtaatgtaaataatatttatagagtatgaaggaaagttttatagaagaggtgaggagttaaattttttatatgttaatagtgatggtagggggaagataggagtgggaattgggggttggagaaaggtattgtaagttgagagagtagtagaagtaaatatttaaagtatgagtattttcggtggtttggggaaatggtattaattagggtaggttgtttgttggataggtatggtttggggagaggaggatggaggtagagaatgtgaatggagaggtatatgagttttattggtggaggtttatgaaggcgatgttagatattttgggttttattttttatgtgagtgggaagagtagagtggtgggatattatttgttttaaaaattatttttcggttttagtgggaaaaatggtttggagtggggagaatgaatgtgattaggaggtttgggaagagagtaatatatatatattttgagatggagttttattttaggttggagtgcggtggtacgatttcggtttattgtaatttttattttttgggtttaagcgatttttttgttttagtattttaagtagttgggattataggtttgtattattatatttagttaatttttgtatttttagtagagatagggttttattatgttggttaggttggttttaaatttttggttttaaatgatttgtttgtttcggttttttaaattgttgggattataggtatgagttattatgttaagttttaaattaatattttaaagagatatttgtagtgttatgtttattgtagttttatttataatgggtaagatatagaattaatttatgtttatgggtaaatggagaaagaaaatgtgttatatatatagtggtatattatgtagttattaaaaagaaggtaattttgttatttttgataatatggatgtaattggaggatattatgttaagtgaaataagttaggtatagaaagaaaaatgttatgtgtttttattatatgtgggaggtaaaattgaagtagagagtagaatggtagtaggtaattagaggatggggtatttgggggataggattggggagatgttggttaaaggatataaaattatagttaggtaggaggaataagtttaatagagttattgtacggtatggtaattatagttaatgattttatattgtatttttgaaaaatgttgagagtggatgttaaatgtttttattataaggatgataattatgtgaggtaatgtatattttaattaagtagagttaattgttttataatgtgtgtgtatgtatattttaaatattatgtttaaataaatatatataattttttttgttaatttaaaataaataagtaaataaataaataaataaaataatttgtaggagggaggaaattagagttttttcgtatttgttttttaagattggggtgggaatgtttatgttttttatggttagttttttttttttttagtttttagtatgagattgtgaaggttgatatgaatagaagaattgggtttaggaatggtgaatattttgaattgtttttgtgaggaatgggaaaagatgttgagtgtataagagtgggatttatagttatgttgggggttttttgaggttggtgtggtggttttatgatgacgttagtgggattttcgtttatttattgtagtttttaatagagcggagaaaataggaggttgttttaagttaaggatggtagtttgggggtttggaggatattggtaaaagacgatgtatttatttggttgtttttagtttattagtttggtgatgtgtatgtttgtgagggtatttagttatttatttgtgtaagatggtatttacgaatatagtttttgtggatatgaaatttataattttgttttcgtttttagtgatgttatttgattattgatataaaatgaatataatcgatattgattattgttttgatattaattattagttttagtggaattgttgttttatatgtttttagaattaggaagtatgtttagtgagtttgtgtagtatattgatttgttttgtgtgtgtgtgagtgtgtgtgtgtgtgtgtgtgtgtgtgtgtgtgtgtgagagagagagagagagagagagagagatagattttatgaattttaggtgaggttagatttttggagagaatatagattaaagaggggttaatgtttttatttttggaattttattataatttttatttattattagttttaagtattaaatgtttttaaaaaaatgtatttatgagttatatgaagatgatggattaataatggattgtatatatgatagttgttttataagattataatatcgtattttttttttttttttttttgagacggagttttgttttgtttttaggttggagtgtagtggcgtgattttggtttattgcgatttttgttttttgggtttaagcgatttttttgttttagttttttgagtagttgggattataggcgtacgttattatgtttagttaatttttgtatttttagtagagatagggttttattatgttggttaagatggttttgattttttgattttgtgatttgttcgtttcggttttttaaagtgttaggattataggtgtgagttatggcgttcggttaatacggtatttttattgtattttttttatgtttaattatgtttagatatataaatattattgtgttatagttgtttatagtatttagtatagtaatatgttatgtaggtttgtattttgggagtaataggttatgttatatagtttaggtatgtagtaggttttattatttgggtttatgtaaatgtattttataatgtttttataataaaattgtttaacgatatattttttagaatgtgtttttatttttgtatgatagtatagttttaaagtgatttttggtttttttgcgttagtgtgtttgtttatgtgtatgtgagggttattttatattatgatttgtggttatttattagttttgggttttggaataaagtatttaatttgttttttagttgtggtagtaatagtttttattcgatggattgattttgttaattgtttagtagttttggatatttattataggagtttttttttatttaaggtttttatttttgaggttttagttatttatggttaattatggtttaaaaataagtaagtgtagtataagaaaatatttttagaaagagatagagagagagagagatatattatatttatataatttattatagtatattgttgtaattattttattttattattagttattgttgttaattttttattgtgtttaatcgatagattaaacggtatcgtaagtatatatttataagaaaaaatttagtgtatataggatttaggattatttgtggttttaggtatttattgaaatgtatttgtggaggataaggggggattattgtattgaattttaatattatttaaaattaaattgtatataattttattgtttaagttttagagtgtgtttattaggtagtattttgtttttttagaaatggtttttatgtattttagtttgttttgtgtttttgtataggtttaggtttaattaatttatatataaatgtttattttttttttttgaaaagttttgattaaaggagagttttttgttttatgatttgtttatagtgtttaagaagtcgtgagggagttaggataagatttgaagtttgatttttttttttataataggaattgttagattagtttgtttaaaatgagaagtatttgtttagatataagaaaattgtttttgttggttttatttttaaaatgatataatttattatttttttttgtgtggggtaaaaatttgtttttttattattttaatattgtttgatttttttttgtttggtgttttttaaaggtattttaaaatagtggatacgggaggtagtggagcgttttttggttttttgtatttatatgagttagtgttaatttttttttcgtaagtatttataaatatttgaaggataaggttttaaagttttttttttttattttttttattttttttttgtttgagttggttttgaatgtttattgtttgtttatttgggtttggatatatggtttttttggaaaggataaagtgggttgtttggtatggtggatatattatagagtaaattatttttgttaatgggatagattgaattaggaaattaggttttatagttgtttgatttttcgtgatttttatgacggaaggcgatattttaggtatttttttttatttgttgttaagttttatttttgttattttttgttgaaaatgatttgagtagtaattgtttggttttaggtataggtttttttttgagatagagttttgttgttgttgtttaggttggaatgtagtggtatgattttagtttattgtaattttcgtttttcggatttaagtaatttttttgttttagtttttttagtagttgggattgtaggtgtttattattatgtttggttaatttttgtatttttagtagagacggggttttattatgtaggttaggttggtttcgaatttttgattttatgtgattcgtttgtttcgatttcgtaaagtgttgggattataggtgtgagttattatatttggttaggtataggtttttatatttatttttattaaatattttttttttggttttagtttattattataggataaattcgataggatatggtttttgtttttaaagagtttattatgttgtttagttattaggttaaggtgaaaggagaggatatacgtgtgtttatatatatatacgtatatatatatagttttttgtttattttttatttttgtatgataattattgtatataaaaatttattgtaaaaacgaaagtagttgaggtagagttgtttgttttagttgggattgtaatttgtttggtgagataggggaattggaaggggagttttgtttgtgtgttcgtattttggttttttgtttgtgtgtattgaggtaaattagagttttaacgggtttttaatgtgttttttgtaaatttattagaaatagatattttgtttgatgtttgttatttattttgtatattaatgtttgtggattaataatggaaaatttttatttgttttaaagtaggttagaggtttgaaaattatttttagaaattttagaaatgttagtaatttagttttgcggtgagtagttaaaattatatttaatatttggatttagttttgtgcgtttttaaagttttgttgttttttgtatgtttaattggtatttttataattttgtttttagtatttttagtgtattttttttttgtttttcgttgttaattgattgttttatagatgttatttgttatttattattataataaattttggggaaaaaatgttttgttattttagttggtagtgaaattgttttaagttttttttttttagttaaaaaaaaaaaaaagaaatttttttttagagtttgagtattttaagttatgtgtttttgatattattaattatgttttatttggttgtttttaaagtgttattatttaatattttttttttgtaagagagttaatttgtgtgtgtcgtttgtgtgtttgtgtgtgtgtgtgtatgtgtgtgtgtgtatatgtattttaaggaggtattaaagttgcgttttagagggaagtattgatttttaaaaattttagatattatattaattttttaagggaagttttatagttttgatatttttaggaaggttatagttatttgtttagaaggttttgattttaggttttgttaaattatttttagatgaggtagagggtgtttggaaaataaatagaatttgttttggtttgtgagtatagttatgtagtttttttatattttcggagtttagtatttttaggattggttttgtaacggagattttaggacggttttttaggtaagtagtggagttgggaaagtttattttatggtgagtgttttttcgtttgtgtttttggattttttttattttttagttttagatatttgattgtttttttgaagtttcgaatttgttttggtttagggtttttcgttatatttttttttattttttttttaaggaattaattatttaatgtagttattttattttttgtatatttgcgtgtttattttttgtttttgtgtagaatgtaagaattatgagtttgttttgtgttttttatatagtgttttagtgtttggaataggggtcgttatagtgtaggggtttaataaatatttgtggaatgaatgagtaggtataaaaatgattttaagttatatttggaagaatttaggataatttttattttttttagggaataaaatgttttagtttagttttgggttaagatgcgtttgtagagtagatgtttgggttatttatttggggcggttatatttatatgtattcgaattatgattttttgttttttgtttttagtttgatttattatttttgattggttttttttaaatatattaacgtgggttttttgaaggttatgtagagcgagagttttgcgttaacgtggattgaatttttagggatttgtatagttgttgtgacgtttagattattgttttagttttaatgtatgagtaggcgttgatttttttgtttggggtagttaagttcgatattgtttttaggtttgtgagtagcgaattgtatttttcgttgatcggaatatagtaaagtggtgaattttaggtgataaaggtttttatttttttttgtattgagtaagggtttcgtgttttagtagtacgatattttatttggtttttaagttacgtaatgaagaggaatttagagtgtgtttgaatatatggttttaaggttatttagtggttaattttttttgttttttaagagtaagttgttttaattgtgattgtgttagttagaggattaaaataagaagaggatgtttaagttaatatttttgtatttttttagaaagggattatagtgttagaattttgtaatttttgtcggggtattttggtatttataaggtgaggtttattggttggtattggtgtattaaataaagtttaaaaatggagtgatttttatgttattatttttagttgtatagattttggatagttgttgataggttgtgaagatttgatttttttagggattttgggaaaagtcgattaaatttgatgacgttaagagggatatatatagtagagaaaagtagttagtaacgggggttttgtagatagttagattcggatgtgagtttaggttttgttttaagtattaggggttaggaaggtttaagttagggttatattgtaggttttagtttttttatttgtaaaatttagaggataaaattttttgaagggttgttattaggagtaatagaaatgaagtatatgatgtatatacgatattgtcgattttttgtttatgttttttttgttgagaaatattatttgatggtttttttattattttgttttataagtaaatatgttgttaattaatatttagatatatttttttttttttttttattttttttgttttttttttttttttttttttttttttttgattagaaaggtttagtattttttaatattttaagtgagatatgaaacggttttgaagatgattttttgttaagtgtattaatagagattttagaggaaatttggaatttttatgttagaagtagtgttgtttttattaggtttataaggtggaattaagataaatttatagtgtgaattttaagtaataaaggtggtgatttttttaaaaatttatataaatttaatttttaatgttttaaaaggggatgttgaaggatgtttttgtgtaatatattttttggtgttttatttatacgtagatttttaaaagattttttttgggaggtatattttttgtaatgtaacgttaattaggacgtttttgtaggtagagaaaatatttagttttttgtaaagttggttttttttatttatattttttgtagtttttatttaatattggtgagaattaatagttgaaatttaaagagttgattgatattttttagtttagataatttaattatgtttttttattattttttgttaaaagagatttacgatgtatttgtattgagaggtaggtttttttaaaagatattttttattttgtaggattatgaaaatgtttttaattatgagtaaatgaagagagttagtattgttttttgaagaattttggggatttattttatttatttatgtattgttggatattagtgaggataggggaggttgtttttgtttttttttttattaatttttgtgtttaacgttgtttattttattggatatattttatttgtataatttggtaataaagttatgtatgaaaaatgattaaaaaaggaattatatttaattgtagtattttagttagagttaagatatatagaaattgatatattgtgtttgtttatttggtttttttattttgttagaggaagatagtaaattagatttattgaatatttatttatttgtttatttatttattaatttatgtatttagtaggtattttttatgtatgttttatgtgttaatattgtgttaagtattgagggagtgaattaaataaataatttttgtttttagggaatagatggtttggtggtgaagtttgattattaaataagttatattaataaattgtgatgattgtcgtaatagagtaatattgtagggatatgagaggatttagtgggggtattggtattattgggaatagagttgggtatttggggatattttttggaagaagaggtatgtaagttgaaatttatgaaagaattagaaaaagtattgtaaaaatagatgtgaggaggtaggtataaagggaggttatgttttagataaacggggttgttgggtagattttttagaggtaaaagggaattttgtatattaagtaattgaaattattttattgggattggggaatggaagtgggaggtggtatgttttgacgaagttggttaaatagagtttagtttatgaatgtttaagaagttttgttttattttatttttaaggtagatatgatagtgtttaaggatgggagataggtttgtattggtgttatatgatttaagttatagtgtatgtaataggttagtggggtaatatagaagataggagattattaggaggttattttattaatttaagtgtagattggtgatggtttagattttattggtggtagtgggggtgagataagttgacgtattagaggttaggtatagtggtttatgtttgtaattttagcgttttgggaggtcgaggtgggtagattatttgaggttaggagtttgagaatattttgattaatatggtgaaattttgtttttattaaaaataaaaaaattagttagatttggtggtgggtgtttgtaattttagttattcgggaggttgaggtaggagaatcgtttgaatttgggagatagaggttgtagtgagtcgagattatgttattgtattttagtttgggtgataggtgatagagtgaaatttcgattttaaaaaaaaaaaaaaaaagagatagagagagaagttgatgtattagagatatgttagtttaaaattgatagggtttagtaggattttggggatggaggaaggagagttaaagatgttatttggttttttagttagggttttatgggtagatggaatgtcgttcgttaagatagacgggagtagagtagatttagagataatgatgattttaaatttgttaggttaagttggagggtatttaagtggttggatataaagtttagaaatttagaaaagagatttgagttggaattgttgatgttaattgggaaaggatgaagtttaagaagtagagttagaaaagttggatgtaggtttgaattttttgggataataatgtcgaaagtagatagagtaaaaagtgttgttttttgggagtttggttaattgagaatatggtgattttttttagattatatatattaaagtttggttttgtttttttttaatgtaaatattgatgagtttgttttattaattaattattttttaagtttattgtttttattttgatgtggtttgtgtatttatgatgaggttgattaatattgggataaatagagttggtgtgagttgaaaggtttttttgtaagtagtttgttgtatgaaatggatatgggttgggaataggggtaaggaattgttttttaggtatttttataatataaaaatcgatattattattatgggtaaaaaagtaaaagcgaaagtttataggaaatgtatatattgatttatattatttgttatttttgtttttttggagagggagggagtacgtttttaggggacggaggaggggagttttagcggtatttgttttattttttttaaagttatttgaggtaaatatgggaatatgttaatattttttaaatttgagttgtaggtaacgtggataattagtatgttttttttagtatttttttgtatgttggaatatttcgtaattaagagttattttttaaagaaataaaaataagatgggatggggtttgtgttgattgtttgtttgatttatatttaggaaattatgagaaaattataggtaatattgagttaaaaaggagttgtatttagaaattaggttttgggtggatgtgggtgtttagatagttttttattaaagttataaaatataaaaatttttgttttttgttgggtatgggagaaaacgttttatttgagaataaattaattttatgtggagatttttaatttttttttattttttgttattaatagaatttttgagtaatttgagttaggattttttttttttttggaattttagattaaaggtgtgttttttcgagtttaggtagagtgtgtttttggaggttaggtttttataggtaggaggaaagggagagtagttttttgggtggaggagatagaagttttttcgagggatttttttaaattttttttgaatgggtttattgtttataagaatagttttttaatggaaaaataaaaaggtaagagggtttgtaatgtgttttcggtttttttttgtttagttttattgtttatttgatttattaagttttaagtagttgtgtttttttgtgattttttttgagttgtttttttagagtatttatttattttatttagaaatataatatttaaaaattttggagttgagttaaaaaatcgttatttttttgatgtggtcgtttttttttttttttgaaattttaaatttgttggggttattaaagttttggattgtagttttttaattattaagtttttttgggtgttgggtttttggggtttgtggtttgtgtaaggttggagataggttggttttaggttttgttggttttcgttgtttgtttgtacgtaattagaggataagatgttagataatttggtgttaagtggtagagaagggattgttaaaggtacgaatttaaggtggtgttttaagggggtggttttgaagtggattttaaggtatgtttaagtagagattaggaggttttttttttttgttttaatatagttgtagaatgatttttgaattttgattttttagattaaatatttttaatagaagaaagaatgttgtaaaattagagtttgttttttatatttattattttttttttagcgtttttatttttttttggtttttttttgttttgttagattttttatgataaggatttgttaaagaaagtttgaaggttaaagagtagatgttaaatataattttattattttaatatatgagttgttttaaattttagtatttttttttttgtttttatttatattttgttttaggttttgttggtttttacgtattttattttttttaaaattaaggagttattaaaggtgtaggtagaattttgttaggaagttgatggttaggaagagatgttgtatggatttaagtgtggagattttagtgattagtattttagaggatatttttgtatttatgattgtaattttttggttggttatttatatttttattagatgaattttagagttattttattaaatttcgttttattttaagtaaaatatagtattaataaaaataaatgttatttttatagattgcgattggaattgtgttaaatttattattttttaaggggattgatatttttataaggtataatttttttattgtgaaatatgatatgtttttgtttaaataggattttttttttttgtgattgtagaagtttaaatttttttatgtttttgtatgggtcgtatgttttttttggttattgtttggtttatttttggtagtttagtttgtatgattttttggtttaattgggagtagtatggtaaaatggatttttatgaggattttgtatttatattgttagaatttattattggttttgttgtggttattagtgagatttcgggtaggatatttaatttttttaagttttggtttttttatttttaaaaggtggatagtaatggtatttattttatagggttattgtgaaaagtaagtgagttaatatgttaagggtttaatattgtttttggtagttagtatgtgtttaaaaaatattatatatatatatatatattttttgaaacggagtttcgtttttgttgtttaggttggagtgtagtggtgtgatttcggtatcgtaacgtttgtttttcgagtttaagcgatttttttgttttagcgtttcgagtagttgggattataggtatgtattaatatgtttagttaattttgtatttttagtagagatggggtttttttatgttggttaggttggttttgaatttttaattttaggttatttgttcgttttttaaaggatgaattaatgaatttaatggattaatggatttattgaatgaatttttgtttgggattataggcgagagttattacggtcggttattattatttatttttattgattggtaattgttggtgaatagaaaagttatggatttttgtatgtttatttttaattttatggttatattaaatgttttatttgttttatcgtttttttgttatattttttgtgttttttagattagtttataatattatttgttaataataatatttttattttttttttagttgttgtatagtgtatttttgttttatgtaatattgaattggttttaattttttggataatagtgattaataatgattataattattttggttgttattttaatattattttttttattaggttaaggaaatgtttttttagtttgggttttatttttttttttaaaaaaagtattaaattttattaattattttttattattttttgtttttatgatatataattttttttttttgatttattgatgatttttgtatgtttttttataatatttttaattatgttttttggtataaggtttatttgattttagattttggtataatttgatatgttagtattgtatttagtattttagtatttttgttgtgtgtttatatatagttttgatttttagttttttttttttgtttttataatattagatttggtattgagattgtatttgtttttaaaatgtattgtaattttttttatatgttttaatttagaaaagtttttataatatgaaattatttgttttttgagtgtttgaataaatttatatataacgttattagggtttgagtttggagtttttattggaaataattttgaagagttattttagttttttttattgttattgagttttttatatgtttttaagttaattttggttatttatatttaattaggattttaaaatttaattgtatagaattttgaaatatatttttttaaaaagtaaataatttttttttgtttatgtttatattttatttttagtttgtgtttgtattgtttgtttttttaattttgggtggatttgttcgtggtgttttagtttgttgtgttttttattttttaaatagtttgtttcgggatatatttataaattttaatggtttttattttttttagattataatttatttttgttattgttgttatttttattttttattttttttaatttgtaaaaatgattttatatattgtttttttttttttgatagtaagatgatatttatgtcgttgattttgttattgtataaaatgattgttggtaatattatttgtaaatgttaatatttttaaatattttttttatgtaattgtaaaatatagttttttgtgtgtgtgtgtgtgtgtgtgtgtgtgtgtgtgtgtgtgtgtgtgttgagtttatgtatatatatatgtgttgtttgggtatgaatgtttattataggatatattcgaatttattttggtataatattagatgatgatagattttgaaaatattttaagagtaattgatttagatttgttttttataatttaagaaaggaaatgatttattttgttgttaataattagtagagaggaagagagatttttgttatttttgttaatttattttagtattttgttaagttttggtaagaatatttttatttttgtgttattaggttttatttgttgtgttttgagtttgtttttttttttttattttttaaagttattagagtataaagtgggtgtttttagtaattttttatatgtttgaagatatatgttagagtatttgaattttttatattttattttttttattgatagttttattttgattttggttgattatagttttttttgattagtttttaaaaatggagaataaaagattttttgtttttataagggtatgattagtatttaatataggaaggagttttgaaatgttaattattgatgaagttatttattttagtggtttaatatttgtttttattttgtttttaaatagggtgattttttataattatttttttgttgtgtgaatgtgtttaggatttttgtacgttgtatgtttttttttgattgatgattgttttaagtttgtttttttttaaatattttattgattggttggattatagtttattttattagttttttattgttgtttatttaaggtattttttttaaaaaatagattattttttagagtggtattgggtttatagtaaaattgtgtggaagatatagatattttttatatgtttttttgtttttatatagttataattttttttattgttaatattttttattagagaggtatattggttataattggtgaattaatatggatatcgtattattatttaaagtttatagattattttaggggatatttttggtgttgtttatttattttgtgggtttggataaatggatagtgatgtgtatttgttattatagtattatatagagtagttttattgtttttaaaattttttgtgttttattagtttttttttttttttatttatttatttttattatttttagtaaatagtgatttttatagttttgcgttttttagagtgttatatatttggaattatatagtatatagattttttatattgtttttttttatttagtgatataagttttttttatgtttttttatgatttgatagtttattttattttagtattgagtaatattttagtgtttggatgtatttatttattatcgattgaaggatattttggttgtttttaagttttggtaattatgaataaagttgttataatttttgtggtgtgtttatgttttatttttttttttattgatataaaagtaggtggtggttatttttgtagttgattttttgtttttatttttgattatttttataaattttttaaagtagaattgttggattaagaaatagttatatgttaagggtttaatatatatttagaagagttaatttaatttattttttattagcggtgtgtgtatttatattattagtcgtttttaatataatagatgttaggatagagatttttttatttagttagtttatttaggttgttataataaattattataaattgggtggttttattttttttagttttggaagttagaattttgtaattaaggtgtttgtaggtttatattttttttgacggttttagaaaagtatttttttttgttttttttattttttgggagttattggttatttttgttattgtttggtttgtagatgtattattttagtttttgtttttatttttatatgatgtttttttttttatgtgtattttagtgtttgttggtttattttttttttttttttgagatggagttttattttgtcgtttaggttggagtgtagtggcgcgatttcggtttattgtaatttttgtttttcgggttcgagcgatttttttgttttagttttttgagtagatgggattataggtgtttgttattacgtttagttaatttttgtgtttttagtagagacggggttttattatgttagttaggatggtttggattttttgattttgtgatttatcggtttcggttttttaaagtgttgggattataggtgtgagttattgtgttcggttttgttggttttttcgtaaggatattattaattggatttagggtttattttaatttagtataattttattttataaattatatttgtaaagatgttgtttttatataaggtcgtattttgaggtttttggtggatatgaattttggggaggatattatttaatttagtatgattgtttgatttttatttttttttgttatttagttttaaaaaataatgaaaattttattagaaaattaataatattaagtagtagttataggaatgatgataaatgaatttttattttttttttttatgttgttattatttttagtgataaatttgataaatttatttttgatttttttttttttgttaatataaatattaaataataatattttagatattaaattttattgtaatatttttaaaagaaaatgtatttggggtttatttagatatggggtgaatagcgttttaaaataattttattgttaatatttttttttatgttttttttttttttttgagatagggttttattttgttatttagatttgagtgtagtggtatgatcggggtttattgtagttttaattttttaggtttaagtgatttttttattttaattttttaagtagttgggattataggtttgtgttaacgtatttagttaattaattttttttttttttgagataggtttttattatatagtttagtttggttttaattttttgagtttaagtaatttttttgttttagttttttaatgtgttgggattataggtatagttatagtatttagttattatgattatttttaatgttattttgttaggtttattttagatggttttaaaatatttaaaagtttattttagttattattttatttaattttaaaatgtagatattatgaaaatgagatgtggtggtttataaaagttgatttggtgtagaattagaagtttgtttgaattaattgaaaatttaggtatttagatttaggatatattatttttaaagatgatgtttgtttaggtttatttaggtaattggatttgttgtaaatgttgtgggttttttagtgattaaggtttgaaagattttgaattttgcgttttatagtgtagttgtattgatggttaggggtgttgtttttaggtagggtagttgttatttcgttgttgttgtttttgggtgtttatgtgattttttaggtgttttatttgtgtttttttgtgagtatatgattttgttttgagatttttaaaaggttttttaaatatttttttttttgtaaaattaagaacgttattattttttttgtgagttttttatgggtatttgttatacgttaggtacggtgttggttattaggggtgttaattaaggcggagagggtggattttaaggaattttaattagggtgaaacgtagtatttaaatatttagttataatattatgttaagaatattatggttgagagattttgaaagtgttttggggagttggaaggaggaatatgaaattatttgattggaggagggttgttagggaaagttgttgagaggagttgagattttattgtttttcgttttagatattagtttttgtagtataagtttatggtaagttcgttatttggtttttatatgttgagttacgttttaaggttgtgttttatatttgggattgttgacgatatggtttggtttatgtgattatttgtataatgtatggtgatagtgaggttaagtttttagttgttggtttaaataggtttagtgtgtgttaagagttgttgaaatggttgttttggtttaaagagggagtttagtatatgttttatgattttagggataggttgaggttttaagttttgagaggttggtgtttgtataaatggttaatttaggaaagtgagtatatattattgttgttagggtgtgtgtgcgtgtgttttttagattataattttttatttttgatattaatagtattagttgtaggttggagagatttattggttgtttaagaagataatgtatatatattttgtagtagtatatttgtggtgtataggagtgtataagggaagttgtagtatatttgggtagttttaaaatgttacgaataaagtatttggatatttgtattttttgagagttgtaagatagaagttagagtttatttgtagtatttgagaattgtttaagaaatggttttgagtattttgttataattataggaaaaatgtggtttgaagagcgtgtggattatattattatttgaaagtattttagtatgttttgtgaattttttttgaatggatgtaggaaaaagatgcgggagagtatgagtgggtgatagggaataagaaagtagtttggagaaggaagcggttttttaggtggtttttggatttttttttatgagttgggagaaaatatatggttaaattatagtggatttgaatatgtgtggattttgatggatttaggaaatatgttttgaaatttttatagtagggtgaattaagagttttgggtgttagttttgtaaaagtagttagtttaggtagaggaggggatttagtagtataggataggaagatattaaattgtgtagatttttttagtttgtttgtttgtatgtttaggtgggatgggagttagtgtttattttaataggtattatgtgtgttgtaggttgtattttttaggaggtagattttgagatagagttttgtgtgtaggatgtttattagggaatgtttttaagataggtatttggggaagagaggggaggagtaggaaggagtatagggagatgttaggatgtaacgaaggtgttatgttagttttagttgattttataggggtttagtggggagtaagagttgttttaagtcgtattgagacggttgggtttttatatttttatataaattagttattgatttaataatttttgggggtgagggttgttttaggaatgagtgtttttttgtttaaagtagttttttgtggtataggtaatttttgtatgggttgagcgttaaagggtgtttgtgtttttgggttgggtattatgatgttattataatatatattatatggttttatttatttatttattaaaataatttatatttattgtgttttttttaaaattagttattgttttaggttttgaagggagtgttgaaggaaatagatatggtgtttttttattgtaggaagagtaggttcgttttttagttaggagatagtcggtaaataaggtagtgaatatgaaggtattaggtggaatgggtgttttgatgattataaatgggttgatgagatagttggtgattgagggattttgagatatttgaaggtgtagttatagggagatttgcggtaggggttttgtaggttagggaacggtagcgtagagttttggggtagatttaggtatggtgtgttttataatagaaatagagattggttagagtagagacgaggggaaggagatgaggttgaggtaggaattttagttttattttaagtatgacgggaggtagagtagaggggagcgttttagagagggtattttttagagagtgtttagtatgtgtttattttattttgagtgttttgtatgagtgacgtatttaattttcggtaattttattaagtggttattgttattatttttttttattttatagaagagggaattgaggtagagatatgtttaaggtttatggttagtgtcggagttggggatttaatttgaggaggttaggtttatatttttggttttcgatttttatgttgtggttattgttttgaaaaggtggtttggttaatatgtggggtaggaggagagttaggaggttatttaggaggttattgtagtttggttgagttcgggtgagagggggtgacggtttagttttgaagagggagggaagtggatggatttagtttatgttgtggagagaggaatttaagatgatttatcgttttttgatttgagtaaatataaaatataaatatagatataatataggatattttatttgttttttatttgacggcggtgtagggattgggaagtttttaggttgttataggttttttagtgatttggaaagaaaattaaatttattttttgtaaggggtatggatttttgattaggaatttttttttatttgttgtttttagaaattgtttattttttaaagtttgattgttttgggtttttgttatggttttggttggggtaagataaggtaatgacgaggtgttttaggtttttttttgatttgttttttatttaaataatagtttggtatatgaaagtttattagtatttagtttgttgttatttgtttttgtgttgtttgtttgtatttggtgaaaagtaaatatggaggttggtattattaatatgatagtgtttatattttgaaaggatgagaacgttaatattaatagtgatttttttttaattttttgagatagagttttattttgttatttaggttggagtgttatggcgtaatttcggtttattgtaatttttgttttttgggtttaagcgatttttatgttttagttttttgagtagttgggattataggtgtgcgttattatgttaggtttatttttttgttatttttagtagagacggggttttattacgttgattagattggttttgaatttttggttttaagtgatttgtttatttaggttttttagagtattgggattatagatgtgaattattatgtttagttaatttttttgtgtatttttagtagagatagggtttcgttatgttggttaggttatttttgaatttttggttttaaacgatttgcgtattttgtttatttcggttttttaaagtgttgggattataggtatgagttattacgtttggttaaaagtaatttgtttgggatttttgtttgttaaaaaaatttttttgtgtgtgtgtgtgtgtgtgtgtgtgtgtatttatatgtgtgtatatatatatatatatatgtgtatatatatatatatatatatatatatatatatatatatatatatatatatatatgtatataaaaatgtgtttttttaatattatgtgaggttttgttttttattgaatattggaaagttggtaataagtttagttggttagaagtgaaatgtgaggttttttggcgaaaaagtttaaggagaaatttcggttttttgggtaaagagtatgcgtttatagggattattattattatttttttaattttaaagtaaggatataaagtagggtttttggtattatttggagaatttagatagaaaagaagaaaggaaaagtagtatttgtttatatttttatttttatttttttttttaaagttgttttgcgtaatatggtagttatttatcgtatttgattatttatatttaaatttatgtaaattaaaatggaataaaattaaatatttagttttagttatattggtcgtatttgaagtgtttatcggttacgggtttattggttgttttgttaaacggagtatttgtggaatacgttattaatatagaaagtgttattggatagtgttgtttatagttttagaatttaagagatttttggatttttggaggttcgttgtaaatcgtagggttttaggaatttaggagagaaagagtttttatagataaatttatagatgattttaaatatgaaataataatagtaataaagttagtttatttataaggattattttgaagttttgtaatttgaagatggaagttttattttattggtttaggtaattagtttttggaaagttcggtatatggatgatttttttagttagttagtgtttgatgttatttattaagatgtatgagattttgttttttcgtgtgagtattttaatttaggttattatttttttgtaaaatgggtatagttattttaggggaatgtagtgtggggtaatggaatgtttttattatatttcgaaattatagttgaatggtatttatagagttatattaaaaattatatgaattggttttggaagtttttgtttttgtttttgttgtttttttgtttgttgttgagatggggtttcgttttggtatttaggttagaatgtaaagttgtgattatggtttattttagttttgattttttgggtttaggtagtttttttatttaagttttttatgtagtcgggattataggtatgcgttattatattggttaatttttttttggatttttttatagagatagggttttattatgttgtttaagttggttttgaatttttgggtttaagatatttatttattttatttttttaaagtgttaggattataggggtgagttatcgcgtttagtttggaaattttgtataggttgaaatttaagttatgttatttattgttgtttgtgatgtatttggattttttatttgttaggtagtaatatttttagtgtaggtgagaagttttgatattttaatataatttttagaaagtttgttttttagattataggagttggtaaattatagttggagggttaaatttagtttgtttgtgtaagtaaagttttattggaatatagttattttatttgtttatgattgtgtgtggttgttttagttttattattgtagagttgtagaattataatagattggtttgtaaaattgaaaatatttatattgtagtttttgataaaaaaagttttgttagtttttagtttagatattgggtgaacgattggaacgtttttttagtaaggaaatatttgtgtaggtttaggtttgttagaggattttagagtagatgtgagatttttttatttttgggttatataatttagtagataatagaaagggtaattatatattatatttttttggatgttaaagatttttttggatgttattttttagcgataattttattttttatttttattaaggaaattttggagttttattttaataggagataatttttatcgattttttatttgttagggtttgtgtttattgttttttatagatgagttgttcgaattgtttggttgttgtttaaaggtaatgttgagcgtattttgggttttattttttagttttttttaggttattattttatttttttttcgtttgtgttatttgatttgtttttttgttggattgttttattaggatatatatgtttattttttgaaaagaaatagatatttagtgattatgtttattttattagttgttatttttttttggtttttttgtgtgtaagtttttttttatagggttattggagttcgttgtttttatttttagttatttttttttgaatttattttagtttttgttttagttatttgttttataaaagttgttttgtttaggttattgttggttttttggttgtttagattagtggttagtttttagtttttattatgtttgatatgatgataggggttttttttttgttttatttggtatagtttttgtatgatagttgggttttttttgttgtttttcgtttttattattgtttgttttttgtaggttatttttcgtttttattttttgtatatgggagagtatagagtttagatttgggtttttttttttttttgtatttattttttgggagttcgtagttagttttatgaattgaaatattattgatttgtttataacgtttaaatttatttttttagttttgtttttttttatttaaattttatatttgtgtattagttgtttattagatatttttgtttggatatttgtaagatattttaaatatgatattggcgaaatgagttattttttatttattttaggttgttatattttttttagtttaggtgatggtaaggttatgtttttagttttttaggtttttaacggtggaatattggaattatattttttatttttttattttttcgttttttttttatttttttatatatatatatatttatatttttttgttatatatatattttaagtttagtttgttaggaaattttgtggatttttttttttataaagtattagaatttgttttttgtttattgtttttttaggagttattattagtttttttttggattgtattaatagtttttagtttttttattattatttttgttttattagagtttgttgttaatatagtgagtttttataaatataagttggattatgttatttttttgtttaaaatttatttaagggttttattttttttggagttaatgtttatatagtggttttgggtagtatattttgtttttttcgttatttgtttatttacgttttttttttgttttagttgtattagtttgtttttacgttgttaatatagatatatttacgattggataatttataaaagaaagaagtttattggattttcggttttatatggttggggttgttttataattatggtggaaggtgaaaggtatattttatatggtagtagataagaggagagtttgtgtagggaaattttttttttaaaaattattagatttcgtgagatttaatattacgagaatggtatgggaaagatttgtttttatgatttaatttttttttattaggttttttttataatatatgggaatttaagatgagatttaggtggagatatagttaaattatattattagttatattgtttattgtttttttttaaatatattaggaatatttttgttttgttgttttggtttttttttttttttttttttttgtgtttgtttttttgattcgtttatgtttgttaagtttgtgtttaaatgtttattttttgtgtgatttatttagattattttgttttgtttgtttgtttgttttttgtttattttcggttgtttggttttattgaatattattttatttttatttttttatagtcgtttggtaatttttaataaatattattttttttttttggtaaattttaattttttagtgatggggatgtgtttattttgttgattgttagagtttaagtgtttagattagggtttagttattagtttttagtatatagtaggagtttagtatatgtttgttgaatgagtgaaggggtttgatttagtttagtgtagtttttttttgtagtagtgaaggaatagtttttttttttttttgaaggggggtgatgagttttttggagataagaggtaaggtcgtttagttttaatttgtttttttgtaggtggtgggagtgggttatttttttaaagatatatattttagaatggttagtattatggtatttgtcgttttggttattgttcgaggagtttttataatgattatggaattaagcgtttgtatttgggtggtttgtagtttgttttattgatatgatggtaagttggggttttagtagaagttgtagggatgatatataattttgttggtattttaggtgatgtatattttgttttgattgttttttttggagttttttgttttaagtagagtagttgagtgtgtggatatttgttgtgtgttgtttttggtcgatattttagttgggatatagttgggtttttgggtttagaggtagtatatttattgtattttttagatttttagttgaatagtatttgaagtttttgttagtattgattttttttatgttaagtttggttagtgattgagatttatgaaggcgaagttattttattatttttggtgtattaggatttagttggtttttatatttagcggggttgcgtgaatgtttatggagtcgtgagtgatattgtttttagtaaagtttttttagatattatatgttagatattttagtagtatgtgagtttttgttattgttttattggacgagttcgtcgaggagatagggtgtatttttgtagaggagtatattgttgtttgtattagtttcgttttattaaattttttttttgtttatttttgttggtttatttatgtttttttatattaatttattttttcgtttgtttttagtttttataatttttgaataagttgtttattgatgattttttttttattatatttaggattttgaatatttatatgtttttaagttatagaaatgtagaattggagtttagtgggtaaaggtttaagttttggattagattgatggggtttataaattaacgttgttatatgttaagtgtgttttttttttttttgtattttattttttttatttttaaataggtgataattgtggattttgttttatttttcgtttttatatgatttttttagttttagtttttttagtttttaaaaggttaaggttatgaaatttttttttttatttgaagttatagttttttttatgtttttgattattgaatatgtgattttttgttgttttcgttttttttttttattttgtattaggggatattttttaatatttgatgtgagggtttttgaggtttttgttgatatttttttttatttttggttattttttttttattatttttatttatttttattagaatatgggttgtaattaggatatgtaagtttttaagggaaggacggagtgtttttattattggagcgttagtatttagattagttttttttgtaataaagtgggtgtttagtaaataggtgaattagatagggatggataaattaatgaatagagtttttttttagtttcgtgagaaggttattttttattttagtttggttttttagtttagtgtatgttttttattgaatagtttggttttttgtttggaaatttgggggttagatttaaaaagtgtttgaggggagagggaagcgattttgtgtttttttttgggttttagtattgtttggttttttaggatttttaggtagggttgtattgaggagggttgggttgtggattttggggattaatattttatttttattgatttttaaaggagagtagtaaaattaggtgaagatttagggaatagtttttttgagggaatgtttattgagttaagttgtggattttgtattttttttaatagtttagggttaaagaagtagattgttttagatttataaaagatgaggaagtagattgttttggtagagtttagattggggttggtaatttcgttatttgtgtaagttatgggtttgtgtttttttgggtatttgtttgtatgaatttatgttttgtttttttgattgtagaaggaataggtaggtttttggagagaaagagagagaggaatttgggtggcgttagagaagaaggtttagaaatttgagttgatagatttgtttttatgaaggattttatgtgatttatgggtttttataggatttgttaggatttgtggggaaagttttgtatagaattgtggagggggtattttttgtatttttgtttggaatttagttgttttttggtattttggtggatttttgaggatatttttgggttagtattagtatatggggattaaagtaatggggtatgagtaaatgttaattaaattgaaatagggttttatgataagttggttaggatattagtttttgtttcggttattatgtttgatttgtgtgataatttttttttattattttgtttgtgatttggagtttagttgataagtttagatttggtgttagtaggagggtggttttgggttttgtattgtttagagttatgtgcgtgggttgtgggatttaatagatttaggtttaatttttggttttgttgtgtggttttagggaagttttttattttttataagttttggttttatttatttatatttattttataaaatggaaataataagtttatggtgaggatttaaggaaattaaagagataaagggttttgtatagtttgatattcggtagttgttattgttagtgttattatatattatggtatgtaagttggaatttagttatttttatatagagttaatggtttttaatgtttatgttttttatataagtttgtttaaaatttatttttagtcgtaaaagttttgtaagagagattattgttattttttttttttttttggagatagagttttattttgttatttaggttggagtgtagtggtataattttagtttattgtaatttttgttttttaggttttagtgattttcgtgttttagttatttagatagttaggattataggtgtgtgttattacgtttggttaatttttgtatttttagtcgagatagggttttgttatattggttaggttggtttcgaatttttgattttaagtgattagtttattttggttttttaaagtgttgggattataggtatgagttattgtatttagtttttatttttttaaatgaagagattgagttttaaaagggtgaagtttgtttttttagtttatataattggatcgagggatggaaggtaagtatttcggggggattggtttagtgtattttatttatgttagtattaatggtgaattttaatatttaaaagtatttattattttgttgattatagatatatagatatattaagtattatataggtggtgtgtttttgattagttagttttagggtttttttgggaatttaatggatttaaatagttgtataaggtgcgattgtaaggtaatagacggtatttatagaaattaggtaggaaagataattttatcgttttatagatatattttatgttagtatgggggtagaggttttattgagagttgatatttatagaatattttttttgcgtatttttatttaattttttcggtaagtttattgttgtttttacgttttatagatgaggaaatggcgttcggggagtttagtgatttgttcgagttggagttgagtgtagtgatagagttaggttttgaattttggtagttagatttttcgttcgtgtcgttattttttgtgcggttttggggggcggttgatgaatatagtttattaaaaacgaattgtgattcgatagatgaaagtcgaggtttgtgaatatgtgaatgtttttttgtgaatcgaaatgtgttttagttgttttttttgtgtgttagggaagagcgattatgaatttttagttcgttgggtaaagggttgatttatgaggatttgtttaattttaattagttggttaataatacggagtttttaacgtttttaggggaggaaatgaataaataggtatttgggatgaagtttattgagttcgcgggattggttgaaaggtgaatttagttggaagaagttttgatatataatgtagatattttttgatttagttttgaattagagtttttagtaaataaagttaggaaattagaatttttgggttaattttatattttataagtaacgttaaaagaaatatttattttgtgggaaggttatttggtttaggtggaataagttagacggaaaagtaaaattagttatttagatgatgggtgttttttattgattttaaatttagtaaaattgttattagaaatttttaattataatatttatgttttatttagtattttaattataaatggtttgtatatatttgagagttttttattttatggaatatttgaaattatgttgtatttaatttaattttttttagaaaattaaatattattagttatttgttttttatttgttttttggttttttggaaaaatataaaattaggatattttggtagaattaatatagtaggttaaaatttttgtaattttttagtgattttttagaaataaaagttatgtggtagtggttaagtttgtgtttagtataaaatgattaaaagtgtaaattggtaaggggttgatatagattagttttgtttttgtttttgagtttttttagcgtgtattttgtttttttattttttttgggtaatttttttgttgtagggaatatggattttttttgagagttagtggttgtgttagagttgattatgtttttaaagagttttttgagtttttttttgttttgggggaatgagaggttttgaaagttttttgtgttcgtgaaaggagtttggtttagaaggtttttattagattttggtaggattatttaggttatatataaaaaaagggaaagaggataggaaaatataggaaaaaaatgattggagaatattataatatttatttgtttttaaattagaataaatgggtagttttttataaaagttaaaatagatagtattttcgttatttggatttgtgtaggatatttatttatttatgttgttagttttattgtaaagattgaataagttatattaatgtaattttaaaaaaatagggttagattgggttttagaaataagtaatttaaagttgtttgggatatgaggggatatgaagagagagaaaagatttttgtttttgtgttaggtattttaattgatttttttagaatattttttgttcgtcgtgtttgttaacgatggtttggttaatgtagtttagtgttcgtggaggttgtatttttttaagttagttaggtattaagtattttattagtatttatggtatatttatttgtgggagaatgtaatataaaaatatattcgtcgttgtgataatttgatttgtagggaagagtaaggtttatagtgtgtttagtgggttattttgtagagggtaggtattatcgggtaagggtattggattttttgtttatttgttcgtggttttttttttttttttttgattgttgttttttagggatggggtttgggttattttattttaagtttgtttttataattgtaaaatgtggaataatttttataatttgtaaggttgttgtgagagtgatattaggtagaaggtgaatggttttttgagagttataaatggtttgtgttttgttaaatagaaggtgataatagttaagtaatgaaatgtgttaattttatttacggaaaatttttagttttattgttgaaaatttattttttttttttaggtaattatttggaggtttaggttagaggttggattaggaggattggatgtattcgcgttgtttatttttgttgttgtataaacgatttagttatagatttttttggatgggttattttgaaagggggaagttttaaagaatgcgtataaatttatatatttatttaggtgcgggatgattgtaagattattttatttatttaatttatttatattttttagtgtaaaaaagtttatttttttttattttattatttaattttgttttttgatagaaatgttagttatgtaaatttttttttattatagaggtagtgagttaagatatgcggattttttttttttgtttgaaatttatggttgagattttatgggtgagagtagaatgtgtatgaattttgtaggtatttttattttttgttttttggagtagttaatattgttttatgtttttaagtgaaaattttaagatttttttttaaaattttttttatgaagagaattacgaaggagataacgggtttacgtatagaagaagtaaattaaaaagaatttttaatttttatgttattatgtttaagtaatgtgaatatatttaggagtagagaaaagattagaaggaaatatatttttttgtttaaaatttatagttgagattttatgtatgagagtagaatgtgtacgagttttatagatatttttattttcgttttttggagtcgtaaatattgttttatttttagaggtaatgtgaaggtatattttgtttaattttgttgggaaattttgtttttaaatattattaaaatttttaagaaaaatagataaaaatagattatggtatagttttgggttttttttttattgttatttgtatttttaatttttattatggattataaatgttagagggttgtttgtagtgatagaaggaattttttaaggatttagtgatttagttttgatttatatttggaagaaagttttaagaattgtataaatttgagtaagttgagaagttgtaagttttagggttttcgattattagacgtttatttttttttttttcgtattttttgtgttttgtagtatttgattatggtttttaataataaaagtaataattattgtggaaagtttgaaaaatattgaagaatatagtaaaataaaataaatattagttttattttattatttatgtgtggatgataattgttaatattttagtatatttttttttagttttttttttatttgtggatgtatttatattgtttaaatatagtgatgtgggagttggaaattttttttaatttgttttttttgtatttaggtttattatttttttagttttttttataggaaaagttttttaaaaaattttgaagtttttatttgggaagaagtgttaaaatgttttgttaaatgtttatttcgtgaagtttgtgatagtggatttgtatgatagaaaaggttatgaaattatattttatatagatttttgaataattttgaaaatttttgtaattaagtttagttttgaatttaatatttattagaagttaaggtgagatgtaagatagtgaattgataatatagtttttagagttgtatagagttagaagagttggaaagtgaggtgagtggggaatggaggatattgtataattgttatagaattttataattttatatagaatgattaataaataattgtgtgttgagttaattagattgttgttgtagggagaagttataaaaagtttataggttatattttgtttgaggaattagggttaaattgggtatgagtttatagaatgtttaatattttttttttatttttataggggatttaggaaagaaaaaaataatttttaagtaaatatttgattgtggtaattgtggtgagagtgttggtattttttttatttattattaatttgtattttagaaagattaggtatttttttaaaaagttagtaaggttagacgtggtggtttatatttgtaattttagtattttaggaggttaaggcgggtggattacgaggttaggaggtcgagattattttggttaatatggtgaaatttcgtttttattataaatataaaaaattggttgggtgtggtggtaggtatttgtagttttagttattcgggaggttgaggtaggagaatggtttgaatttaggaggcggagtttgtagtgagcggagattgtgttattgtattttaatttgggcgatagagcgagatattgttttaaaaaaaaaaaaaaaaaaaaaaagattagtaagttttttgtaagaattgtaatatttaagtttgaaatagttttgataaaaatatatttatttttatattgagaagtttttaaatatatatatatgtgtgtgtatatatatatatatatatataattttttttttttttgaaatatagttttgttttgtcgtttaggttggagtgtagtgttgtaattttagtttattgtaatttttgttttttgggtttaattgattttcgtgttttagttttttgagtagttgggattataggtacgttttagtacgtttagttaatttttttgtatttttagtagaggtaggtttttattatgttggttaggttggttttgaatttttgattttcgtttgttttggttttttaaagtattgtgattataggcgtgagttattgtgtttggtttgatttttttttttaattttagcgaaatattggaaaatatagtaaatataagaagtaattgaatattattttttatattttaattgattgtaattgaaatataagaagtaattgaaatataagaagtaataagaagtaattgattttttatagataattattattgttaatattttggtatttgttttttgttttttttttttttttttttgtttttttttttttttttgtgttttgtgggtattattaattttttattgttgggtatttaggatttttatttgttttattataaatattgttttagtgaatatttttttagggaagtttttgtatagaatttgaattatttttttgggtatgtatttagtaaggggaggattgggttaattagtatatatatttaagatttgttttttatattattaaattggtgtatgtatatgtgagtatttaatatgtattaatgttattttgttaataatagtgtatgttttttattaaatttttattagtattttttcgtttgatattaagataaaaaaatagtattatgttttaattttattttttttataatataatgaaatataattattttttatttttatattgtatatttaaattttttttttattgaattggttgtttatgtatagtttgaggcggtttttttgatatagagtaatattttgttatatattgtatatgtttgaatatatattaggttgtttaaaataaatagttgtaagttttatattttagaaaaataatggtgtttgtgaatgggtgtatagagatagatttgaagtagatattgaagggttgtttggaagttttttgaattgatattttttattttatattaaagagaatatgtatgtagaaaaggatatattttataaatgggtagttagataattttttataaattaaatatttgtgaagttagaattaggtttaagaaatagatttatttagtattttttagtttattttgatttttgatatttaatagtatgtattttattttttatttttttgtttttaatttttttgagataggattttattttattgtttagattggagtgtagtggtgcgattatagtttattgtagttttaattttttaggtttaggtgttttttttgttttagtttttcgagtagttgggattattagtgcgtgttattatgtttggttaatttttaaaacgttttttagagatgggggttttgttgtgttgtttaggttggtttcgaatttttggttttaagtgatttttttattttagttttttaaggtgtagagattgtaggtatgagttattgtgttcggtttgttttcgaattttatagatttgttttttttttgtgtttggttttttttttttggtttatattatgtttacgagatttatttatattatatgtagttgtgtatgtttattttttttggtgtatagtatttttttgtgtggttatattataatttatgaatttgttttattgttaatggatatttggtggttttatatttttggttataaagagcgattttgtgaatattttgttatatgttttttggtgtttttggtgttgggagtagaataatatttttataaatttttttgtgtttatatttttattttttttttttttttaatattttttgagtaaagtaaagaatagtatagatttggtaatgtatagtgtttttgtttttttttgacgttatttttaggaaggatgagagtaatgaagtttttttaataaggtattgagttttgatttaaattgtagataatgattgttggtttaagattaggttattatttttaagtgaagaattatgttttatgttttgttatttttttttttattagttttttttgatttattttagtaaatggaaggtttttgaattgttttaaaaggaaggagtttattaatttgttggttttataagtaatttttttaggtttattagtttaatgaaaaataatttttggggtaagaaattggatttaggttatgtgtatgtatgagttgagtttgagagatgtattaaatttggattttgttgttgtgtgattttttggtagaattaaatagaaggtattaaaaatttttatagttgttttttattagttttatgtttgattttttttttttttttaaattttttggttgatatgagttttgaagttttgttatatttatttattagtttgtggtaaatgtagtttttattaatattaagatgaaaggttgatagttaagagaaaaaaataaaagtatgtgttatataaaaatgttttatttttttaagaaattgttagagttacgtttatttttttttttttttttttgtatgtatacggaaaaagttaaattgttaaatttttattttttaattttttaagtgtatatatatttatttaaaatttattagtaatttttaaatatatttaaattgataatttaataatttaaggagggttagatatttgttggtgtgtttttaattttatgggtatttttgtaaattatgaattattttgtattttttttatatgtatgggttaaatattaatttttatagtaatttttttgagtatggaatagatggaaaattaatgttgggagagaggaattttgtagtatggtagtttgtgtttatttgttttgtttttaatttgtttgtttattttcgtttttattgtttattgtttttagtattttgttttttattaaagaatattagttttaagttgatgaatagtaatattatgtttttaggtgataatttggtaagcgttaatagaggtataaagaattagaattaggttaggtatagtggtttatgtttgtaattttagtattttaggaggtcgaagtgggcggattatttgaggttaggagttcgagattagtttggttaatatggcgaaattcggtttttattagaaattataaaaattagttaggcgtggtggtatgtatttgtaattttagttatttggaaggttgaggtgggagaattgtttaaatttcggaggtagagggtgtagtgagtcgagattattttattgtattttagtttgggtgataagtatgaaattttatttttaaaaaaaaaaaaaatttagttggttatggtggcgtgtatttgtaattttagttatttggaatgttgaggtgggagaattgttcgaattcgggaggtagagggtgtagtgagtagagattgtgttattgtattttagtttgggagatagagtgagattttgttttaaaaaaaaaaaaaaaaaaaaaaaaaaaggaattagaattaggttggtagaatgttgttataagagatttttttttgttttttttttttttgtttgttgtttttttaattttttaattggagttatgtttttatttttggtattttgttttttggggttttattgttaaggtttatagggatgttttagtgttattttttttggggttttatttcgattagaaagatgtttgttgttttggttatttttggaagatagtaagaatagtaatagtagtaaacgtatattgttgtttttagatattttttggaagttttattatatttatttaattatttatttatttgtagaatattttattagtgtttatggtgtgtatataagagatagtagagtattgaattttagcgtttgtttttaaggattttatagtttagtgatggagatatataagtgaatagttaattattaaataaggtaagaaatgttttggtagatattgggtggaaagttgagtaggtttagaagatgggatagaaggggttgaggatggttttttatgtttagagtttttatttaggttgggtagtttggagttggttttgtagatatttgggttttatgtaaggtttgtgagtttggaagtgatatgtgtttttagaagatttttaggaaggggagtatacggaatatcgtaatttttaattttgtttttatttttattaatttgtgataagttggtttttgtatttttgatattaagatttaatatatgcgatttttggatttgttaagtatttgttttttaatgttttggatttttatttatggttttatggttttaattttgtttgtaagattagattttatatttttgattgaattatttagaatattagtatatttagtgattttataaaattgatttgtttacgtttaagaggtattttagatgtttttttttgtggttagtttaggtaggtataaaagaagtttaagatttgatattattagtagttagttatagataaggtttaaatttagaataagtagggaatgagatttttaaatgtattagtagtttatttgatttaatggtatgataaattgtatggtatagttgtgtttttatgatttaattagtgaaattaaattaatttgttattttttttttgatgtttaagtgtttatgtggaaaaatgtttttatatttgggttttaggaatatgtatttttaagggggtattttaaaaatatttttttagttttatgaaaattttgatgtttttgtatattatttgaatttttaaaatttttatgtagaaagatagtttatattggataggtaagtattatattagaatttttgttggtttttgtggtttttatagtagggatgtagggatattataatgttaaagatttgtaatagatttgttataatttattagagagcgtattttatttaatagtgatttgttttttttttttttttttttggatatagttttattttgttgtttaggtttattgtaatttttacgtttggttaatttttgtatttttagtaaatatgaggttttattatgttggttaggttggtttagaatttttgattttaagtgatttattcgttttggttttttaaagtgttggaattataggtacgtgtcgttgtttttggtttatgaatagtgatttaaaagttttattttttttatgattattttattattgtttttttttgtaatgttaagattgtttttagaatgaaagattttattataaaaaaaaaaattaaaatttttttttagatttttttaatttttatttatttatttatttatttgatatatagtttcgttttgttgtttaggttggagtgtagtggcgtgatttcggtttattgtaagttttattttttgagtttatgttatttttttgttttagtttttcgaatagttgggattatagttataggttattacgttcggttaattgtttgtatttttagtagagatggggttttatcgtgttagttaggatggtttcgattttttgattttatgattcgtttgtttcggttttttaaagtgttgggattataggcgtgagttatcgtgttcggtaattatttttatttttatttttatttttttttagataaggtttttatttgttttttaggttagagtgtagtggtatgattttggtttattgtaatttttgttttttaggtttaaggagttttttattttagttttttaagaagttgggattataggtttgcgttattatgtttagttaatttttgtatgttgtgtagagatagggttttattatgttgtttagttgttttcgaatttttgggtttaagtagtttgtttattttagttttttaaagtgttgggattataggtgtgagttattatgtttggtttttagattttttaaatagattttaatacgggaatatataattatattaaaatattagtttttaaagtttgttcgtatattgtaggggtatggataggatgtgttttagtgattattttttttatttagttattaaattagaatttgtgtttttgtatgtattttggtgtttttttagtaatgaattttaagtttatttagatagatttattataaaaggaaaaaaaaattgtataggtttggaaagtaatattttaaaattatttagattttaaagattgataaagataagtaagtaaaagattattatttgaatagagtggtcggaagattgaagtattagtatagtaaggaagttattaaattggttaaagaataatttttagaaatattgtggaaaattttaggggttaagtgtaagttagataaagttaaaaagagagatattggggttatgagatttatgatgtgtttagtggttgtgatgtgtaaaaaatagagatggtatatggttaggtacggtagtttacgtttgtaattttagtattttgggaggttgaggcgggtggattatttgaggttaggagtttaagattagtttgattaatatggtaaaattttgtttttattaaaagtataaaaaattagttaggtgtgttggcgggcgtttgtaattttagttattcgggaggttgaggtaggagaatcgtttgaatttaggagatggaggttgtagtgagtcgagatagtattattgtattttagtttgggtaataagagtaaaattttgttttaaaaaaaaaaaaagaaaagaaaatagagatggtttattagatagaggtagcgttgaatttaataaggatttagagtgaaagggtagagataattgtagttggggaaaaggtaaattagagagaggtagttatagagtagaggtttgttgttgatggagatgagtattttttggtagtgttcggaggggtgtgataagtagaggtgagatagaagagtattgtttaatgtggggtaaagaaaggtaggtgtatagagatagataatttttggtttgagtttgagtaatttatgaggtttttggtaaggaagattgtgatttgaatattatagaaggaggttagtattgtaaaagattagtgtttggatggaagatatttagtttgtgaggatagttgttatttgataggaaattttaagtttgtcgtgtagatttgaagataggttgaaaatataaaaaaaaaaaaaaaaaaaaaaaaaaaggtgtttattttttttttttttggattatttttttttaggattttagagatagtaatgtatagaaagggaaatagaaatgaattttttttaggtaagagagttttgtaaggtcgagttatttgggagttaaggagaagttgtttttttgtgataaagtaggggttgaagttgtagtggttgttaatattttgttgaatgagttttgaggtgtatttattttataggaggggtggtttcgttttttagttggtttatattaagatttttatttttgtttataggtagtagagtagataagaggaatttagtagaattgatagaattgttaggtatagtaatatagttttgattatgtttttcgtttgtcgtttttattaattttttttgggaattttcgtagaattggtttagataatgtgattaggatggaagagttttttgaatgatttggtagtagtgtagtgcgaaatttattattattttttttaaagtttttttgttaaaaaagtatatttttatttgtgttaataagatgtgaattaaagaataaagaaaaatgtagaaaaaattatatgtgtttttaatttaaattaaaggtgtaatattttagagtattagagtagttattgagattgtaaagtttagttgaatttatttttgaggggttgggttgagatcgtagtttttttgaaaatttgaattagagattttttaaattaatttttgtttaaattttttttataaaggtaagtttggtttatttttttatagttaaaatttgaagaagaggttttttttttttatggtttttatttaatgtttatattattgtttattttgtgttaattttgtagtttttgcgtttttttttaggtagttttttatttagaaaaattagtaatgtgggttttgagggtagtagttattttgtttttattttttttagaaggttagggtttatgttgggatatacggagtttttgatatggatgagtttgtatgaattgaatgtgaagaattaatttgggttggtttgtattgtttgtgttgatttagtttgttttaaattttattatttaatttttgatataagaggtggaaatatttttttagaattttgattatatttgtttttgtttttagtaaggagttttttaattatgtgggaagaggaatttttaaaattttatttttggatatgttttttttatttttattaataaatgtatgtgttatattaggttatataattgttaggtttagaattataggagattgatttgatttttgatttattaattttgtgattttggagaagttaatttttttaagtttattttcgttatttgtaggatgatattgttgtttgttttatagttattttaagattttaaagtatttatattaaatattgtggagatgatagttattttattttttgaatattttttttaggtgtgttttatagttttattaatgggtgttgttgttatattttgagataaggtaggttagaggataatacgatttttttgtaaaagattagttagtaaatgtttttagattttaataggcgatttagtttttattattatttaattttgttgttgtggttttaaaatagttgtagataatatgaaaatgaatgagtttggttgtgttttaataaaatattatttatggattttgaaatttaaattttttattatttttgtttgttgtgaaatattattttttttttggttattttttatttattaaaaagtttgagatatatttgagtttataggttgtataaaagtagttagaggatataggttgttagtaattattttaaaataatttgtttgattttttttagtaaatattgtttatggagaaataaaatgtatttttcgggaaaattttaagtgttttaagttattgtagaaaattaagtagaagggattgatgtttttaatagatatttgaagaattaagtatatttgtttagtaaatgttgatttggggtttgattagagatacgttgaagaagtgggtaaaagagatgattagttttaattatagattattaatttggagttttttttttggttgtaaaatagtagttatttttttttaagttgtttattttgatgtttggtgaaggcgtttattggtttgttgttttagaggttacggagtttttttttgtattatttttttttttaggatatttatgagaagttggttgaagttgataggagatgttttattttatataaggggaagtagtagtttaaagaaattttgtgatttgtttaatattagatatttttagtagtataggttgggtatttttgatttgaaaatttggaattttaaatgtttttaaatttgaaattttgggagtattaacgtgatgttataagtagaaaattttatatttgattttatgtgaggggttgttgttaaaattttgttttatatataaaattattagaaatattgtatgtcgtgattttaaggttatggatatgaggtgtatgtgaagtataaatgaattttgtgtttagatttgggttttatttttaagatattttattatgtatatgtaaatattttaaaatttgataaaattttaaattcgaaagatttttggttttaagtattttgaataagggatatttaatttggatatttaaggtttggaaatttaatgtttggtttagggtttaattattttgttattttgttttgtattattatatagattattaggttagtgatagtatttagtttttataaatgttatagtttataaagtttttttttatatgttattatgtttaatttttataatattttatgaagtaagaggggtaagttttattatttgtttttggtagaggaggtagttgataatttgatatattttaatgtattttgggttatatatcgattaagtgttaggagtaagtttgggagttaggttttttaattttttttattatattgtgttgttttattatattatatggtagttgatgttattaatatttaaatattaaaaaataaattgaaaaagaaataatattttgttatggttttagtttttggtagtgatttttaagtggaggtttgtgttatgagaatttttgtttttaaaatattgtatgtattttttgtaaaaggttgaatgaaatgattttagttttggtaagtggtttatgtacgtttattatttatttatttaggttttttttgttttagtttttttggttaaatgaagtattgttgtatttttattgtatattttattattaaaagaaattgaaaagacgtttgttagttttaatatcgtatggatggaaatatatttggtatatttaggaatagttataatttttaatagtgtattttaagaagtagtttggttttgtttttgattaaaaaaagagaaaatttttttaaatttgttataattcgataattatttttagttgggaagggagaatgtttttgtgttgtatgattttgattttattgatttatttagtatttttttttagttagtgggaagggattatatttttgggtagtatgaagggttttttatttgttggtaaataatttaagtaaagttgtttttaagtgtaagtttttttttttttttttgtaaattatatgtttttttaatttttggatatatgttttttttaataaattatgtgcggttttaattgttggagttattgttaagttaagtataagttaaatatttaggttgttttttgtatttaagcgtttattatagtttttttgaagatagtgttttttttgtttgtttgttttgtttttttgtaaaatagttatttagaatttggaaattttatagaaatggggaggtgtggggagaaatagggtgataagaagataatttagttatagtatgagaggtgttatttatattgtaagatattaaatgtgtttaaggtttgagtttgataaaagtaataatagcgataatagaagtagaatgagaaattcgaagaagtttttgaattatgttttatttatgattttggtttaaagtttatagttaagttcgtttgattaaagtttgtagtattttttttgacggtttttagaggaagaggtagaataattttaataatgaaaatagtttttagttgggcgcggtggtttatattacgtttgtaattttatattttgggaggtcgaggcgggtggattatttgaggttaggagtttaagattagtttggttaatattgtgaaattttgtttttattaaaaatataaaaattagttgggtgtagtgtttggtttttttttttttatgttatttaggaggttgaggtaggagaatggtttgaatttgggaggtagaggttgtagtgagttaagattgtgtttttgatttttagtttgggtaataagagtgaaagtttattttaaaaaaaaaaaaatagtttttatatgtatagatagaatagtggtaagtaaatgaatgtttttaaaaattttttatagaagttatattttaggggttaatagtaatttataatataaaggaaagttatgttaagttgggtatttatttgaagggtgattttaagttagtcgtttaatttttgttaaattttaggacgtttagttgaataattggttgatgatattgtattttggataggtttgtgaagatttagtgggattaacgtatgtggagtatatagtattggtttggcgtttagtaagtgtttaataaatgtgaggcgtagagtatagtttagtgttgttaacgtattttttatttatgtttttttagagtgggttggtaaaagttgagttaataagtttttagggagggattttagggtatttttgatattttggggaggtgtttgtatatgtataggagataattaaaatgatataattttatataggttaatttattaaaatgatataattttatataggttaattttatataaaatgatataattttatataggttaatttattaaaattttttaaagttttatattagcggggggtgttattaatatgtgtatatttagttttttgtattttagttatgttttattgttttaagggatggaataaatagtttaaagtaaggttttaatagataaatttgtgggataattttttaatttgtatgtatttaatttgaatttttttagataattatagtaaaggttatatatagaattaaaaataaaagataaataaattagttttttttgtattttaaatgattgagaaatataagttaaaaatttatataaatatttttatgttaattggtgtatttttttgatatttttttttttgtttagaaattttgtatagaaataattatatattttttttttttttattttttttcgtttaaaaattcgaatttttaaataatttagagatatggtagtttggtggttaagtgagtgaatttttggggttgtggtgtgaggaaggagagtagttagcgttatgtttgtggttatgaaggtgtgttttgtgagaggtgaaattttgtggtttttttttttttttttataggtagtatttgagttattatttgagattttgtaaaggtatagatttttgtggttaatttattagaagtaggttgtttagatataattgtgaagaattaaaaggtggtatttttatttgggttttttaaatgtatattttatagttgaggttagtgggttatagttaaagggggtttttgttgtagaaatttgattcgggtagtatttggtttttgtttagaggttgattgagtgtaggtgagttttgttgtttgttttttatgggggttatgtggtttttagttttttttggtataataatggtattatcgtgatatttaaatgtattttttaggagcgtttgatttttgtaagggtataagtatggtttttaaaatgttattaaaaatataatattattatatgtttaggtttttttatttcgtgattttttaaaaataaaaatatgtaatataaatatattagatgtagtttattaagtttgtgtttatttttgtagtttggaaaaatgttagaaaggttaggaaatagaattttgttggtgatgggaggagggtgtggatttgggaattagtatttgaaagtattgttaaaggaagaagttgttgtatatagaggtttattttttcgtgtttttaaaggaaaattaagttgtaagttttttggttatataggggttgggttagatttttagagtgataggattatttttatcggaggatgtagttaggtggtagtaatttggatattttggttttttgaataggtttgttattgtttttgtttaattgttggtcgtggatttcgttatggaattttaattgtttaggtttgtatgtgtaaagtaagaaagagagattttttattttttgtttgttaaagattaaaattgaatttttaaagaaatttcgaatatttaaatgtttatgagattgtgatttatagagagagatagttataaatgtgttattaagtaaaaggtaaaatttttgattttttagggaatttattgtattgtttttgatgttattaattaatttattttgtgtaagtagcgattggtaattaatagtagattaatagaagaagttttatgacgttgttttagaatttttaatttaagaaagagttttggtaagagtttgaaaaataaggtagatttttttttttttaaaggcgaattcgttggggtttttaagggtattgttttgtttatatttttttgtttttaagtgtatgttggatttggtaagtttttttgtagggagttttgaaagatggttagtatttttgggtttgtgtttgtatttaagtgtttgtttagggtagtgtttaattaggttatagtaattttcgttgatttcgttattagtgtttagaagtattttttcgggggtagagatggggttgtagattttttatttgtgagggtttaggggtataggaaaatgtatggaaattttatgggttatagggtatatttgttgaagttttagataagttgatagtgttatttgtttattattgttattatttttttaaaaaaaaaatataggaggtagtttgttttgtatgttattaaagttttttgttgtagtgaggggaatagttattttaggttttatattttcgtttatttgaatttttattttgttttttttgtttatttttttttattttagggattttttttgaagttgaatggagttttgtaaattgagtagttggggagtgaggtgagaattttgttttggtttgagttttaatttgttgttttttggagtaaatggtttttagtggaagttattgggatattggttagtttagattatgttttattttttggtaaaaagaatagtagaaatatgaaaataattaagttattttatggttttgatggagggtattttttttttttttttttttttttttttggagattgagttttatttttgttgtttaggttggagtgtaatggcgtgattttggtttattgtaattttcgttttttgggtttaagcgatttttttgttttagatttttaagtagttgggattataggtatgcgttattatatttggttgattttgtttttttagtagagatggggtttttttatgttggttaggttggttttgaatttttgattttgggttatttgtttatttcggttttttaaagtgttgggattataggtgtgatttattacgtttggtttgatggagagtattttttattttttttttttttattttgggattttttggttggtgaaagtaggaagagagagtaattttataatttttgagggagagttgttatttgaatttttttaaggttttaaattttgttgtagtttttttatgttgtaggtttggtagtgtagtttaaaggttgtaaataaagttgagtgtttttttttgatttatttgggtttttttttttgttattcgttattgttaatgggagatgtatgtgtagttgtataagggtaaagtttgatttcgagggtattggaaatgtttttagagtgggtattgtttgtttacgttttttggaagttaagttttagatattttagggagtagtttttggttttggtagaattgtaatttagatggaaagaggaaatattttgttttttaaaattataggaattttattttttttttttagcgtaattttgtaatgtttttgaatatatttagtttttttttttttttatttttgatttttttttggttagttttggggagaattttgaaatagggagcgaggatttggatttcgttggtttttatttaaagagtattaatatgtaaataattaaagaaataaaagttgataagatgtaataaatgaataataggaaaaaaatgaaataatgttttttgtaaatatagcgaagtaattttttgggaggaaaggagagacgattatgttttgtgttttgtttaggataggagggtggggttttaagtttttggagatatattaaaaatgtttggaatatataaagtttttggtcgagttttggagtgcggtggagagggtgtgtagtgttgagtggggtttgtgtgtatttttgcgcgtggtagggggaggattgtatttgtgcgggttttttacgtgggtttagtgtttttttatagatttgttatttgggtttttgtcggtgttttttaggagtggatttatgttgttaaaaatttaatgggagagtgttttagttttgaaattttttgtgtatagtaatgttattttttttttttttttttttttttttttattggtggtagtagtggatgttggggtatatatttaggtattattttaaaagtttatttaggaatagagtttttgttttgttaataggggatagggaggtgtggatttagtaaagtatattgggaagtttttttgtattatttatttatttgggatatgacggttagtttttgagttgggtttaatattttgttttatcgttattattgggttgttgtgaggattatatgagatgatgtaaataatgatgggaaagggttatttttttttttaaggatggggaagatgtttgtttgtgaggggtttagattagttaataatatatttatggagttttagttttgtattttaatttatttgaacgtgattttattatattatttaatatagaagttataaggttttataaatttagattttaaatatggaaatagtatttttttgttagaattttatttggttagaaatttgagtatttttcggtttttttttttatttttttttaatattttgttgttttttttttgttcgttttattttttttttattttggttggttgtaatttgagtgttatttttttgggaaagtttgatattttgattttagttttgtaatttaatgatggagagtttttttagtaaattaaatttagagttttagaatgtttattttatatttagattttgaatataaaaggtattttatattcgtaattgtttatttaatgagtaattgtagagtgtaggtcggttaagggattgagttatatgtattattattgtaagaagtatttcgaaatattagaaataggacgtaagttttgattagggagattgcgagtataattattttttttttaaatttttttgtgatattgcgggaggaaaaaggattttgaaatttgaaaggaaagagtttgtttttaattttaaaagttaggaggaaagggttttgaaatttgtttagaatttttaatttattattagtttgtttttttttttagttttaaggtatttttcgttttttgaaaagatgttaagaaatttagttataatagagagtttagttttgaatatgttttattcggtttattgaggtttaggttttagtttttgtgtggggtgaattgagttgagcggttagttggttggagagaggtgaatgaggagtcgttgtgtattcgtaaattttggtaaagaaaaaagtttatttttttttttattttataatatgtatttttgtataattttgttagtggtaatatgtggagtggagtttgtttttaagttaatatagagtatttggtttatagtaatttttgttaagtttgttttgtaattgaagttgttgttgattttgtttggggattatttgtaaaatcgtttatttagtataaattgaaataataaatttttttttttttaggttgattgtgatagggtgatattagtttgatttaatgattagtcgtttgatttttttgttggagagagaggtttgaatagggagagtttattcggaagtatttagaaagaatattaatgagtttgttaaatttagtatggttttaattatttttaatttttttaatgggagtagtattgtttgggagagggagagggagagggaggtagagagatatcgagaatgtttttagagggtttgcgtagttagagagagtttattaagagaagttggcgtaaagtagttagttagagtttggggattgtgttgtaagtattgtttgtttttttatatttcgtattttttaggttttgggataagagaggagtagtgggtattaaaatgggttttaagggaaaattaatgttaagtgggaaaagggggtgaatacgtgtattgtgagtttttaattagttaattttgttaggtgataggaggtgtttttagttagtgatgtttggtagagttttgtttttattttgaaggaattatttgaaattttttttttaagttatggatagaaaaaaataaaataaaataaaataaaaaaattcgaaatttgttttttcggttattatgagaaatcggatagatgtttgtttgtaagcgtttataagtgcgtgttcgagttttgttttatgtagtaacgtgattattttttttagatttttattgtaaacgttttaagtattgtttgtaaggattttatttttttttttttttgagtttttagtattaagaatatttgatttgatgttatttgtttttggatgagtttggaaattttgggatagtttttaaaacgtgatgttttgggtagttttttgggggtagggatttgttaatttttatttgagtatggatatgaaaagagaaggaggtataaagtgggattatgatgatagtatttaaagttatttttttttgaaagattttagtgaattgtatgtttcggtttgattttcgagtttgtagttgttaaatatagagaagcgggaatagttgttttgtgtttggttgttaaagtttattggtagatgtttttggagtagtgggttgtttgtttatatttttgtagtagatttttgtttgttgttatggtggatagtgtgtttttgttaataatttggtttggcgtagtttgtttgtattgatttttaaattttattgaataattcggtttaattgaataagattagatagttttcgttttttggtttgttgaagtggttgttaaatttataagagtaggtaggaatattgtttggaaagtgttttttttattgtatatagagtgtttttaagtttcgtagttgtttgtattgtggagtgtgtatattgttaggtttttatatgaatgttcgttaaaagtaatttggtataggaggtaaattttatgaagtatttgtttgttggagttttttttttggagcggggaggtgtggttgggtaaaattagggtagtattgattattgtaaaagtaagttttttgatggaagtttttacgtaaaaaaaatttttgtttgtatttaattttattaagggaatagtaattttaatttaattttttttatattaaaaatgtgtatttcggttattttttgttataattttaatatttatttttgttgggtgaatttttattaagaaaattattgagttaaaaggtatttttatttttatttattttttttatttcgtcgtttcgattatttttttgagtttatttttttaagaggttgggggaatggtgggaagagtttttggttagattataatttatttattatttagttatttgtgaggttggatttaaatgtttattataaatatgtagtttttaagatagggtttattatagggatgtcgttttaagagaagaaaagttaatttattttaggataattaagttaaggaaattttgttttaaatttggaataggttagtcgagtttggttatttattttttttagagaatgttaattatgtgttagagtttttttgaggaagggttttttggtttttaaatgaaggtttttttttatagaatttgtattttagtgttagaagtttattttagatttaagtttgaaataaaggttttatatagagtataaattagtggaaaatatgatttgggttatttgtaggttatgggaatttttataaaattgatataagttttagtgtttttgatatttttttgtttttacgtaattgtaaaatttttattttatagattgtgaattttttgttaatgaagtataagggtgatttattgtttaaaaatattagttagaggggaaaataaaaatgtattttgttttttgtagtttgttttaaaattgtaaggagtatggtatgaattgtttttatagagattaatgtgaatatgtgagattataggattttttttgtttttgtttttatttgatagattaaatatataatttattttttaattataaagtttgggatgaggatttgtataaaatattattaaaataatattttatagttattttgtagtagttagtaaattttttgtaaagattaaaatatattttattgttttttttgttttgtaagttatttgttaaggtaaggaatatattgtttagtttttaagttttatatataggtagaaagattaaatttgttgttggttttaggtagtttaagttttgagttaatataaatagtatttgttattttcggtttgtatttttatgtaagtttgtgtttatagttttatttttttttgaatttgaataaagttatgaaattgttaaagtattatttttatgtttattgggggagtttttagttaattatatttgttttatggattattttgaagataaatttgtatatgagaataagatgtgtttaagatttatttatttaaaatgtataataatattattatttatatttaaatatagtttttttttaagataggaataggaaacggtttttatattagatgtttaagtggtatttggatagtagttttttttttattagtatttatttgttagagtatagtttgttgattaaatgtggaatttgtttaggagtatgtagtttagagtttatgtatgatttaaagagatgaattggtttatttgttgtgggtttatataggtagtgtgatttaattttatgtatgggttttttgatttgttattatagaaaggttatttaattatatttgtagagaattatagtggagaaatggaaagtttttattgatcgaagggaattgaagtattaggaaattggaatattcgttgtatatggaatttttttaagttgttttttatatgtttgaagaaatgtatggatttattagagtatggatatatattaatattttttatattttttttttttatttttagagttattttatatttggatttttagttttattttgtgttttttttaggttttagttttgttgtatggatagaagtaggaagtattttacgagaggttttgtaggtttttatgattggtatttttatttttttttattaatgagttttttgttttatttttggttttgttaaattttttgttgggttataaatttgatttaaaataataaaatagtataaatttttggatagttttttaataggttattttttaggagtaaaggttttatattttttggagtaattagagttttagtgggtagttggaaggattttgtgttatttcggaggtttcgcgtttttaggtaggtaaagggaagttggatatgtatagttttagattggtaaaggttttagttttacgtgggatttgtaagatgttggttagtttatgagtagaaattttatgggtagatttatttagaagttggtgatgttaatttgttaatttttatattttagtttaataggtttattttttgtttttttttatttttttttgtgtatttgtgtattttggatttttatttataaataattttgtttgtaaagattttattttagttttgtagtttttaaagttgttgtgaatgagaaagatatttttttttcgggagagggatatcgagaatgagatttaattgattatggttttttaattgttttttaaagtagtttatagagttttttattttttttttttttttagaggatgaaagttttggatagatttattatagagagagaagaaacgtaattattatgtagttatagaatgtttaggggtttagtaaagttagtgaggaatttttaatatcgagtgacgagagggttttattgattaagaaagagatttatgggtttttgttatacgtggcggagttttttgtgtcgtatcgcgggacggtgtttgttatggattttaggaatggttatatggagttttattatcgtaagtgtttatgttagtcggtatttgtttaggagttatggggagggttgtgtgtgtgtgtgtgtgtgtgtgtgtgtgtgtgtgtgtgtgcgcgttttatgaagttttggtttgtataatttattaaaaggtgtaattttttttttatttttttttttattttttttattttttttttattttttttagagagagatgtttttttacgtttttaagtaatattagtttttagtggggcggtttttaggagagtggtttatttgtgattaatttatatgagatttttgttgagaagtagaattagagttattttatttaaatagatgttgtaggagaaaaatttgttgttatgaagttatgaaagtaggttgtattaagagaagtgtttaatagtcgtaatttttatttttaatgattttttaatgtaatgattttgtttatttttatttttgatggtttgtaaaaataaattttttttaataaatttgtgttaaattttttaaaatggaagatttttttttgtgttgtatttttttttttaattagcgtgttagatatattagaagttttttttttagtattaattacgtttaagaaattaattaggattttgaatttatgtatgggatggttttttttaacggtagaatataaagaaaaatgtataagggttgagtttatttttgatttgtttttagttaaaaaaatataatttggttgtggagtaatgaagtttatattgaggtgttaaagtttgtagtttttgattatagatttattattttgttaggatttagatttgttatttaattttttcggttttaattttagatgatttattgagttttagtgagggggattggtttgtgtttttttttttttatattatttagaaattttagtgttttaaggtaaaaggttattagttagatgattgattagtgaggatagttgattagtgtatgtttttttgtttaagaaagtgtttaggataaaagttaattttatttttttattagttggtttgtagtaaaggggaatgtttattttttagattaaagggtttcgtataattttaagttttagtaatcgttatttcgtattattttttttttaattagattatattgttggaaaagatggaagttatattattttttttaagtggagagagtattttttaaaaagtggttagaagtacggagggtagttttttggatttttttaagtttttgaaaaaggttataatttttttgttttaaaagtgtttgtttattttatttttgtagatatagaaataaggaggaaggttattgggtttgtttttttttttatttagggtttatttagttttattttatttatttttttttttagtaatgaaggtttaaaatagttttggtaggttttttttttgagtatatttttaagttttttgtattgtatttttatttgtgagttttttttaaatattatttatgtagaaaatgtgagggatttttatatgttttttatttgtatttatagattttagtagtagatttattttttaagaaaaatttaggttagatttttagttaaagttttttgtattgtttttgtttttatgtgtgaatataaattttttttattttatatttatgttttgttgtttttttaagatgtttattaattagtgaggtatttaattagttaggatagttgaagagtattttttttttggttgatagtagtgagtagataatcgttaattttttttttgtgttatttaatttgtagtttgtttttggttcgtttgttttaacggttttttttattgaattttttcgttttttgaggggttgggagttttttatatttgggatttttgtttttttttagcggtgtaagtgggatttattttttggatttttaatgttttattaattaatgatgggtacgggagagtttttagggggatttgaatttatttattattattttgttttgaggttatagtatttatagtggattattcgttatatttttttataatattgtttaaattagtgttaaaattatgtgataatttataaattgtataagttttttgtaattaaatggtaaatataattttgatttattattttaatgtattttttaaattggttataaattatattattatatagataatatggatgggaagttttaaagattgtatagattggtttaatatttgggaatttgggtttaaggtttagttttgttatttgttagttgtgtgattttgataagtgtgttgatttttttaggaattttttttttattgtgggatagggtgataatatgattgtttgttttatggtgtttttgtggaaattgagataatgtaaataaagtattaattaaaatttttggtatatgttaagtgttttaaatgtattaaggtagtttttttttgtttttttttttttttttttttttttttttttttttttttttttatattattattttttttttttttattattattaatatgtgataagttgattttttaagttatgtttgtgagggttgtatttgtatttgatttagtgtagattgtttttttttttttttttttttttttgttagatttggttatttgtttgtttgagattagttttttttataatatagattaagaattgagtaaattgtaaatttgtaattgtggtgtcgttagagttgtgtattgtggttttttgaatataatttttttttagttaattttagtagatcgattataatttttttttgttttgtaagtgaagaaattgtaaagattttaaatgagtttgagaagtgttaatattttaaatttttagtagaaagtgttttatgtaataaatgtaaattttaatatatgtaggaatataaaagatatagtattatttatttatattgaatatttaaagatattttaaattaagttttagtattatatgggatatgattttattttttttttagaattttgttggattatttaattttttgttagtattataagtattttttgagatattttataataaaatttatttgtttatatggatttaattatttaggtaaagttaatgattgatgtgaattgaaggtgataaattttttatgaattttttagtgtatgaagaaatgttttttttttaaaatgagatatatagttttggttatatttgtttattttgtgggtatagtttgttttagtcgtgggttttgttaataatataagcgtattgtagatttttagtagtttaagtttagaaatatttttttaggttagtttttttgtttttgagttatttgttagttttgttgagtcggttaaaagaaaagatttttttaatttagtgggttggttatgtgaatatttatagtaatttttttatttttttgtggttggaaattgtagattttttaagatgtttaatttgtgtttttatatatatgaattttgtatttttaaagtgtgggtaggttttttgtaagatcggaaaagggaaaattatttttgttttttttttttttttagaaggatatttgtaaaatttttattgtataagattttattatatttgggtatgtaatgttgtatttttagaaattgtagttaggtaaaaattaaagtattttaggttttgtggtttaaaaaaaaaagaaaaaagaaaatttagggatagcgggtattttaaatatttatagtatatgtttagaataaaatttttcggggggatacgggggtatttttttatgaagggtcgtagtggacgggttgtatattaaggcgtaaaagtagacgttttagatgtatgatttagatatggcgtggtgttgataggtttttagttataggattattggcgttttataatttgggggagcgtggtaggggttagattggaggatttgattttgtattagagttagggtaagaagttttattttttgtttaaagattttttagtaatttttttttgtttatgttttgtttgtagttaggtatttttaatcgttatttttttttgtttttattgattgttatgtatttattttttataaatttttaaaggtaggtgatataatagttaaagtatttttgtattttggtcgatatttaatttttattcgttttttttttatagaaaatatgtgttgtattgttttttgttttattgttaagagtttagtttttaaattttttttgtagggatttttgtgtaaagtttttcggatttattagttatgttatattatagggtttttgttggttttggtaaagggagtagaaagatgtttgttttttaaaaaattttaggttttttttatagttttatagttgtgtgaaggttgttttttttttgtttttaattgtttttaagtagtagttttttatggaaaatatgatttatttttttatgtaaatgttttgattgaaaatatattattggtattttttttatgttttttagtttagatgatagaattattggttgttaattagtaaaatttgaggaattagtttaaagaaaaaattttgaatttttaattggtttgtatttattttttgtggaaggttgttgtgttaagtttatttgtatttttgtgtgttaaaaaattgtatagattttttttttatttgtttgtttttatattaggtgattttttatatttttttagaaatatattttttgagtgaatggaagagaggatgtatattttatatatttaataggtatatttgtttatattttttttttttattatttaagtgttattttgagattgtgagagataaaaatgtttaagaggtataaatgaatagttttgttttgattaaattgtaaaggtagtgatagttttttgagtttttagttttttttttatttagattgttttttatatttttggagaatagttgatgagttaattagaaatgttttgttttttttcgttttttgaaaattagattgtttaattagaaagattgatgttgggttatattttgggggttttgttaggttttttgttttttaggttgttagttttgaattgtagtaagagttggagtgaggagatttaaataagtttataaatttttgtaaaattattatttgtgagtttgagaatagttttttgtttatttttgttttttttttagaaatttaatagaatgatttggtttttttttagtaatttagaggtaatgttttaagattagaaatagtgagttatttatatagttttttttttttttttttttttttggagatagagttttgttttcgtttaggttgtgtagtggcgtaatttcggtttattgtaagtttcgtttttcgggtttatgttatttttttgttttagtttttcgagtagttgggattataggtatttgttattatattcggttaattttttttttttttgtattttttagtagagacggggttttattatgttagttaggatttatagatttttaaagagttgtattgtaagataatttggagtaaagtaatatagatttagggataatttttagtgttttagatttgaattgttgttagtgaattttgattatttttgtgtttgatgcgatcgtgagtttgcgtatttttgttttaggagatagtgaatgaaattgggaattaatagtgagaaaagtttttgtagtatttagaaaaatttgttaataattttatttattaattttgaggataaatttattaaaggagattgggagaagtttgaagattatttaggttaggaagagaaagaaaagattaagagagatcgtatttttttagagaaaattatttagttttttagtgtattggtttagttttttttttttttgtcgtttggtattgtttttttttataacgatttagtttttattggttattgttttggtgttggttttgtttttgttgttttgtttgtatagttgttttttttggattagttatttgttttttttttgtttttaaattttgtttatgtttaaaggtttatttaataatttatttttttggaaagtttttaagagttattttataaggatatttttttatcgtggatatttgagtagttatgttatttttatttttaaatatattatagttatttttttgtgttgtttttatttggtggttcgattttttttggaataatgtgattagttcgaggtagtatttattttttgtgggtattaaaatttttagggtaggattggggatttatgcgtgttattatagggtagagaagttgggagttgtttagatgtttattatagttattatggaggtggaattttaggtgatttatgtttatagtttgtttattagagtggttttttgattatttgaagagatattgttgtttttgttttttttttataatttagttattgtatataatttttgatttaaatttagttatttaattttttttgagagtaggtaatgtataaagtatttatggtatatttgtatatttgtaaaatttgtatttttttattttttatttttgaggcggagttttgttttgttatttaggttggagtgtagtggtgcgattttggtttatcgtaattttcgttttttaggtttaatttatttttttgtttttattttttaagtagttgggattatagatatgtgttatttcgtttggttaatttttatatttttagtagatacggggtttcgttatgttggttacgttggttttgaatttttgattttaggtgattcgttcgtttaagttttttaaagtgttaggattataggtttgagttattttattggtataaggtagggatttcgattttttggaataagttggtattttatttatagatttggatggggatcgtaattttaagtattgtaagattaatataggagagttgttttttttttatgatatttatttggtatcgaataagtaggtattttttttgtggttaaggggagtatgatgtttgtttgtttttttttaaattttagtgatgtattttgtttttaatagtttttaggtaatttatattttggtaatatttttttaatttagtatttaagtatgcgtttgatttatgttgatgggaggttttatttgtaatttagtttaggattatgaatttagttgtttaaagattttatgtaattatttattttttttaatttggtatttatttaaatggtatttttttagtagttgtttgtgattttttttttttcgttttttttttttttgttttttttttttttttttttttagagtaaagtatgagaaatagtaatttttgttattttatagttatttgttaatagttttttttttcgtttttttaatagaggtaatattattttcggtttttttttttttttttgtataattaaagaatgttatttttgatgttttttgaagttgtaattttttattttgttttagtttttttgattttatatttgtaaatttgtgttgtatttttatagtttttagggaaagggtttgatttttttttgtgtgttgtttatagtttgggttaatttagagtaatcgatttggtattttattgtttttttttttttgttttttgatatagtttggatttttgttgtacgttttgaaaaggatttaatttttttaattttttaagttattaaatttgggtttattttataatggattgtttttattattttaatgtttttattttttttgaggggggttaggttttttattaattttagttttttaatgagttttttttttttagattaaaataaagtaagattttatttgatttttttagttatttatttttgtgtttattttgttagttatgtattaattgagtatttgtttattgagtgttatttaagtgttaaatagtgttgaataaaatgagtaagtgtttgtttttgttgagttttaggttatcgaaaagttaatataagggagttgttaggggagagagagtgaggagttttttgggagtaggtgagggatttatttagttttggtagtttagaaggtttttcggaggaggtgatatttgaaagaggtgaggaaagagtaatttaggtaaaaaggagtatttgttaaggtttggaagttaaaggaagaattgatatttgtaggatttgagaagaatttttgtggttggagggtgaattttaggagggaagtggtaaagatagggtttaagaggtttaggttagtaggtttttgtgaggagttgtttgttttttttttgtaagagtttggggtgattattaagatttgttttatggttttttgtatatttaaatagatttttgggtttttaattatttatttagaatttttttattgtagaattgaatttatttttgtttttaatttgatagcgtgcgattttatcgtaggttatagggttttttttttaggcgtttttggttgggttgttgttttattggtttttaaggatgtgttgttgtatttttttgtgtagtaggttatatatatatttttttgagatggagtttcgtttttgttgtttaggttggagtgtaatggtgtgatttcggtttatcgtaatttttgtttttcgggtttaagtgatttttttgttttagttttttgagtagttgggattataggtatgtgttattatgttacgttaattttgtatttttagtagagatggagttttattatgttgtttaggttagttttgaatttttaattttaagtgatttgttcgtttcggttttttaaagtgttgggattataggcgtgagttattatgtttagttagtaggttatattttttttttaagataatataatttatttttatttgtttttaattgttgagttgttttgtaataggtaattttaattattataatattttgattataaagtataaataaaaaatataggaaataattgtggtttcgtttttaaagaattaatagtgttttgtattaaggtatattttaatttttatttatagtgtttaaaatgaaaaaaaaaagtattgagttttattttattggaaaatttttaaatgtttttatattagttaagttagagaaattgtgtagtagggttaggttgaggttggagatagggtttagaaataattaagtgaaatttagttgggaaatttagtagttaatattattaggggagtatgagaataaagattggtattagtggatgagtttgtaatttagttaggattgaaagagttttaggggagaggatgggatttcggaggagatttgtgttatgttttttagggagtcgtaggtttaattagtggatattgtgaggattaaagggagtttattttaggaagcggggtgtttacgtcgtttattggggggatttagatttgtattttgattgtgtttttgttttgtgagtggagtaaaaggaggtgtttgttttttaggtaatttagataagagtagagaagtgtacgtgggggatgttgagaagtaaatgttagttttttttttggtttgttttcgtggaataagtttgtttttaaatggggtaagattttatattttttttttttttttttatttttgtgttttttttttgtaagaaatttattttttttttttttaggggtgaagggaaattaatatataatggtagtttttttgtgatttcgttttttgttagagaatttgtgatttattttaatttggtgtttgtgattttagtttggtttagtgaatttgattaagtgggttgattttttgattaaatgtgtagtttattttttatatataggtttgtgagatgtatttttatgtagtttttattttttatgatgaatgatgttttaaatgtagtatgtgtttattatattgttatagatcgatgatgtgggagatagtgaataattggagatatttgagtgtttttgggggatttagtttttttgataatattgttgacgtgatttgtttcgagttttattttattaagtatatgatgtatgatatttatttttattaaaaaattttgtgtagtgttttgagagtttgttgtgagttagatattattttaggttttgaggggttagcgtttgttaaaataaattaggtttttgtttttaaagttgatatattagttagaagagatatataataaatatttaggtagagttttaataagaagatataggttgagtattttttatttgaaatgtttaggattagaagtgttttagattttagattttgaatatttgtatatatagaatgagatattttggagatgaaatttaagtttatataaataatttatttatgttttatatatattttttttatatagttttaaggcgattttatgtagtattttaaaataattttatgtatgaaataattttagttgtattttgattatgatttattatatgaggtcggttaggtgtggaattttttatttgtggtattattttagtttttagagttttggattttggagtattttagatttttagattagggatatttaatttatagttggtggtgttttgagggtaataaattaggtgatgtgttagagagagatttgggtaggaatgttgtgttttaggttaggtgggtggggtagggaaagttttgtttaggaggtgtttttgtagttagaataattgaataaaaaaagagaagttgttttgggagatttgagggagagtattttattgaaaggtttgtcgtgaaaaagtattaggagcggagagtatgttaatgtggttattggttaggggttgggatagtagggggagatgagattgagggattttgtgggttaataaaaagttagtggaagaagtgttgtgatttgatttttattttagggttgttattttggttggtgtgtagtgacgtttgtgaaggtatggaatgtggaattagggaggtgatttagtaggttgttgttgtagtggtttaggtgggaaatgatttttgttgaaatgatagttagtagaaagtaagttttttgtttgtattataatgttatgttatgggttttgtttttgaagttattaaatttttataaaataattttatgagcggttgttatgatttttttttttgatatatgaggaaattgagatttggtaaagttaagtaagttgtttatttttacgtggtttggaagtggttgaattgaggtttgaattcggtttattggttttagaatttagattttttatttatgttttataacggatgagattttaaaatgatagtttagatttgtgtaagagcgtggttaggttgttagtggtttgggattagtttagttggggagtgtttggaaattatgttttggaatttaggtggtggtattgttagttttgggtaggggtttggagtataagggtgtagaattagggaaggtaggttaaatgttatttcggtgtttaggttttgtttttatgtattttagtgttagagaggtaggaattggtttttgttatttttgtttttttcgtgttttaggtgttgggttgtaggggagaatgagatatttttttttattttgttaattgatattttgtaaagaatttaatattattttatttagaagttaaaaatggggaagtttgtggttttttttgtatttttatgttttggaggatgtaagagttggtatatagtagtaattattattataggttatatgtgtgatattttttatgtgttaagtattgggttgaggattttattatgtgattttttttagtttttatataaatttatttagtatttgaattataattatggagattatatagtttgtttatggtgttggtttgagtttggattttagatttcggttttgtaattgagaaacggaggtttacgtgtattttttttttagttgttttataaaacgttgttttttttatggtgtttttgttgtttttatatttgtttcgttaatggtgtagtggtttttggaagatgggttgtttttttggattaaagattttaatttattatgtgaaattttagtttttaagaatagtttgtataataattggagtttttatatgttaatagataatataagttagtatttggttttatttaggtatttttggggattagttttattagttatatagagtttattgtaagatttttaattgtttttatatgtggttttatatagggttgtaaattattttgttttatttaggggaggaggtggtgggaagatagtattttttttgtttataaatatatttaatgtttatatgtggtagggggagagaaagagaaaaaaagtgagagagagagatagagagaaaatagtttttttttataaaggtattttggtatttaatagtttcgttaatatggatagtttatgttttttgattttggtgttttagataaattaaaagaattttaagtatgatgaagaggttggaggaatgatttatgagaaaagattaaaaggattgagtatagatagtagggttcgtgtaggttaaagatagatatggaaatttttaattaataatttaaagaaatatatgttaaggaaggttaagattgatatagagagttttgagtagaaaatttgtgaaaatagtaagaagaagattattgggatttttttttgtttttgggatttgtaagtaggattgatatttgttttaaagataaatatgagatatttgtttggatttgtataaagtaatgttttaggggatttgatttgatttgagatatatttggtttgtgagataaagatatatgttgtggtaatgtttttttgttatattaggaaaataagaaaaggtaatattgagatttttaagagtgattataatattttgagatatagttagttagaatagtttaaagattatgaaaaattgttataaggtttttagagaagttagagggatgaatttttagatttttttattggttttttaatattaattgagttttatatatagtagaataaaagatatgattttagcgttttagattttataatttggggagagaaaataagaaataatatatgaaataattaagttgtatattaataagtgtaaaatagtaagataaaaggtaggatttagatttggtgacggtgattttagattttaagggggtttttataatagagttttgattttatggtaaatttaaatatattatgaaatttttttaattaatatttttttttttttttttaaatattaaatttatggattttgagaaatttatataatatatatgtcgatgttgcgttttttttttgtttgattcgttttagtttttattaagtttaatgtttgatttttattaatttatgaggagttgtgaattgtaatttgaaatgtttttttgaattttagagtttttttgtagggaaaattttacgtgagtttattttgatttttgttaatattttagttaagtatatagtttattgtttaatgattttttaaggttttttagtgatgttggtacgtgttgttatattttgagggtggtgcgtagttagtttttgttagtgttgattttattttgttttatatttgatttattaaatttgagagtttatagtatgtttaatttagtatatagtttttgtttttaaaatttaataaatttagaagtaataaattttttgggtttttgtgggtttgttttttgagttagggtagttaaaagttgtatttggtatgttttgtttattatagcggttacggaaagtgtttttttttttttttttgtgtttttttatgggtttatagtaatagggaattgattttaggatatgaatcgtttagtttttggtcgttaacgttagatgttttttatatacgagttttttttatgtatagttatttgaagttaatatttcgtattggtgattatgtatttttatgtttgggagcgtagatattagattgttggattgtgtgtgaaatagtttatttgagatgttatttttggggattatttattttattgttaggataaaagatttttgagatttattttagagtttttttttggaaatgtatgttaataggatttttttttttttttttttttttttgagatagagtttcgttttgttgtttaggttggagtgtagtggtataatttcggtttattgtaatttttattttttaagtttaattaatttttttgttttagttttttaagtagatgggattatgggtacgcgatattacgtcggttaatttttgtatttatagtagatacggtgttttattatattgtttaggttagtttcgaatttttgattttaggtgatttgtttgtttgggttttttaaagtgttaggattataggtaggagttattacgtttagttaggatgtttttaatttttttttttttttggtaatggtgtagttttgtttttttgatgttatatttttgttattaatttttagattttttgaagtgttttttttataatgagttattaggtgagtaagattttaaggtatagtttttttttttttttttgttgttttttatttagagtattaagattttaattagaaattttattatgtagagtttgataggaaagttgtgattggttttatttttgaaaagagttaggatttagtggggtgatgatgtagtgttagtttttttgttttgtgaattttttgattttagtgtttggagggaattcggtgtaattaggagtgaggtttggagtttgattggttgagaagttttataggttgtattgtttgggttttggaagtaaatgaatttggaggtatcggtaatattaatgtttgagtgtgttttgtcgtttatttgtttttatttagttaatgatatttgagattaaggtaaaatattgatttattttagagttttttgttttatttgaatgttaatttagttttgttaagagttaaagtagaaatagagttgttttaaggagttataagtttgttttttttttatttaagtaagttgatgatatgagagaatgtttttgtataagttttatttttattaaataaattttattttttaaagttaatttttaaaaaaaagtattttttttaggaattaatattgaaggttttttggtgttttgaaattgtaggagagggttttggtgtagaggattatggtgttagtaataatggaatatggtgatgtgtaaagatttgaagtaaatgattattgatagggtggtaggtgaagattatttgtgtttttttttttgagtttattttatgtttaaatattttttagggttttttttttagttttagtttaatgttttttaagatgatgttttgttaaatgttttataaaattaatttgtttatgttggtttatttttgattagtggtgttagatttggttgaataattggggttaattttttgaggattttagaattgaatgataattgtgaggttgtaagtttgtaatttattgagaggttataaagagatgttattagaatttttttttagagtaatattttaaaattgggatgttaagttaggtagaagtaaagttttttttttgaaatggatttgaaaaagttaaattttttttttttatatgcgatgattatttgattattttaatattagtttgttgtttttttaggaaagatttagtaagaaagaaattttgaagttttttttataatttaatattttttattatatttgatgataattattatgtataagttaatatatgtttattttaataaattatgaagtcggtcgggcgcggtggtttacgtttgtaattttagtattttgggaggttaaggcgggcggattaggaggttaggagatcgagattattttggttaatatggtgaaattttatttttattaaaaatataaaaaattagtcgggcgtagtggcgggcgtttgtagttttagttattcgggaggttgaggtaggagaatggcgtgaatttaggaggcggagtttgtagtgagtcgagattgaattattgtattttagtttgggcgatagagcgagtttttattttaaaaataaataaataaatgaataaataaataaataaataaataatgaagttttgaagattttggaatggaaagttatagtggtttatttttttttttttaattttagttttaggggtatttgttattgtttttgttttagtttttttggtaaataattattataattttagaatgtgtttatatttttatattttgatatgttaattttagatattttttatgtaatatattgattttgaaatgagaaagttaatttttaatttttaatattttgttttttttttttaatattgatattatattattatttgtatattgggtgtttttataattttaaagagtgttgtaagttttttttttttttttttattagttttttatagtaaaacgagtaagatgttaggttttttgtgttatttatattttattttttggagttagtttttttattatagtgttagggttgttaatatgtttgtggggttttattattataattatatttgttatgtttttgtttatagattgatttttaaagttgaagatttagaaagtatttatagtattatggttgtggaaattttttgtgttgaattagtagaatgttaagattatatttaattttttgtgttagtttagtttttaaatttttaaattatttaatggcgatgtgtttagtattacgaataagtgttttatttatatttattttttaattgtttttttatttattatgttgttttttggtagttgatttagttttttttttattatttgtttttataatagttttatatttttttattttttaattttttaattatattttttgtatttaagggaaagttttttttttttttggttaatttatttttttgagaagtttgaacgaggaatttttagatatttttttgtgattttttggattggaattattgttttttaggttttacgattttaattttgttatttttaatttatttttttattttattggaatatattaagtaattttttaataatagtggaggtagaatttttgagtttttgtgtttgtgaaattttttttattttgtttttgtttttttttgatggtgtagttagaattttaatttaaaaggtttttttataagattttttaaggtattattatattttttattattatttaaagttgtagatgagaagtttgatgtttttttgatttgtatttttttgtagatggtttattttttttttttttggaaatttttgggatttttttatttttagtggtttgaaagtatgtatttagatgtgttttaatttaatttttatttttattaattttgtttatttttttatggattatttgaatttgaagatttattcgttaattttatggatgatttttattttatttttaataattttatttgttgtgtttttttttttttttttttttaaaattttatatagttgattgttagattttttaggttatttttgtgtgtttttttttttttttttgatattttgtatgtttttgtttttggttttgtgttttgggaaatttttttgattttattttttattgttttatattatttttaattttttgtagttataattttaatttttaagaattttaagaaattttttattgaaatttttttttaatattttgtttttgttttttgtatgtaatgttttttaaaattttttaaaagttttttttaaggttagttttttttgttgatattggttatttttatttttgtttttttttttttttataaaatttagtgatttttgggtgttattttttaaaatcgtggagaaggatagttggtttaatgttgttttgtttggtatatggaaatttggatggatggatggaatattttgattacgtgtattagttggtaggattttttttagggaaatagggtggagtttttttatatgttagaacgaagagggtttgattttggggagttataagaatcggtatggtttgggtattaataagggtgttatattaatttgttgggattaatattagaagttagagttggtgtgatttttgtggtgagtgtatttgtgtgatagatttgggtggaaatagggttttaaaatttacgttgaagtttttatttttttaggaaagtttattttgttttttgaaaaagagttataaaatttttatttggagaaatgttagttatttgtgtttatgtgttgtgggtaggagataggttatttgattgttacgggtgtgttcggtaaaagatttgtttagtttagggttttttttttttttgttttttagatggagtttcggtttgtcgtttaggttggagtgtagtggcgcgatttcggtttaatgtaagtttcgtttttcgggtttaagtagttttttgttttagtttttttagtggttgagattataggcgttcgttattttatttagttaatttttttgtatttttggtagagacggggttttattattttggttaggttggttttgtatttttgatttcgtgattttttcgtttcggttttttaaagtgttgggattataggcgtgagttatcgcgtttaatttagtttatggttttttaggtgaattagttgttatttgtttttttgtttttttgaagaatattttaggttgttgtttttttacgtattatgtttatttataattttagttttatttattatgtattttgtagaaatgggttgaaattttttattttaattttatgtatttttttgattgtgttaagagttttatttatagatttagattgttttagtttaaattttaattttgttatttttaataatgtgattatgggtaaattatttagtttttttgagtttttatttttttatatatatagtggggtcgggagtagttttgatattatgggttcgttttgaggattaaattatttaatataaataaagtttttagaagtgtttagtatagagtaagggtttggtaaattttattttttggtattgttattttattattattataaaatttatttttagttttttattttatagaagtttttggagggataggtgagaaatatgtttgtttagtttgttattttgaattggaaatgatggattaaatatgttgtatttttgttagattgtaatagtgttagttaaatttaagatttaggtttatttttgttattttttggtagtgtgattttgagtaagtttttagatattggattggtttttttatttttaaaatgggagtggaaatggtagtcgtatagggtgataataggaattaagggagataatttgttaagatttatggatttttatttttattattatttttttgatgttttggtttttattttaaaaaaaaaatattgatatattaaggacggtttatgggttgtttgattgatagtttttttttttgtatatttaagattttttttgatgttgttgaatttttttttataatttttttatttttagtttttaagatgtattttattttttttatgattttataaatttgagaagtttgaaaataaatgaatttaattttaaatttttatttaaaaattaggtatgtattatattttatagaattatttataaagattaaagaggtagttttttaaagatagtgatttaaaagttaaaaagttttttgaaaattttattttttgttattggaagagttagttttttattttttgagaaaaatgttattttttatttttttttaattaaatggattaaaaatagtaataattatatttaattggtagtatttaatagaaatatatgataggttgatagaaatttaaattaaataattgaattttggttaatattataatagataattaaagtgggtgatgttgttaaattgtgttttaaattgagtgtttttttattatagattggttatttaggtaagtttttttttaaatatttttttatatatgtatattttttttgattttatttttttattgtatattaagtttatttgaagatatttgattggtattttgttttaaatttgttttttttttttttttttttttttttttttttttttgagttagggttttgttttgtcgtttaggttggagtgtggtggttcgattatggtttattgtaattttcgttttttgttttttgggtttaagtaatttttttgttttagttttttgagtagttgggattataggtatgtgttattatatttggttaataattttgtattttttttatagagatagagttttgttatgttgtttaggttggtttttaatttttgagtttaagtaatttgttgttttggttttttaaagtgttgggattataggcgatagttattgtattaggttttatatttgttttttaatatggtttattttaatgtttattgtattgtttaaaaattatgaatttggagaaataaaaatacgttgtaaaatttaggttgttttaaaattggaaaagttatttttagtttgttttaaatattattggagtttaaatattttaagttggtattgtattgaaataggttatttttttatagaaattggttttgtttaagaaatgggtatagtgaattatggggatgtatgtgtgttgtttaaaggtattatagtttgtaaatagttttgtaagttagattttattgagaagagggaagtgggtagatttatgagttttaaatatatgttgtttattttatatgaagtatatgttagtgtgttttttttttaaattatgtatttttgaaaaatgtgtaatgggttgtggtgttagagaaaaatatttttattttagtttggatagaagagtatgaggtagtttgtttattgtaagtttgggattagttttgaggttcgtttattgttgggtttttttggtcgaagttaaaaaggtttgttattagaaggagtgtttgtaattaagagttatgttagaagtgggaagataggttgttatttagagaataagattgtgtggttgaaagttggtgaaaaattgaaagttaaaaaaatttaaattgaaagagttggaatagttttagagttgaggaggttatatcgagtgtgggagtgtaaagtgtagatggtttaggggttggttgtggattgacgttcgttattgggtttttttttggggtttttatttttttgggttggagatagttttgtaatttagaaataggaaggttatagttttttagttttttaggttgatttttttttaataagtgggttttggaatttagattaaagtttagagtagaagaatgttgttatggtagttatagaattgttggtttatgttaagtgaggtgtatatttttttgaaaattttaaatattgtgtagataaaatataagattatgatataagatagtgtggttatgtgattttttgtaggatatattatatggttgattttggttttttttatttattgtttattaggaaatttagattgttgtttttaggaaatttagattattagttgtttagttattttaattttattggattgcggtttgtatatttttttttaattttttttaggttttgattatttaaattgttttttgattagatttttttttagttagtattttttattttgtgaatttttgtatgttggttgaaatttttaatgaaatgaggtaaagtattaaaattatattattttagattatttgttgaggtatgttataattttatttagtatgagaaatagttatataggtgagcgttgttaaagtaatgtgtgtagatagatttgtgtgatagaataagtggatgttgagaagttttgtgttgaatgaatttgattatagtagttttttttttttttaaatgttagaattttttagagaaatataggtattatttttttttttggtatgatttggaaaagttagtatttttagttttttagaaaggttttagagggaattgttttattatttaggttttaaattttttttatttgtagtatatgtgtgttttaaatattttttttttttatttttttaaaaaaattttttttaagttgaattaggtttaaggatatttgtgtgttgttgtttttttaagttttaatgtgtagtgattttgtaagtaagttttaatattttagtatttatatttgtattttttttgtgaaaatatgtgattttattaatcgagttttgtatgattattttttgtgtttttgagttattttagatatgtagtttttttattttggcgtttagttttatcgaattttattgtatagagtttgtacgtaaatgtcgtttatagttatatttttaaaaataagaggtttgttttttgaggatagttttgtattatgggtagagtataattttgaatattgtttttttttgtttttaaatggttggggatagtgagttaggagtgagaattttttttgttttatgtcgtgtgtatggtaggggaagaatgtcgtagggtagaaaatgaagaaagatataaaaggattttagtttaaggaggttagatttattagaggtttagcgttgtttttaaagatgtttgggataggtggtagtttaagataattatagtagtggtgttcgttggagtcgagataagggattgtcgtggaagtttgttatttgttgttcgtttgttttgatgtaattttgttagtaagatttgggggagtagatgattgttttttttcgtggtttgttgttgttgtttagttttttaaggttttattatagtgttttttgaggattaattttttttaaggtttatatgagatggttttgtttaagggtttagatagggattttggcgttatttgtataaggtattatggtaggtttttttttttttttatttttttaagttgttggtatttataaatatttgttagcgtgaggattgtaagtatgtagtattttttgttgatttttgttgtgtttttgttattgtgcgagtaatatcgttagtattaaattgttagtttttatttttttattttattttttgttaattgtgttttttttttgaaagaaaatttgttgtagtttggttgtagaagggattgttgagtttttttgatttattgtttttatgaaatatttatttgtataatttgtatttatttggaatattttattttaaaaatatattttttgagcgagtaaattaaatcgttagattttattagatttgttattttaaatattattatttaggaaaagaaaagtggtagattttatttttgattttttttatatatatagtagtattaatggtaataattaaagtaaaaattattttttgagttttagaaataaattttgtttcgatattttgaatttttagttgaataaagtattttattgttatttaaaattttttaagtggtatttgaaggtaagtaagtcgggaattttgagattagtatttgaatttggttttatgatattgtatttggttttttatatttggttggggatagagatgattttgagaattattaatagtatacggacgttttttattttttggttagtggtttagggtaattttttgttgttagtaattaaaaggtaatttatatttaattgattgtatttgtttagttttttcggtgttggtttggttttgtaggaagaggagtatttagaattaaaacgagtattataattggtatatagttttataataagtgtcgtttatattttttgtaggttagattttttataaatttgaaataatttttaaaataatagtagaaataagttaagtttttgtagttagtttagttagggaaaaagatatagttatataggttatttgatattttatagataagtatgtgtttggtttttaaatttttgtaaaggattgttttgtggtgtgtttatattgattgatagttattaaaaggaaaattattttttgagatggtttattttaagggtaatttttttttatttatgagtgagtaaataatggaaggtaagataagatagtggggagaggtagttgcggtgggagagtcgaataaagtagaatgatgattcggtgggtattaggggttttgtttttgaaggtgattttttaaattgtagtaatagaattaattttgcgaattttggtgtgattatgtagtattttggtttcgtgttagatttttgaattagaatttttgagaattggattttaggttttgtgtttttaataagtttttaaataatgaagtgtgagaattattgtttttaaaggttagatgttaattttaatttttttaagtttttagttggtaagtatttatatttttcgttttaaaaagattttgtatatttgtatagttagttgtggtatattagattattttttgaattatattttatttttggtaattatttaaaaataaaattgaatatttatgatgatattaatttagtattttttttaataagtaaagatggaatattagttattttatgttatggagaatttttatttattttttaagtgttgtgtttaaattgaattaataataagaagtaaggataatttgtataattacgtttttgtatttttgaatttttttttaggaaatagaaatatatatatttttgtatgtattttaatgcgtatgtattttggtgtgtattgttaataaaaatatagattttattaaatatgaaattgtttttatttgttagaaaaattattaagtttgtgaattagttttttattattattttttggttaagatattgtatgttttttaaaggaaggttttattgttgagattagtagatttaggatgtagaaatgttggttgagtgtaatttttttttcggaaatgtgaaaatagagttattaattattggtgaaaaaagtgttggtttggtttgtttaattgttttattaaagtggaagatgttaatttaagggatgagtaatatatattttagatatacgtatttgaaataaatgtcgataatggatttgttaattgattttatcgatatgaatgttaatattttgttagtatttgtgataattataagaaaatagtagaggtgtagaatataataaaaagtttgaagtagtataagttttgtaattaatatttagatttatttttttggatattttgatcgtaaggtttaaaagatatttttgcgtgttttagtaaaaatattttgtatttaataattttttattttgtttaggttttaggaaaatttgattattagaaagttaggtgttttttttgatttagtatttggtatagaggggattattatagttggttttttttatttagttttattagttgattattttttagaatatatttgatttgtatatgtttttaataaagaaaagataggtgttggtgatttggttttttggaggaaaattagatgtgattttggaattagaaaggataggattttagttttagttttttgttggttgatttgtgtaagttatttaattttttagttttttttttgatattaagtatttgttttagatgattgtatgagggtcgagtatttggatttagatattgatattttatatgtattttgttatgagagtttatattggtatgaagttttttttttttttaagtgattgaagtttgaatatttgaggtatagaatagtttagttttttgttttaataatattatttttggttaatttgtggttatatttatagattttatggtttttttttaataaaaattataaaaaatttgattttatgtgattaggaggtgagggttttataattggaaagattgtgtgaaagttaggatttttttaataaaatatatatatataaaatataaattatatataatatatgatatatattaatatatataagtatgttatttgattttttggtttggtttatttttattaaatagtattttttattttaatatttttttagggtttttaatttatttgtttttatgttatagatattgggagataatttgtttgtatgttttttgatttaaagttataggtgtggaagtttgggaggtaatggtttttaagttaaggggagaggggattggttgttatttttgttgttagttttagaaattttttatttgttgtggttatttggtattttttaattttaagatttggggtttatttattattaatgttgaatttaagataattagagttgttgtgttgagggatagagaagtatatattagtttttgttattgttttttggttttattttgatttaaaataatagtagttggtatttaatgggtgtttattgtttaggtgggtgtatttttgatggagggggaggaggtggggatatgaggattttgtatttttaagaagagtagatatataaattggaagttgttattttttagtttggtgtatttatttagatttttaagggatattagatggaaggaaaagtaggtaaagattaatgtggaagagagggtaggggtttgggaattttatatggagataatgttgttagttatatatttaagtaggttgtaattaataattgttgattaaaataatatatattggtatttcgtttttgttatttgttattttgggggtaggggtagtaggtatcgtttatttttattgtattaaatttttgtttatttgttttttagattagtatttattaatatgtggttttaggatacgtagtatttgtatttttagggaatttgttagaaatggtattttttgtgtattttttttgttttattgaattagaaatttttgggttgggatttagtaatttgtgttaataagttttttaggtaaagttgatgtagcgaaagtttgagattattgtgttaaggagtattacgtagaataatttgggtttgttattaagaggggaatattgaggtaggtggggaggtgtgatttaagtcgaagagggaaagagagtcgtttgtttggttttttttgattttttgttattggtaaattaaaatttaaagtagttgatggtataggaatttagatgtaggagttagtgaatataatatttttttttggtggtggtttgtttaagttatttttttattaagttgtaattttttgagtttgttattttatattttatgaatatgtgtttatttagtatttaggtttgtaggcggtaatttaagaataataatagaaattttatgggagaaaatgataattgttgatttttaaatattggatttatggaaatttatgaatgtagaaaaaaagttaagttttataagattaaattagaatagtatatttggagttatgtttatgtattaattttaagttaagtaagaggtagtagttatttagagtatatgtttaattttagttttttttttatattttttgaaatattgttttgtttttttaatttaaagaaatgaaaagaattaagtattttatttttttttataagatattaaggagagggggtaataaatagtatttcgtcgatgtattttaataaatattggtttattgtattttataacggaaagtaaatatatgtaattatttgtaaatttttttagtgtttgtatttataaatttttgtttaaatttttttagttgggagtttagttagtttttttgttgtggaattagggttttgtttttttgtttaatttcggtataagttggaataatttagaaacgtattagagagattgttgtttttaaaaggtataaggaaataatttttattttcggttttagagaaattagtttaattagagttcgggtagatttttcgattaaataaagaattaattgtgtataaattgtattttaataatttgtaaggtgtttattttagaaatgttttgtatatggaaagttgatattttttaattagggtagtggggttgttaaagttaaaatgtcgttagtatttttttattattttatataattattatttttcgtaaattaaatttaaagttgtatttataagtagtttttagttttgagatttatggtatcgggttgttaaatatagatggagataattttttttataagtgcgagggtttagggcgtgtgtgcgtgtgtttgtgagtttgtgtggatgattcgatttatttggaatatattttcgggagttttgggttgttaagttttattttagtaaattttatattgggaattaaatagggggtagaaagttattgtatttaatgttgttgtgattttttttgtttttagttaaattatttagaaattaaagttaggtttttgtgttattgtggaatgttgtttagaatggattttttaagagggatttagtagatttttgttgattgttaagagatgtttttgttaaatcgttatttttgtggtatttttagaaaagtgattgtatttttttataggaaatttgggaatattttattttgtgttagttttttatttgttttgtttgaggtatttttgttttttaatgtagggaagggatttagttgatataataagtaggtatttttaagttttaatgtttagggtaagaattttttaaattttagtatttattttaagaagagagtgtatattatagttggttttggttacgttattttggtttgaatttgatagttttatatttttagtgtagtagaataattaagggtgttggtaaggatggtttgggatggttaagagtaaatagaaattatagtttttgggttttatagaaattttgagattttttacgtgatttaaaaatcggtcgaggaaaaatattgaaaattgttttttttatatgttttttttggtttttttgttttgtttatatagaaatgtagatataggatatatttattgataagatttttttttttaatagaagtcggaatgaaagaatatagtgcgggagttagaggtttcggttttttttgttggtgtgttttgttttgttttttttttttttggttgagttttgttatttgtaggtgagggaagtttttattagttttgtttgttttttatagttttggttgtttttaaggttgtaggaggtttatatggagagtggttgaaggagttttgttgaattgtgaaagggttatttaaatggtgtttttttttttatagttttgggttttacgatgttgagtttgaaagagtttgaaagagttcgttttttttttaaaatagtgatttgttgggttttgatttatagttattttatgtacgttaggagtttttaaatagtggtgatagtttgttattttatgtttattgtgttaaatgagtaagttaagttggtgagaatttaaatttggaaattagaaggttattgggttttttggttgtagcggaagtggtgtagtgttaaggtgttaagatgattacgttattttggtttgaatttgatagttttatatttttagtgaagtagaataattaagggtgttggtaaggatggtttgggatgtttaagagcgaaaagaaattatggttttttgggttttatagaaattttgagattttttacgtgaattaaaaattaatttaagaaaaatattgaaaattgggggttaggggtttttagttgttgtgtgttagatttggtgtgattagaaggtttattttgagttatggtattgttattttttagttttttattttttttaaattttgtatttattatttgaaaattgaggataagtatattgtttttttagatttgttgtggagaatttagtgagaaaggaaataaaaattgtttagtttatagttaggattttgaatttaacgttgttattcgtggaaattatttgggatttaatatgtatattaagaaaataaaaaataatggaaaggtgaaaaagtttttgagtgtattttattaagatgattaagttttaaaggggatgagaatatttgtaaattcgaagttggtattttgagtttttattaaaaagaaaaaaatttttgtatgaaaggtaaatttattttatttttttttgttaagtgtttgagagggttttttgatagttttggtttattaagtatattttgataattttatttgtagtgttagataatgaattttatcgttagagtggatatttaattaattatggtgtcgtttttttatggagatagcggtagttatttaagggttagtatttttttgattacggaatttgtagtgatatgtagggtgggaaagtttcgagttgggtttttttttaaaatggtatttaaatgtatattagatttatatttattattttaatttaaattttattgtaaatgaatatgtatggtttttgagattatatattttgttagaaggaggtttatgtgttggtagtttttgtttgaaatattatttgttttatttttttagtaaaagtaggtatttaataagttaaaattatttttattaacgagttttggttttttttaaagttggagtttttaatgtttttttttttgtatttattttattgggttagaatcgtatttattagatgggaaagtttttttattaggaatgtttagttattggttattttttttaaaattgagttatggtaatgagtgtttaagtgatttgttatttttaaaattgtttttaaaaggcgtttggtttttggtattgtaatatgtaaaatatgtaaaattatttgttagataggtgatagttttgtaaataaaggattagaggtatataagggtgtatttaggtggtgcgaatgaaaacgttgtttaaagaggtatttaggaatttagagttttggtttttttgttggtattattttttttttttttttttattattatttttttttttttttttttttttttgtttttttgattaatttattgagtgaaattttaatatcgtatattttttgatatagtaatttttgaaagttaatattaaaagttagaattagtttaaagaattgggatttttataaaatagggaattttgttataggttgagcgtttatttataatttaaagtgtgtattagtatgttgtagttttggttttgtttttggaggaaagatattgtttagtttataagtgatatttgcgtatggttgaatattggtaaagggaggatgtagataattttgtagatttttgagaattgtcgtaagtagttgagagggaaggaatttgaaaaggatattttcggttttatgagattataataagaggttttttatgagattttttattaaattatggcgtgttaaaagtgatggagttttagttgtttgtgtttatggattttattagtgttttgatatattttgtgttaatatttttgaaaatatatagtaagatgatttttgtaattgaggtaaatttaatttgatttggagaatgttttggttattttcggtaattaatgttgtgttttcgtgtattagaggtggtttgtttggtaatttttaagttgtttatataataaaaataaatggatagattttacgaatgggttgaaaatagatttttacgtatttagaaaggggatggaaagttttaatttttttttttttttttttttttttgtagatttaaaatttggatttgattttttgggtattaatgaagttttttagtttatttagtttatttatttagttttaaagggttaaaatttttgaggataagtgttgtttatgggttgagtattttgttttttttttttgttttttgggtgaattttatttagtatttatattttattatataaattaaattatatgagttcgtgtgttgttgtttaaaacgtagaggtttttaatttagtatttaaatagggagttgtatttgaaggcgggttttataaaattgtttttttttacgtttgaatttgaattttttatatatgtgatatgtttgggatttggtggtttttgttaagataggttttgtagaaatgtgtgttttatgaaaagggtttgttggtgtttttattttgttgtttggaaagggtttttgtttggttttggtgttgtttaggttgttttgtgagttgatgatgttttttttgtttatttgaggtatttttttttttaggatttttgagggaaaatttaagataatttataataatttttattttggttttatttttaatatagtcgtgggtagtatgatagttgttaatatttgttattaattttaaattatataatgtgttatgaaaataaaaatttttatgttaatttttttttatttttagaggggataagaaattacggagagtataaaattgattttgtatatttgtgattattttaaaataattttatttttaaaagaaattttgttttttttttttaagtaattaattgttttattgtgtttttgttgtgtgtaagtttggttttttgggagataaaaatttttagttgtagggaaataggtgtaggattttagtgttatagggtatttaatagtagttcgggggtttgatagagttaatgtaatatttacgttatttgaattattaggagtttggtagaaaagaagagatgaattatattggtttttatttagagattgaaaatttgtggtaatttgaagttttcgaaaatgtaggaaaatgggttgggtacggtgggtatatttgtaattttagtattttgggaggtcgaggtgggtaggttatttaaggttaggagttttagattagtttggttaatatggtgaaattttgtttttattaaaaatataaaaattagttgggtatggtggtagggcgtttgtagttttagttatttaggaggttgaggtaggagaatcgtttgaatttgggatatggaagttgtagtgagttgagattatattattgtattttaatttgggagatagagcgagatttcgttttaaaaaaaaaaaaaaaaaaaaaaagtaggaaaattatttggggttaatataagaaaaaggtttatatttttgttttttatttttttttttttttttttttttttttatttttttattattgtaaatgttttgttatttttaaaattatgttttttttggtcggtgcggtggtttaagtttgtaagtttaatattttgggaggttgaggtaggtatattgtttgaggttaggagtttgagattagtttggttaatatggtgaaattttttttttattaaaaatataaaaattagttgagtgtggtagtgtatgtttgtagttttaattatttaggaggttgaggtaggagaatcgtttgaatttgggaggcggaggttgtagtgagtcgagattatattattgtattttagtttgggtgatagggtaagattttattttataaaataaataaataaataaataaaaaatttttttcgatttgtatatatatatatatttatattattagatttttggaagagttaatataggtatatattggtaaggagttagttgattttagggtttttggaattttatagtatagtgcggatgtgttatttagtagtgattgaaggatatattttttttttttaagtttttttattttaataattaatttaattttttatatatatttgttattgagaaagtatttttgtattttttttttttttttttaagttaaatcgtatttagttttataaaagatatgttttataagtaattatcgtattttaggtaggatatgggtagatagtcgttaatagtatataataatttttaaattttttttttttatggattattaataattagaaagttaagataaaatttaataagtttttatttgatgttttgaatagggtaagtttagagtgagggttgatatttcgtatttagtatgttgtttaataattttttataagttgattttgatttttaggaagtggaatgaaaatggtagaatttatttgaagatttataatttagaaacggaattattgtttttttgaggggtgttattttattgttattattggaaagtttagattgtgtgatatattggtaattaatgattggggattatgttttaatagatgtttggttttaagggagttaagtttatgttgaaaggtggaaagggagaagaggatataaaattaaatttgttttttttttttataaggtttttgtgttaaggtggatatgtgtattaaagttagggagttttttttttttttgggagttaagaggaagttttttagaattagaagggaaagggaaaggtgttttttttatattagtttagttttagagatattttattagggatatatattttgttttttaaaaataataatgaagtgttttgtgtgttaataatatagtttaaagtaaaataaaattttgtatttttataaaatttgataaaaaatagtattttaaattgtatagttattagaagtatatagttattaaaaatgtagatattttatttggtatttttagtatttttagttttttgggtttggttttttttggtaattttattttttgtagggttatttttttttttgttagtattagtttttttttttttttttttgggtatttttttaggggtttttttaggtttgttttggttttggaggagtaggtttagtagataattttgtggattttttttgtggtttattttttattttggttttattttttttagtattttttttagttttttttttgggtatgttggtaataatagcgacgggacgtaggtgttgggtataggatgtggtggtgtgcgggttttggtcggttcgggggtcgttttcgtttttttttttttatattgtttcgtatttttgtattttttatttattagagatgtagatattatacgagtatttttggtattttttgggttttatttatttttgagatagagtttcgttttgtcgtttaggttggagtgtagtggtgtgatttcggtttattgtagtttttattttttaggtttaagtagtttttttgttttagtttttcgagtgagtagttgggattataggtttttgttattatgttcggttaatttttgtatttttagtagagatagggttttattatgttggttaggttggtttcgaatttttgattttaagtgattcgtttatttcggttttttaaagtgatgggattatagatgtgagttattatattcggttttatttatttatttatttttaattgaatgtttttttttttttgggtaggttgggatgtatgattttatgtgggtatagttttttggtgtttagatatgtatttttatagtggggatggtagtggtattttttttatagggagaatacgtttttagtttatagatttttttgatatttagtaaatgttaggtatttttatagttattagttgaaagaatgttggttgggattagaagtatattatatttaatttaaaaaattttaatgttaattgttatgggaaataatgggtatatatatttatgaagtataagtgatgttttgatataggtatgtaatatgtaataattatattagagtaattgaggtatttattttaagtatttattatttttttgtgttaggaatattttaattttatttttttcgttatttaaaatatataataagttattgtttattgtagttattttgttttgttattaaatattagattttatttattttatttagttgtgtttttgtttttataattatagaattatattttgtggttatataattaaataaagttaagtaggttattgaatagttgagtttaaattttgttttttattaattgaagatatttggttggttttttgtttataataatagtggatatagttttttggggtttagatatgtatagtgaggtataatgtatttggagaaaaagcgttggtttttagaaagagtttatgatattattatagacggtagatgaaatttttgttatgtagtgaatagtggggtaaaattttttttgttattgtttgtgggagtttttagtatttggtatatttttttgttttttataagttttgtgtttgtttttattggttttattttttattatttttttttttgggtttttattttttggatgtttagggttttatattttggagttaagtattagggtggttattttttggattttgttttaatattttttatatcgggtgtattgtttataatgggttatttagtgtttttttagtttattcgtaatgtttatgattacgttatagattgtgtaaatttaagttattttatttggtttttgtgtttttttttttggattaaagagagcgagttgaggaaagaatagagttaggtgagttagttggtagaaaaggtgtttagttttagggaagtttaagtgttttagaattttattttttgttgttgtgttttatgtatttgatattggttatttgaaatattttttattttttttaggtttgtttttttgtttttggtttatagaaaatgatatagttttttgaagtattatttttattttatttttggtgttttgtttatgtttgggttgtggtaatggtttttagattttttgttttttagtttgttttttatattgttgttttgttaatttttttgaaatgtttttaagattatttttttgtttagattatagttatttattgataatatcgtttagattttttgatttgattttttgagttattttgtaatttggtatttatgagaatatttttatattgttgaatttgttttatttgagtagattttatgttgtagttcgttggtatttatattcgattttagtattttgtatgtatgttttgttttttgttttcggttttagtttagttttatttttggtaggagattttttggtaaaatttagtgtggataagggttgatagattatgtaagttgttatttatttattatttattttagttaattttgtagtaagtttttaataatttttaatattgttttttttattttggtagtaattatagaagaagattgaggtttatagaagatgaatagttttttagagtttgtatttttagtggtagagttgggatttaaatttaagtttgattggtttttaaagttcgtgttgttttggatttttgtcgtttttaaattattataggtttatgtgttattaattagagttgggagttattttgtattgggtgtttattgtttttggggtagataattattgaataagttgatgttgttttttaggaatttatttattaaaagaaataaaatgtgtcggttttattatttatttatttaattgtaaatttttttttttttttttattatttaaagttagtatgtgttttattttaattaaaaataatattttggaaataatttaaaaatagtttaagataattgtaatattgtggtatttataaaattaagtgttggttttttgtgttttgtagatgttgtgtagggtatgtgtttttgatttttgttttgaattatcgggtttattatggttttttttttatatcgtgggtttgtttttttttggatttattatggttttaaagtaggtgattgtatgtggaaataacgaatgtttattttcgttgtttgtgttgttgatacggttttttgaatgtttagtatgatgtagatatataataggtatttaattaattagtatttgttgaagtttgaatgaatgaatgaatgaaaatatgaatgaatggagatgtatttttatttgggtattttatgttggatttttagaaaagttggttgtaaaaggaatttttaaaattgaattttattataaaattgaaaattaatttatttgtatggagatattaataataaattttggaaatatttgaagaaaggaataagatagaggttggtttttttgtttttttgttatatagaattttttgtgagatttttttatttattattttatttttttttggtattatttgtggtcgtttttaggtattagttatgatttttgttgttataataaaataaagttttatataagaaagatatgtatatttttgatatttaattttatttatagaaaagtaatgtttggttttttataaaaaaagtattttaaagaggtatagttagtattcgtagtaaagtaatttataatttattgtttttttggttagtgtttttttttgttaggtaaagttaaaattttttttttgtaagtggaaaagtcgacgtttataattgttgttgattgtgtttattttagagtaggatgtttttttttgttaggaagatgtttagttttagggtatggaatttgtttttgttagtaggcgtttttttattttatttgttgattttttattgttttgaaatttttcgttttagaggttagttttagtttcgggaaaataaggttttttaaataaagtttatttttgttttgtcgtgttttattcgttatttttattgttagtttagaatgtttaattggaaaatgttagtgttttgttggtttttttgtagtttttttattttttgattgtgtggttttaagggtaggatattatgtttttatttattatagtttttaggttattttttttttaaggttttttggtgtatattagttaaaatattagtaatattttattatagtttatggggtttgtgtgggatttaaattttttgaggtgttagatttttaggaattttattttttaaaatatggggttgtttgttagtgaaagtaatgtttttttttatttagtttttggttgttttgtagtgattgtgatgaatcgtagatttgtttatggatgttggtagttaatttagttttgtaggaggggttggattaaagtaaggtgtttttatttagttgggaaaataaaagattgtagggggttatggttaaatgtttattagtatttaaagagttatcgtatagaaaagtaattatatttaatgtaggtggcgttagaatgtagcgttaagatgtattgatgggttgggtaaaagttagagggaggttagtgtggtggggtggaggggataggattttttgtgtatagagtagtgtgaaaggagggtgatggcgttagatttttagtttttagagataggggtgggagggtgttttaggttaggttggatgattgttggtggagggtgggatggggacgtcgtgtaaaggatttttgtaagggatggttgtaatagataaatagataatttaaaaagatgttttttagttttgaaattttatggttttattatgttaaggtaagttattttagggtagttttattttttttttttttttttttttttttttttttttttgtaattgtggaatttatttgtgtgtgtggtttatgttaaagaagttttaattatgtattattttttatttttttattttgaaatggttagatttttagttgagttgtgtttgggtattgtagagggaggtagggtgtttgtgtatagttgtgttgggtgtttattgtataaaggatagaaataaggggttaaatttgaatatatattttgtttattaagttatttagaggaagagtttatttttttagtttgcggaaagcgttattagtttattaagttgagtgttagaggggttaggtttttttagaagaggtatagttttttaatttgttagattagaggtttttagtttaatttgaagatgttggttatgattttagagggaggtataatatattatttttaatttattaggattgataaagttaagtttagatatatttgtgaatttcgtggtgggttgtataaatatagtgttaattattgttattaacggtgtaaagttttattaagtatttacgtatttttgcggatttattaagtatttaggtttttggaagtatttggaggatttgtttaagtttttattttttatttggatatttgatattgtgtgtatatagttttgtgtattttttttttagtttaggagattttttttgatttttttatttatttttaatttttaggggtaataaatttggttgaaaagtagttgaggatttatgaatgtgaggtatataaaatttttttggatttttagatttatattaaataaatttgtgagtgtgttagtgaagaggaaaaagtttaaaaaatttagtacgttatcggtaaggttggttattttttaaaataataataatagtaaataaaatggaaataaaatataggtcgcgttgttgatagtaggtagtagttttttgagtaggcgtgaagagatgtagagattgttgtgtatttgtgaagtgtttttagagatagattttttaagtttttttttattttttggttttgttattgttttttttttttttggaatgtggaggaaatattttttatttatttatttataaaaattttggaagagagttattttttttttattttttttatttgttagtttttgttttgttttttggtttttttgtatcgtttgtttttagtgttatttttagttagtaagggtagaattttcgttgttttttgtttttagtgttagttttgtgattgttgttttgcgatttgttttttatgtttaaatatttttagtcgtttgagttgaatatatttcgtgtttttgtgtaagtttatgagttggtgttatttttttttagttattttgatgtttttgtgtttttgttttttgtttgtttgtttgtttgttttttttttgagatagggttattgtcgtttaggttggagtgtagcggtgtgatttcggtttacgtagtttcgatttttcgggtttaaggggtttttttattttagttttttgagtagttgggattatagatttgtatttttatatttggttaattattttattttattttattttattttgagtagagatagggttttgttgtgttgtttaggttggttttaaatttttgggtttaagtagtttgttagtttcggttttttaaaatgcgaggattataggtgtgagtcgttatatttgatataattttgtgttttatttttttttttggaaatttttatagtttttaattattataaattagtagtttttatattgttggtagtaagaaatggaaaaaatattcgttttttttatcgtttttttttttttaaaaaaatattgtggggtagatattaatatagggatattagatatttgtttaaatatgggtatggtagggttggggtaagttgggatattggaaaatagtaaataatttttagagtattttttgttgttattattattttataatataaaggttgtttttatattacgaagtaggaagaatagattattgagtagaggatattttttgaaaatgagtaattttagttgtgtgaaatatttattattttaattttttttgtttttattttgtgtttatttattttatataattatagatttttaattagtatgtagaggttattgttgtaaatgattttaaaagaaggagtttttttgtttagtagtaaaataaatatagagtttattagggaggtttattttatttgggtaggaagttattagatgttttggtaggagttcgtttttgtttatgtggttataagatttgttgtgattagggtttttattgtagttggagggatatagagattaggagtattttgtagtttagatttttgtaggagtaagaggggtgggtattggattttgaggttttaggttggggatagtatagttttgagggttaggtgttgagtgggtgtttgtgagtatgtttagtttttgggttgtgtttttagaggacgtgtagatattagatatttatagtgagtagtatggaaattgcgggttgtatgaggatgtttgttggacggtgaggttaggttgtttaattacggaatatgttggaattgttggggagatggaggttagaaaatatatgtttttttttgtttgttcggttgttttatttttgttttttttggtttttatattttttagtttgtttggttaaaaattaaatgtaaaaaggatgagagaaatttttaggggttaaaaggaaggtttattattgaggtatgtattgagaaatttgattttttggtggggtgtttgggttttttggataagcggatgtatttcgggcgtgattttatatttcgtttattaaaattagttttatgtgattgtagacgtggaggtgtttgtttacgagagatagagttgtttttttgtttgaggaaaattgatttttatttaatagatgtgtatggagagttggttttttcgaggttagtattggatatatatagtttattaaggtttagttttaagtgggaggatttatattttgtagattttgttgtttgtttgatgaagtggaattaaagaatgttgtttttaaatttagatgtatattttttgaaaagattttttattatttgtgattaatttaagtatatattattttttttttaaatttttttttgattttttttttttttttttacggcgttattttatttttttattttttattttttttttattttttttcgtttttcgtttttttttttatgttagtgtatttttttttttatggagttttgtttttatttagagtaatttttataaatatttgaaattaaatttatgttttttagaaataagattttttttgaaaatatattttgggtgataaagatgtaatttgtttttaaatttttttaaatttgggtgtaaattatgaaatagaaaaaaaaagaagtagttatttagtatttgattattagtttatattaagttaagtttagtgtgtttttttgaatttgtttatttgaatttagggtatatagtagtaggtatatgttagattaggagttagaaatatacggttttaggattggttatgaaggatttagggtagattatttattttgtttgaattttagtttttttatttgtaaaatgaaggtaattttatagtgtttttttggataaatttagataataattattaaagtttttggtagtattatagttttaatttgtttaggttgttgtaataaaatattataaatggagtggtttataaatagtagaaatttattttttatagttttggagattgagaagttttagattaaggtgttagtagatttgttgtttgatgaggatttgttttttggtttatagatggttttttttttattgtgtttttacgtggtggaacggttaataggttttttggggtttttttaaaaggaattttatttataagggttttatttttatgaatattttttagttgttatattgttaaatattattatattggggattagagtttaatatgtgaattttagaagaatatatttagtttatagtaatgttgtaattttaaatgtttttttgaattaatttatttttaaattttttttaagttaagagtttgaattttagaaatgtgtgtttattaaatgatgattttataattttatatttattatatatagtaattttaggagtggtttattgatttagtaaatatttggaaatgtttattttatgttagattttttgttgtgtttatgggatttaaagattagtaagatatttttttcgttttgtttgtttatttattgtagagatgggaagtgggaaatgttagagcggatgtgtgaataaggttggagggtgtagatgttagggcgtttttataggagattgaattgggtattgaaggatgttgggtacgtagtatgtttaggtaggttttacgtgatgtattatttttttttttgataatatttttaatttagattaatgttgatttttggagaagtgaagtttaggattttattgaagatgatagatttttaattattggtttaattgtttggtattattttattttttaatgtttttattttttttaagtggagatcgtaagtatgtttatatatttgtatagggtattaaataaagtatatcgtttttagagatatagtgaatagttaaggaaagagatgtatagtgaatattagaaagttagttggttttttacgtgatatttatatgtttaatattattattagtattattattattattgtttttattttttttattaattttgttattatttatggtttatggtaatgtattattagattgtagtatttttatttttattttttttttttttttgagtttttttatatgttaatttatatttgaagtttgagagatagatttagggttttattttgattttttattttgggttattttgggtgtttttggataggtgatttagtgtttttatgttttagtgttcgtagttgagaaatgaggatttagatatttacgttattggaatgtgaaaaggattgggtgaggttatgtgtgttaagtatagtatttggttaaagtgtaatagttgaagaaatagttgtagagaggttttttaagtattttggagaattagttattttggttttttaattatatagtgagttgtttttagaatttgaattaaagttatagttttttgttttttagttttgtttttttttttaataagatatatttgatttttgaattatgttattgtataaatcggagattggataaaaagtttagttatttatggtattgtggggggtttaaggatatgtgtataagtttttgatatttttgtttttaggaggtgggattttttttttttttttttaatgatttatttttagtgaagtgatgggatggtatttttaaaattagattataaaaggattgtgatttaggtggtttttttgtttttttttttgaattttttattttggggtggatagtggttatgttatgaggatatttagttggtggagaggttgtatggggaggagttaagtttggaaatatatttttttttagttaggttttgaggtgattgtagttttttgagagatttttagtcggagttatttagttaagtcgttttcggattttttattttttaaaagtgtgagttagtatatgtttattatttttatttgttatatggaaggttaattgtgattaatttagtatttatttgtagaatggagtttaaagcgttttaagttttgagtttgttgtatgttataatatgttataattaggtatttttgcgttagtgtgatcggcgaattgagatggtatttttatatttttgtatttagggggttgttaaagataaaagttttaaatgattttgtttgatttagggataagtcggagtaggattgttgtttatttgtagtttagtttattatgtttgagttttagataatttacgttttatagtagaaatatttagaattataaatgttttaattttaggtatgggaagagatttggtgtaatttgtttggtgaggtattgaagtttaagaagttaagtgtatatttagtttgtatagttgttcggtggttgggttgttgaggttttttttttgtattagttagggttattgggttatatgtaatagaaattgattttaatttttgtattaataggaattgttgggatgatatagaattgttttaaaattgttagaaaatttcgagaagtaggtgttgtagaggtataggaagtaggcgtgagagtttttttgggggaatgagttttgattgttttttttttttttaatttaggtttaggatttaggtttttagtagaggtcgtttgttattagagttaggtattttggttgttttgggtagtgaggtttatggattttttaaaaaaatgattttttagggatttagaattagaaatattatttgatttagttattttattattgggtatatatttaaaggattataaattatgttgttataaagatatatgtatacgtatgtttatagcggtattatttataatagtaaagatttggaattaatttaaatgtttaataatgatagattggattaagaaaatgtggtatatatatattatggtatattatgtagttataaaaaatgatgagtttatgttttttgtagggatatggatgaaattggaaattattatttttagtaaattattgtaagaataaaaaattaaatatcgtatatttttatttataggtgggaattgaataatgagattatatggatataggaaggggaatattatattttggggattgttgtggggtgggagagggtggagggatagtattgggagatatatttaatgttagatgacgagttagtgggtgtagtatattagtatggtatatgtatatgtatgtaattaatttgtataatgtgtatatgtattttaaaatttaaagtataataataataaaataaataaataaataaataaaaagatattagtaaacgaaatttagtagtatattaaagtaattatatatttaaaaaaaaaaattgagatagagttttgttttgtcgtttaagttggattgtagtggtgttaatatggtttattgtagtttttatttttcgggtttaagtaattttattgttttagttttatgagtagttggaattagaggtgtatgttattatatttggttaatttaaagaaaaaaaaaattgtagagattaggttttgacgtgttgtttagggtggtttcgaatttttggatttaagtagtttttttattttagttttttaaagtgttgggattataggcgggagttattacgttagttttggattttttatttattattttagaatgtttaaatatagtaggagagaagttaattttgtaaaggaaattagagttttgtgggaagaaggaatagatgttttatagttagaaaatgacgatgggtatattgtatatgtttttttttttttagtttttttgagggttgttaggttttttgttttttgttaatatttattgttatttttatttataggagaagagaatgtagtttttttaaaagttattggtatagggcggtttttttaaaataaaattgtaaggaaatttaggtgtgtatgtttgttagtattgttagaataaggtattatagattgggggtttaaaataatagaaatttattatttgttagttttggaagttgaaagtttaaaattaaggtattggtagggttattttttttttgaaattttaagggaggatttttttttgttttttttagtttttggaagttttaggtaatttttgttttatggtagtattattttttgttttttttttatggttgtttttttgtggtgtgtttgtgtataaatttttattttttttttttttttttggaaagagttttgttttgttatttatattggagtgtagtggtgtaattttagtttattgaaattttcgttttttggttttaagtgattttgttattttagttttttaagtaggtgggattataggcgtgtattattatatttggttatttttttttttttttatgtttgtagagacggggttttattatgttgtagaggttagtttgaaatttttgagtttaatcgatttgtttagtttggttttttaaagtgttgggattattggtgtgagttattacgtttagttatagatttttttttataaagatattaggagtattgatttagggtttattttaatgattttatttaatttgattgtttttgtaaagttttatttttaaatatggttatatttatatatattagatgtgagggttttaatatattttttaaagggatatagtttaatttattgtattaggtagttgtggttttttttttttatagtatagaaggtggttatatgttgttggatttttatagttatagtttttttatttgtgttttggttgtatcgggtagtttttaagtttttgtttttagtttcgtgagaaaatattggggttgggagtgggagatattggtattgattgatttggtatgttaattatttatttgttatgagaaagttgtttgtgtttagatttgaagaggatgatatagattttataaatatattatttaatgagtagttttttattataaagatatgttgatgttggttatagagaaagagagtggattggtattaacgtgttcgtgatttttatggagagaaaatattttggtatgtgtatgttgttatagagatttttagaatgttagattgtttcgaaagtgtgttttgttttatatttaaaatattatggttagatgtagtggattatgtttgtaattttagtattttgggaggttaatgtgggaggattatttgaggttataagtacgggattagtttgggtaatatagtaagattttgtttttataaataattttttttaaattagtgaggtgtggtgagtgtttgttattttagttatttaggagaattatttgagttcgggaggtcgtagttgtagtgagttgtgatcgtatttttgtattttagtttgggtaatagagtgagattttgtttttaaaaataattaattaaattaatatatttttaaaaataattaaataaatataatatgtttattgtataaaaatttaaagttatagaaaaaaataaatttagtaaattataaatatgtttattgttaacgaaaaaagtttgttaagtatgttttattttaattattttatgtattgattgaatgagttattggttggttggtggattgttttttagttataaaaataatgtgtatgggagatggtgtcgaatttaaaggaagtaattatttaaagtgagtattattgggagaatgtgaaattttggtttgtatatgtattttttaattcgaagttttggttttaagttgattaaatatgttaagttattattaatgtagtaattggttgttttgaaaatggtatgtttagggatttttatgtggatagtggggaagagggcggagtatgaagtttttgggtagaatttatttagttttggtaaattgtattttttgatattattattttttttttggtacgggggagtaggtaggggatagagttatttttagggtagatgtatttttggatgaatggcgatagtttttttttttggatgttttattgttaggattatttataagggtttttttttttatttacgtaagtttatgtattttagttttaaaatattttgagagaataaataggaattgggttgtgatatttgcgatttattttttttgtatttaagtaggataaagagagttttatattgggtttattttattttcgtttttttttggggtagttgaaaaatttgatttaatggggaataagggatatttgtaattggggtgaaaagtattgttagaaatgaggtattgtggtagttttaaatgatagggtggaagatagtttaaattgatatagtattttttagtttgtaaagtatatttataaatacgattttattttggtttggatttttaaaatgattagtaggtttatatggtaggttttatatttgagaaaatggatgtttagagatatggagttatgtgtataaggttattttggggaattgttttagagttttttgttgtatatcgaataggagttttatgaaatagaaatatattatttttttgattttataggtgaggaaattgggatttaaaaattttaagagggaaggtttttgaggtttttttttggaaatggttgatatggggttaaaatgtagagtattttttttcgttagcgtgggttagtttttagtatattatatagagatagagagatggggataaaaataaatttttttatggtttaataatgagaatttgtttagcgtgtgatgaggagggtatgtgtaagtatatttatattgatttttgtttttttatagttattgagtatttttttttacgtgtcgtttttttttgtggttatatttgtaggttgtggaaaataaatttgttttagggagttaaggttgtggttttaggtttttatttttttattttttaattgtgagttattgggtttattgtttaatttttttgagtataatttgattcgtaaagaggagataatattatatgttttttgggattgttatgggatttgaataaggttagtaagtttttagaaatgggttaggtatataggaagtagttggtagatgattttttttttttggtatgtttggtatagaatatatattttgatatttgtttattaggggtgtcgtagaaggatatggtttgagtagaattgaggtttttgaaggttgttatggagaggaacgtaggtttataaagttaagttttgtagaattatacgtttatttattttaggatagagaaaatggtatgataatttttaaaaagttattttttttttttttaaaggataaaggtttgagagagatattttgttaaattttagattagtaaatgttgtttgttaagtaatgtttaagagaggggattttggttatttttatggatacgagagtttttgttgggtttcgtgtttttggtaggttgttggtgtttaggggaaggggggttttcggggtaggttttaggtattatttgcgtttttttttagtattttttttcgtgtttaattagagtttgggttagggtttgtgaggttgagatcgtttggggtttgatgtttgttgttttttgttttatatttttcgttttttgtttttttattttttagggggagcgattgtttttaatagggtggttgtgatagatgttgtgggaattttgagtttgggataatgagttgttatatgttattttatttaaatataataatataaatattttgattaaatattttttttagttgttgaacgaaagtaataaaagtagtagggagtgttagtgaattttttgtttttgaaacgttttattttttaaaagttgttgtttgttaattttttttatttttgtttgtttttttttttttttttttttttggtttttttgattttttattgtatgtttagtttggggttataaataaagaggttgaatttagggatgtgaagggggtgaaattgagtatagttttttattaaatattttttaggttggtcgtagagtaatcgtagttgttgtgaatttgtaaaatttggtttggtttggttattgtagtatagtttttaagtgtttttttaatttttataattatatttaatttttaggtaatagttttttgagataatttatttttgatggtattaggtttttggagttttgtggttggagtttggttttatggttgatttttatggtagagttttttgggtttttgttgtttattttttatgttttgatttggtttttggaattttttttttttttttttttaggtagagagggatgtggttgttttaggtaaagtggagggttaggagtttgaagggattttgaatattcgtttttggaggattttagtagttttttttgttagtgggtagtaaaggtgtgatcgttttgaatgcgttttttaggttgaaatttttaagaggaatgttttgtattttgttttttttttaaattatgatttttgatttagtaatgttattaagtttgaagtttttttcgtgagtttgttgtttaggggtgggattagattaggtgttttatttgatattggatattttttaaagttagttcgtttttgtatttttttattttttttttttatttttggggaagcgagtttgagttaatttgcgttttattttggattttagggattttgattttatcggtattttttttttttattttattttttttttatttcggtggttttagtgttttttatttataaataaatagagttaaaatatttatatagtatttttggttttgggttttttttagttgttgttttgttttttttatttgtagtcgaatatttcggagtgtattatagtgtttattttggtttttttattcgttagttttttgtagtgtatatattttggtttcggaagttgtgtattttgtttgaaattgttttttttttttggttttttggaggtttttgattggtggttgttttgtgttttttttattttttttttgtataattttgttttttttttttattttttaattgttagtttttttttaggttttttttttttgtattttttttggagatattattaattttgatgttattatttatttttgtgatcgtttttttcgtttttatttttaggttagacgtggtttttaaattttagatttatttttttttagatatttattaggagtttggttgtggtggttattttaaattttatttgttttaggttgaatttatgtttttttttttttttttttgtgtttttttttgtttttttttttgttgttgttttggttttaggattattattaatatttatttgggttagaattttagagttagtttattttttatttttttttttttatttattttttgtgttttttatttttgttttttttagagttttttttttattttatttattttttttttattgttttgttttggttttttgagtttttatattttttgttttttatttttattttattttattttaatttattttttatgttattattaaagtaatatttttaaaagatgtgtttgattattttagttttttgttgagtttttcgtgtttttttgtatggtgtaggagttttgaataggtttggttttatttttttgtacgttttcgtggttttcggagggtttttagtagtagtagttttatttgggagtttattaggaatgtaaatttttaggttttattttaggtttattgagttagaaattgttggggtggagtttagtagtttttattgtaataagttttgtaggaatttggaggtaaggttaagttggaggatcgatgttggaaagtaatattgagttgtttaggagttattaagtacgtttttgttttcgagtaggttgtgtttgtttgtggtgttttttttttatatttttggttatttttttgagtaaggtttttttttaaggagaggaggtttttttggtttttattttttttttatttagttttttgtttattgtttttttatgtgcggtttttggatttgggatgtttttgagttgttgtgtttgtgggtggttttgtgattttttagtttacgtgttttttttttttttggggttttttggagtaattggtttattaggtttttgggaattcgtggggtttggtatttggtagtgttgtttagatttgtagagtgaattgtttttttttttaattaattttttttttttgatatagagttttattttgttatttaggttggagtgtagtggtttaattttggtttattgtaatttttgttttttagatttaagtaatttttttgttttagtttttcgggtagttgggattataggtgtttattattatgttttatttttttgtatttttagtagagatggggtttcgatatgttggttaggttggtttcgaatttttgattttaagtgatttatttgttttagttttttaaagtgttgggattataggcgtttattattatgttttaattttttgtatttttagtagagacggggttttattatgttgtttaggttggttttgaatttcggattttaagtgatttatttgttttagttttttaaagtgttgggattataggtgtgagttattatattttgtttagtgaattggttttgatttgtttttgtatttagtaattatttattgaattttgaggtgttaggattgaagtagtatagaatagaattcgtggttttaattgttttgtttaaattttaagagttagtatcgttgaagagttaagaatagttgagtattaatttagtaatgatttgaagggcgggtagtgtaagggagatagtgattttgagggaaatattgtgatttttttttgaaattttttttaaattttaagattttttttgggtattggtttttttttattttttgtttgatttttgcgttttttttttttgtttttttagtaggataatgtagaatgaaagttaatttttggtattttttttttgtattgaagaagggagttggattttagtatttagttttgagtttatttggggagtgtggtttttttttgatttttattttttgaggatttttggttttggataaagaaatagtgtttattttttggggataaagatttttttgaaagtttttatataggagtgttttttagtttttaagattttttattaatgtgtttgtttttttttttgtaaatttgttatattagtatttaattattttttatgatagtattaaattttatgagtgatttatagtgatttatagttataatagagatttgtatgatttattatagttggtatttgaggtttattaaatttttaagagttataagtattgaaattgtttaatttgattttgtttagaataattatagtatgtgtgaaaatttaaatttaagtataataggaatagttgtattatttattttatttttatttgatgttattgtttacgattgtggtaatcgtatatatgggggatagtggtggtgagtatatgtgttttttatgtagaaaagagaagggaattttttttttttttttttttgagatattgttttgttgttgttgtttaggttggagtgtaatagggcgattttagtttattgtaatcgtcgtttttcgggtttaagtgatttttttgttttagtttttcgattagttgggattataggtatgtgttattatattcggttaattttgtatttttagtagagacggggtttttttatgttggataggttggtttcgaatttttgattttaggtgatttgtttatgttgggcgtttttttgtttttaaaaataagattttggttaggcgcggtggtttatgtttgtaattttagtattttgggaggtcgaggtaggtggattatttgaggttagaagtttgaaattagtttggttaatatggtgaaatttcgtttttggtaaaaatgtaaaaattagttaggcgtggtggcgggtgtttgtaattttagttatttaggaggttgaggtaggagaattgtttgaattttagagacggaggttgtagtgagttgagatcgtattattgtattttagtttgggtaatagagtaagatttcgtttttataaatatataaatatataaataaataaataaataaataaataaaatgaaataaaataaaagatgagttttaaattttgtgttttggatggataggtataatttgttatttgttggttaattgaagagttgattttggtgcgttttttttgtggttttgagataaaagtcggggtagtgcggtgtttattggattgagagtcggggtttgtttgttgtgcgatagatggttttaaattttaatgggtagttgattttgttttagggtttttcgtaaagaagtgtttagattttaatttgtttatggttagtttttatagtgtttttagtgtgttttaagtttttgttgggaatagcgttgtttttatttttgagttggaattttgatagtatattacgggttttgcgtttttgttttggtttttgttttgaattttttatttttgtgtttttttgttgttttagtttgtgtgttttttttaggtataattttcggttgttgtttaaattaataattattttaatgaggtgttgtttcgttattatttttatcggggtaggggaggtgtagttgttcgttttggtgtttttttagatgattttatttatttgtatttgtagagaaaaaggtgtgtttttggattttgtttttttttgtacgggtggtgtggataattttttagggtttttggtcgtagggtagataattttttcggggttatttgttaattattagtgaatgtgtgaagtatttgtgtaaaggtttttgaagtgagttttacgtattgttgtttgggtcgttattggttttgttttttaggtagagggtttcgaggtttagtttggttttttttaagtgttggtggtatttttttgttaaattgtttgtttttttaatgaagtgaattgtttgtttgattttgcggtagaaggtatttaattggggattaaagtaaacgttgaagatatttaaataagttatgtatatttgttttgtggagggaaggaaaatagtttggttttatttattttcgggaagaatcgttaaggaattgtttaaataataaattgagtcgagcgagcggatattgttgtagtttagtttggggtttttgtgttagttttggttggtttgggaatttttttgtagtagttacgaggggagaagagagcggttggatttttgtagttagtaattgtgatttatatatgtgtagagggatttttgttgtgttcggtttaaataagtttaattagtttttaggatagtaggtcggtggatggcgattgtgttagtatagtgtgcgtaggttttagtggtagtaagagagtatcgtcgtggggttgatgtttggttcgtgttttgttagatttggtttggttaggggtttgttgtttgttaggttgggtttttggtgtttgggagaagtgtttgagcgattggggtaaggggattaaagtgtaagtttgaggtagggtttgggtgaggtaggggatttgtatttgggtagtgaaggtaggatgtgtgtaattatttagtgtatttatgataatgtttgttagtagtttttagtttttgtcgttggtaagggtgaagtagagaaggttggaagtgggagtatttttgtgggaaatataggtgtatttaggattagttttatagtttgtgaggtttagtgtaaaaagaaaatggggagtttttgttgaaaaattattaagaattttaagacggttattgcgcgtaatattaaattatgttcgggtttttttgattataggtttaggggttgtataggttttatgtttgggtagttggttttgttgtagtttatagagtattgtagttaggtatatttggatttgaggttaagttttgttagtttttaattgagcgattttaattttttattttttttatttttatttttttatttgtaaaatagtatatgaatatttatttttttagattgttatgtggtataagtaagaaaatatatgaagagtgtttagggtagtttttagtatttgtgagtgtttagtaaatgatagtttttttttgagcgtatttgtagttgtaatttttttttttttttttgaaggttaagttgaggatagtgtttgtttagtgtgaagtttaggagatagagtgaggtttttgttatagattttatttagggatagagatatggaggattttttttgggttttatgattagagaatgtttgagggtaagagagaagtatgatttgaatttttagattatttgtaaagttgaagatatttatataaagttgttgatttttatggtaatttgggtgtttatgttgaggaagaaggatttagaaggaacggtgattttttaaatatgggtatagttatgtgttgtttaaggatatttaggttaaggattgattatatgtaagatagtggttttataagattataatggagttgaagaatttttattatttagtgatattgtggttattataacgttatagtatagttattttattttttataaatttagtgtagtttaagtgtatagtgtttataaagttaatagtattgtatagggatgttttaggtttttatatttatttattatttatttattgatttatttagagtaatttttagttttataagttttattaatggtaagtgttttatataggtgtagtattttaaaaatattttaatattgtatttttgttgtattttttttatgtttagatatgtttagatatattaatatttattattgtgttacggttgtttataggatttagtatggggatatgttatcgtatcgttatagtttacgagtaataggttatattatatagtatgggcgtgtagtaggttttattatttaggtgtgtgtaagtgtattttatgatgtttatataatgatataattatttaaagatatattttttagaatgtattttattgttaagagatgtatgattgttatttagaatttatgaattatttttatttatgttatttggggttttgtataattttgtggagttaatagagttaagttttattagttttattttacggatgaaagaaaatttatattatggttgtagtgattattgtaatttgtttttatagaaatttagaaaatacgtttttaaatgggggagtttttttagttgttttgggtaaaatggagagtagataaatttttatgggaagggtgtatttagttaagggttgtagtatgtattatttagtgtgttgagtatttggttttttttcgattttggagaaggtaaaatttagtagaaaggatggtttttttaaggatttatattgagggtgataaattttgtataagtatatattggtgttaagatgattagtaggttgttattaatttggtttgttgtttagtgttagttattaaatttatgttttgttttaaatgttttgtttaaatttcgtattattatgttttaagttattagtaatagttggaaatagtaaagaagtatgagaagtagttttgtatttttaaaatgagtgtaggttatattttttgattagtggaaatttattgaggaagtgtagattggggttatttttgtgtgagtgtgtttattattacgtatttatgtgttgaggttatagtttttagggttgtaggtgtggatttaggcgtataaggtatagatgtagattttagaagtagattatgttttttgtttttaggggtatttggagtatatggatattattgatattagatatttattaagtatagtttatgaagattggtttagaagttaggggttattttgtagagagggaggagaggatttagatggagattatattagagtttgagttttgttagataaggtaagtagttgttgagtttagatgaagggttagtgagattattattgaggttgtagaagcggaagtgcgtaagagagtttgaggttttagggaagtataggtagtagatagttagtggtttaggtttagtgaaaggagttttaggattattgtttttttagagaggagagtttttattagagtttagttgaataggtttgttgatatttttaagtttattattttttttagttttaaaatagaacgttggtaaattgaatttttttgggatgtgtttgagtatattagtttgtttggattgtaggaattatggaggggaagagtgggtaatgagtggtttttgttttttatgggtatggtgggtttgtaggtttaggtaggatgttttttgtttatagtataggttagatatttaaggtattattataggagtaggtgttttaaggggtggacggttagagatagtttgaaatttatttagtattttaattggaattaagttaagaattaaaataggaagttagatgagattgcgaggaagggaagggtagttaataagagaggaagttattagtgggaattttagagagtggagtttggagtagttttgaattagtttgtaggtagttgtggggttttttatttgtatatttagtaatgagtatgaggtagttgtaaagtggacggtggatttgagaaggtattttaaagaagaaaggtatttcggatttttttagatgatattatttgatagatgtttatatagttaatgtttttgaggtgtgtgtaaaatgtgtagtttgtggttaatatagggttgtagagaaaggagaaatagaagaaaaatggggaatgttttttatttgtatttttatgagttaagaaatgtgaagtggatttttttttttttaagtagcgggggatttttttttttttttattatttttttgtttatttttttaaggaagttatgtcgtgtgttttattgttttatagttatggtgaaagaaatttttaaaataaattttttgttttaaagttttatgtgtttttgtaaataatgatgttttttagatagtgagggtttagagtttaagggatataagaaagtggagttttttaatgtttttagtgtgtagtaaatatgttggaattttaatggattttaaagcgtaataataatagtattaagtatatgttagagtttttgatgttattgatgaaaaaaaaaaaaaaagtaggtggtggtgggggtaaaggggtttttgttatttttgttatgagtttttaaatttttgatttttaattttttgtgtttaagagttttttttatatgggtgttagtagtttgattaagtattttgaatttattggagttattagtgtttttttgatgggaaagggtatttttagttaaaaggttttaattaggattgtgattgttgagcgtttattagtgtttgttttgttttagaggtggtggtatggggtagggtggtgagtttatttattgaagttatttattgtttagtagaaggtaggtagtttggttaggttggaagttgttttttagagtgttaggatttggtttagggtgtgtatgtatttgttgggttttggttttgggtttattttgaatatgggaagtatgtagaaaattgtatagggaggattttaaagaggagatagtttatatttgtgggttttttttattttgtttgttgttggaggttttttaggtagatggaagtgttttgtagtttttaggagggatggttagtttggtttattattgttattgcgtggttttagtttttttttatgttttttttttttttttttattttttttagaatatatatttattgagtttttgttgggtatatacggataagtgggttttttttgtttttatattttagattttttgggagggaaagaagatagttttgatttgtgggtgtgtgtattttggtagggatttatttttatattgtttagtaggaaaggtagtgtggtgtgtttatttttatggttgtgttggtataagttttgtatttagtaaatgtgtgtttgtttgaggaagcgtattgaggatgagtatagggtcgttagagggtaaggtagtggggaggatatgatgcgggtttaagtagaatttttcgggtcgtttttattggttttggttaatttgaattatggagaagggaggaaggagtattcgattttatggagttttttgggaagtttgatggagggggtggtgtttgtattgagttttgaagagggggtaagatttgggtaagagggaatttgtttttaattgaggggatattataagttatgaagtgtatggtgtttgagggggtattgattttcggatggggaggtgttttggatagagtttggtggttggggttttaaatttatggtgaagagtttgggttggagtggggaggttattttgggttattatatattttgggagaagggagggatatggtttagatttggttttagggatgttggtgtggggagtatagtttagataagttatgataaaaagttttaattttgatattgttgtgttaggaagtggaatgtttaagagttttggttttgaagtaagaaagatatatagttttattattgtttttttttgtaatattggagaaggttagtttttttatttataagaatgggcgtatgaatagtatttgttttttagggttaggttttaggaagaaataaatgaggtgaatttaaaaggtattgtatattgtttgatttgtattaaagtatttagtgatttgtatttgtgtttattaagattgttttattattttttattaattattatttatggggtaaattttggaagatttttagttgttgattgataggaattgtagatggagtggatggtttagataaaagaagtagagttaataattttttagagttttttgtttggttttgagtaaaatgaatgtgttttatttattttttaattgttataaagttgttaattagtatatttttgaaatattgttggttttttagagatttttaaatatttttggaagtgattttttatgattgatggtagtatttttttttgtgtaattgtgaagataagggtaaattttttgatatgttgagtttgagtttcgataatttttggtaggtttgtatttgtgttgtttgagagttttttagggttgtcgtttttaaagtaggattgatattttatgaaggtatttgggtttttttgttttggtagggattacgtttgaagtgttaagttttgtgtgttttggtattggaatagaaagagtattaaatttgtattataaggttatagttttatgtaatattgggtagattatttagtttttttgagtggataataaaattttttttttttagtttttaggattgttttgataatagaatttaagaagaaataagatttaggagaataataataacgttttgggaatgtttattttatgttaagaggattttttaagaagatatatattattatgaaatatattattttattttgtttttatatttttttatttgtttttgttagttttgtaatattgaaagttttttttgtagtaggttaattttgaatagaatataatttttaaattttttttttgtggattagttgttggttttttaattaaattaggtttagtttaaatttttgattttattgattttagggttttcgtagttagatttgagataattaaatagtttttatggaaatatttttttttttgtttttattttataattattcgagattagtttggtttatatggtgaatttttgtttttattaaaaatataaaaattagtcgggcgtggtggtgggtatttgtaattttagttattcgggaggttgaggtacgagaatcgtttgaattcgggaggtggaggttgtagtgagttgagattgtgttattgtagtttagtttgggtaatagagtgagatttaatttaaaaaaaaaaaaaaaaaaaaaaaaaaaaagaatttaaatgtatatttttagagttataattgtgatttttgaattttgtgatataaaaatatagttattgatttaaaaatttgttattggtaattaatttttatttttaatttttaagtttatttattgttattgaaaatatattattagtatattttaaagtaaatagatttgttatttttaagtgattttttatatgtttatatgtgatttttttgagagagttttgtagtttagttagaatggatgtaaatttttttttatttttttttgttgtttttttttttggttatttttttttttttattttggtaggaaagttgaaaataataaaaatgttggatgtatatatgtggaattataggtaagatatattttagagtttttgtttggaaggatatggttggttagttagtacgtagatgtggttttttttttattattgggtatttattggatgtgattttgaagggagaaatatgtagatttacggatagaagaagttagaagtttttagaaaggggcgagattagttgttggtttacgattgaggatatatttgaagtagtaaaggtagaggttttttttgttagtttatttgtagaggaatatttggtatttttttgtgggaaatatatgattatgtttgttgaggagtatagaagggatttatttgattgtttaaaaaaaaggatgaattgtgggtgtggttagagtgtagtgatgggtagtatttaggtttaaaatattaattaatttaatagtttgtatgtttatataaaagaaatgataaaaagtttgttatttgagtagtggagaatgttcgtggaagtttatagattaggagttaagattgttaggtagttgttagaagtaaaagtttattgggttttagaaatagtttattttttattgttaattagtattttatgtaaatttgtatttgttttatttaatttataaggtaattttaatttttaaatgtttagttattgttattattgttagatttatggttaattttatttattattttgaaatttgtttatttgttacgggttttgttaaaattagatgagatgtttattgattaatgattaatatgaatatttttattatattaagttagttatataagttagtatatgaagaaagtgtattgaaaatatttgatgtatttagtgttatcgtttagataatataataaataaaaaattgatatttttttttttgaaatgtaataatttttgtaaattattttattatggtatattggaatagggtttgttaatttttttttataaaggataagataataaatgtgttaggttatgggttttttgttttagttggttagttttgttgttggcgtgggaaagtagttataggtaatatgtaaataaataagtatggtagtattttaataaaattttatttataaagtaatttaagtgtttattaatagatgaatgggtaaagaaaatgtggtatatatatatagtggagtattatttagatgtaaagaagaatgaaattttgttatttgtaataatatggatggaattgtaggttatgatgttaagtgaaataagttaggtgtagaaagaatttgattttatttatttgtgggatttaaatattaaaatgattgaatttagagggatagagaatagatggatggttattagaggttaggaaggatagtgggggttgagtagggagtgggaatggttaatgggtataaaaaaatagaaagattgaatgagatttaatgtttgttagtatagtatggtgattatagttaaaagtaatgtaattgtatattttaaaataatgaagagagtataattggattgtttatagtacgtataataaatgtttgaggtgatggatattttatttgttttgatatgtttgttatgtgttgtatgtttgtgttaaaatattttatgtgatttataaatatgtatatttattatgtatttataaaaaattaaaaaattaaaatataattttatttataaaaatcggtttatatgtgatagtttgtagtttttttttatagtatatattttttaagttaaggtttttgttattgtgtaaagtgataaaataatagataatttaaaaaaaaagttttagggtatttttataggatttttagagtatgttagaattatagtttttttaaatttgtattattttatagaagattatataaatacgatgttttattttgatgatttcggaggagtttttaattttatataatatgtttgtgagattagaaaaaagatttttagtgttttatgaggtgatgttgtggggattttgtttagtaagtttttagcggggttttgtgggggtagtattttttagatttcgtttacggtagattatggtgggttatagattgttttgtttaaaatacgttgttttagattttttttgttaggttatttggggtgtttttagagggcggattagtttatttttggtgtcgtgttatttataggtaggaattgtaaggttgtttgagttagtaagttagtttgtattttggagttagtttaaatggttttttatagtgtattgagttttggaaaaacgatttgtaggtacgaggatgatgattggagaagttttatggtgggaagagatagtgatgaggtttgggttgtttttttattattttattagagtgagttttttggtagtcggattttttattttgttttttttttttttttttttttttgtttgagattttttattttatagaagttggatggtgattttggttgtagtatagcggatgttgtttaatgatatttttgttgatggtagatgattgaatgagtttgaggggattggttatttttataggttggattaattttaatgatagaaaattatttttagttgattgagatgattttaagttgattgagtaaattttaaggttagggtatagacgattttagtatttaaattatttatgaggatttttgtatttagtagtttatttttgtattgtttttcgggtatttttagattatttaagtattatttggtgaattatttttttagggtattaattgagagattttgattttttttttttaatttgtaatttttgtatgtaaattttaaattttaaaagatagttttttaggatggtatttaagagattttatagtttgaggatattataattattttttgggagaaggatgtaattagagataaatttttaagtgtttttttcggttattttttggttataggttttatgattaatttaggttgttgtgaagagatttaaaaattaatgtttttcgtttttaatgagatttttaatgtttaacgtgatgatagttagtgtgaaatggaatattgataattttatttagtataaatatttttgttatgtattttagtttaaatatgtgttaagttagttatatatttatagggtttaaagattattttatttaagtttgggagagtgtatattttttaaatttttgtttagtgtaagaggattcgggtataatagttaaatttttcgtaggtttgtaataaattatttttgtaattataagtatgtatagttgattgtttattattgttttatagattcgtttttatttggtagaattttaatttttttagtaaaattgattttattagttttgtatattattttttttgttttttatttagttcgttagtttgttgatagtagagtatatagtatttagtagttggtttgtggagttattagttaggaaattgtatgataaataggaggtagttaggtttcgtggtatttttttttgttttagtagttttcgtttgattttggagaagttattatgtggtgttttgttaaggggtagggtaggagatggttgcggtgtagtaatttattatatatacgtttgagttatgatgcgttatagttgtattgtttatgtgtaaataataaattgcgagttgggtaattatggcggttttggcgataagggtttgttttcgttatgtgggtttttttggatagttttttgggtcgatgatggaatatgtcgttgagttatatagaaacgataaattaagatattagtaaggtaagtatttaacgtttgaggatttaggagtattttttaagaaatgtgttaggattaatgttatgagatgttacgtatgttataggatatgtttatattgttttttattttttatttattttgttaagttatagttaagtacgttttgaattggaagaggggagttttattgtatttttttagaaagtggtttaagaggtgtgatttttattaataattaatataaggtataattgtttatatagatttttgtaatttaggagaagttattttaaatttaattaagaggggaaacgtagaaatagtgagatatttaaattaaaattagatgtttttggttaaattagattatatttattaattttttgttttttatttaaatataattttcgaatgtagaatttataaatttttttgggatataaataagtattaagaatttggtgtagtgttaggagatgtattatatatttttagttagaattaatttttaaatttatagaatattgtggatttaatagtgagaaatgattatttagtgttttagtaattgtgttttatattttttttttaaatttattgttgtagtgttaggttattttattttttattttgaaagagggagagagggtgagagagagaaaatttaaattttgaaagaataattttttgaaaatgagaagatggtagtgttttttaaatgtttttgatagtattgtaggttttttttgaggaagataattttatatttgttgggtatacgtttttgattttatgggattaattggttggtttttattttatatacgtaattattgtaattttattataaatatttatataaaagattgtgattgttatttcggggatatatgaggtatatattaaatgtggaataaatttatatattttgagtgaaaaacgtggttttgtattttgttataatttatagttgtatttatatagagaaaattagatatagttgatatttatttatttggtggagagaattttattatgtagaatatagttaaaagttatgaaataaagaagtgaaaatattttttaattttgatatagttgttagtattttttaaaatagtcgtataaattggtgtatgtgcgatgttttgaggagatgggtacgattttatgaatgttgaatttatattttgttttagtaagtttatttttgtgattgttaagagtagatgatgtgtgttaagtaagaagtttgtagggggtatgcgtgtttgtattggtagtgatagttgaaaggtgtggaagagaaagaagagttatttttatattttatggttatttatttttattcggatttgaatttgattgatttgggtttgttttaaagtttaaaattagtaaatataaattagtatatgttaggtttttaaacgagtgtaaaagatgattttatttaattttttgttgttttaagaagggtgtataattttttttgaaaatggttaaatgagagagaatgtttggttttatagagggtggtttttaattgttaagatggttgaattatgtgtagtaatgaaggtgttaatattgttgaataaatatttaatttaaatttttaaatttattaaattaatttttaatatttatattataaataataatatttatatttttttatattaagtattaagtggtaaatttaaaatataattaatttttatatggattttataaaatgtgtaaagtgtgataaatgaggtcgggcgcggtggttgacgtttgtaattttagtattttgggaggtcgaggcgggtagattacgaggttaggagattaagattattttggttaatacggtgaaagtttgtgtttattaaaaatataaaaaattagttaggcgtggtggcgggcgtttgtagttttagttatttgggaggttgaggtaggagaatggcgtgaattcgggaggtggagtttatagtgagtcgagatcgagttattgtattttagtttgggtgattgagtgagatttcgttttaaaaaaaaaaaaaaaaaaaaattgtgataaatgattaggttattagtatattttttatttgttgaatttttagtattgttgtatattacgatattatagtgatagtgatataagattaaattgatttttttttttttttatgttttttattttttttttatttaattttatgatagttataaagtacggtgagttattgatattttagtaaaatagttttttgggaagttttttagattttagatttggtggtaaattgtagaattatagtttcgggtttttttttggtagattatagagtttttatgaatgttatgtttatcgttttttttatttttattggatttttttttttataaatagagttttatatttttgaaggtagtagggataaaattaaaataagggaagtaatgtattataattttaaaaatatgtttgttgtgtttatattttattagttgtttgttgaagaaaatttggaaaatagagaaatgggtagggaagaaaattaaaattatttgaatttaatattatatatatttaataattatttatttttatttagttgggatggcggtgttgtcgatttcgggggatgtagtcgattttagcggggggacgttttgtgtatttttaggtggtcgattagaatttgttcgttgagagaaggttttattggaattgtttttagagattgttatttttagtattagggtgaaataattggaagttattttgaggtttgtgggtgtatatattaatttttagtagtgttggttttaggtaggtttttagtatgattagtgtggattcgttatatttgaagaatatgttttggtatattttgttgtcgtatttagttttatagatatggagttaaatttttaagttttggatttttttattttgttttttgaaatttgggaaaattttgatttattagttatgtttttaagtataaaatttgttaaaattttttttagtttttatagtgaattatttttttttttttaataaaggtttatttttagtgataatgggtgtgagttattaggagtaagtgggggtgggagagttatttttaaggaagagtatatatttagtagtttaggaattcggagcgttggattggggaaaggtggaagtaggagagggtttgggtttaaggtgaatgttaatattattttgggaggaattttttgagtttggttttagatgtttgtgagtttgagtgggttagtttatttttttttggagggttgtatagtgtttttttggatagggtatagatttgttgtttttgtgtggggattatggaggtttagttcggttaagaaggaggggaatatgtatttaagttaaaaaaaaaaaaaagaagtatatgtatgtatgtgtatattagttatagattttagtaagttttttatttttaaaagtatggtgagtatgggagaaatgaaattggtatttgtattatagtgtttttgtttaaaatttaatttgataatgtagttttattttttaaataagtgtgttttaattttttttttttggttttgtggttttttttagttttttttttttggttagtttgttttttaagatagggagtttgtgttgttttttttttttttgttttcgtgtttgggtttgagttgtagttagttttaggttttgtttttttaggtaggtgtaggtattatttatttagttatattgttgtagtattttatagagttttataattaattttaaagagtttttttataaatttttagattaagtgtaggtagtgaagatataatagtatagtaatgttgttttgtgaatcggaatgttgtttgaaagtgtttatttgatatagattgggtttttttttttttttagattttttttattttttttttgttttttatttttttgtattaattgatgttagatattatgagggtcgttattattacgatttattttcgatttttttattgtatatgtaagtattaatattttttttattaatgaaatggaacgagatgttggtttttattattttaggattttttgttaatggtatgtttattgggttttgaagatgtgatagaagtgtaagatttatttttgaaatatagtaagtttatttgttcgtgggtttattgaagtaaatttttgttgttttttgaggaatgtttgttatattaggtcgtcgataagtattttttatatattttgttgacgtgtgttttgtgggttgtaaatattaaattaaaaagtaaaagtttaatggaaagttattatttagaatatgtatttggtcgatattaggtttgaagtttgttatgtttaaatttttgtaatatgaaagttttgttttggggattataaggaattgtaatgaaatttttatggtaaatttttatagtttttatgtaagtatattagaagttatttgattgatgggaatgttagttaaataaaatggtaaatgtgatcgagtatatggtttatagaaagataaaaggaaagaatgttagtgataatatatattagaaaaggaaaaaggaaattttttggaagtaaatattattttttttggtttggaggaaataaaggatggtggagttgtaaagtaaaatagtatttttttgtagtattgtttaggaaattgttatgtattataataattggagttattttttgggatgggttgttttttgttaacggttttgatatatatatttatttatatttaataattattttttattttgagatagtaaagttagaaaagtataaataatattttgaagaataatgttggttatttagatggtagattgtattttcgtggttattagttatagttgtgtaattatatattatgttaaagaaaaatgaagttgttttaaaataagtttttttttgtgaatagaattaattgatattaataattttaattatatgtttaagtatatatataatattttattaatagttttttggatttattttttattattgaattgtaattttagagtagatttgtttggaggtaagtaataaatttgtgttgtagatttttataagtattaaaggagaagtgggtatttatagagagagaatgtagaaatttgtgattgattttttgagtttttattggaatataagtaagtatttatagggttttgaagtttgttaaaaatattttttaataaaattaggaggttaatttaaaattttttatataaagggaaggaaatttttagtttagtttgaaatatgatatgtaatttattttattatatagaggttttatgatatagatgtgattatatgggttttagatgaggatttgttttatggtttagagtatgtaagggttagatagatttcggagatatggatggttaattttttttagattggagtttttgtgatgtatttaatttaagttagatttttttcggaattttggagttttttatttttttagaaatgatgttttagagtaattttttaaaatgagtttatataataggttgaattattttttttgtatttattatagtttgttttgtaattaaatttaaatatgaatttattaataaaaattttaagttttggttttatggcggaatataatagtaagtttttttgtagtttttattgtgtgttttaggtttttattattgatttgtattggttcgtggtgataatattacgagataagatgcgttatatttggattattttcgtaggtagagtcgggggagttatattttaggtgtgattgttgagttgggttttttttggattttagttttttttgtttttttagttaggttttggatattttattagtatttgattaaatggttttttagtagtttaaatgtataattattaaaaagattgatgatgtaaagttgatagataattttgagttttaaaagataagttttggaagattttgagagggaatattattgttgcgggtatagagaatggtgagtttatgggtttgtggttttttgggattgtttggttttagtgtattttggtagggttttgggtggacgttatgtttatgaagtgggttttagtaagttggggtatgttacgtttttgtgtttttgtgattgatattttgtttgtattggttttagtggttttttttttttgtatggtgaatttttgtttatatttatttttaaggtttaatttaagggtcgttttagagattcgtatgtagttttgttgtgatgtttttttttttgtttggtgatttattgttaacggttattgtttttttttagttttaggggtagtgtttagtatttggttaggtattttgtaaaaggtgtttagtggatatttatattggtttagtttgagagatagtggaggagtagttagagagttcgaatttttgtttttgtgttgttatttatttgtgttgtgtattttggttattgatttttgtatgtgttggtttcgtaacgtggaaatgaagttgtttgttgtatttatttttttagattatagggagagtttaatgaaataatgtttatgtaagtattttgaaaagtatagagttttaaataaatgttgaaggttggtattttaggtagtggggggtatgaaaaatattgggagtttttattttgtttttgtttagttatgagattttgggttgtttttgtattttttgaggtatgataagtagatatttgtgattattttgaaagtggaggttaatcgaggtaaatgtggtttggttatagaaattttaaaagtacgtatttgttaagggatgaattagttatttgggaaagtaaaattattttatttaaaatttgaattttaaattgtttgttatataattgttttatagaaaatgagattaagtgaagagtattaagtttttgtaatatttttaattttaagaagataaaatttggagatattattattattttgtatatataattgtttttttggtgttagttttaaaaattaaattacgagttttttaaaaataaggatttgtgttgatggaaatgtcgatagatttttgtttagaagaagggtaggcgtttttataattatgttattatattttattattaaagattttattgaaagaggtttataaattgtttttttttttagataaattattttatattaaggtattaacgatatggtgtagaattaaattaaaattttataaaatgaaatatgtttcgtattagttgtttgatatttaatttgtttttgaatgagtagaggaaattataaattaatttgtttttgtttttttaattatggtttattaggtgttagaataattgtaattatagattaataataattattaagttttataaatatgtacggaaatacgttagtttgtgttaaagaatttagtttgttaaacggaatgtttttagtttgttttgtttatttttacggtgttatttatagtttatggttaggtagtgtagaatgagtatagaaatttgaatggatttaaatatattattagaaataatttataatttattggtattttgttttttaaattaaaattgtgaatttagatttagaatttttaagtaggatttggaatataagtagtattattttttgagttgttacgtaaaggttgttataaaatgtataatttttgtattgtatttgtttaatttaagtaatttgaaaattaagaaatattggatatgaggaattttttcgttttttcggaaagttattttttattgaatttattaggttttaggtttaataaataaatggaatgttgtttttttttttttttttttaaattttttgagagatttgttaagttagattgtaagaagtataatgttttagaaaaaatattagagtgagtttattttattattgagattattttgtgtattaatgaaagaatttgaatttatatatatatatttttattttatgtgtatatttttattttttggtttttgtattttttgttttgtattgttgatattagggttgttttttttttaattcgaggagatattattgtattttatgggaataaatgatgtttgttaggttaaaaataagtattaatttttaaaattttatttgggaatgtaggtaattggtatattatagtttattattttagaatataattgtattgttaagtggttattttttatagtaataattaaagtatttttttttttgtattttgagtgtgtgttttttgttttttagtgttagaatttaattaagtatgttttttttttaaaagtaggtatggtgtatttgtagaaatttaaattataaagtagttttaaattttaatttgattttatttattttggattttttttgggaaaaagaaatgtagtttttatgtataatttttttgagttaaggttttttaatttatggattagtattaattgaatttcgaattgtttttttgttttatattgagatttgtaatttattttttaaagtagggtttttggttattaatttattgtaataattaagttttattaatttttttgttagtcgagttgtgagttgtttttgttttgtgttgtggatgtgaatagtattgtattttaagttagtttatataaaggttgttgtattttattatttattttattaatttattttcgaaaattagtttttttgttttagggaaaatgagtatttatgttttgttttgtacgttagttttttttttttttttgttgagttaatgtgtttttttttaaggttgtttgatattttttggaattattttatttaagtaaggagagttgttttttttattaaaagtggttatttttttttattttagggagaggatttagtattatgaagattattaatattagttgtgagatagagtgtattggaaataggtaaggtttcgttttcgtaattatggttgtttgttagggatgagagtagggagatgagaggtaagtttggtatatgaataaatatatttttttttagagagaaaaagttttaagaaaaggtatattattatggtaaaagtttagagaaggaaatagtaagtagatgattagggttattattgagttttttttttttaaatttagtacgttgtttgttttggtattatttttattgagagtttatatatttattttaaaggagtttttttagtttagttgtttattgaaaatattatattgggtttgtttatgtaatagtgattttattcgttgtatttttagggaagttttcggtaaaatatggagatttagtaaaattttataattatatttggggttaaaattagtttggaatattttaatagtgtaatttaaaattaataaaggaaagttttttttcgttttttttatttagtgtttgtgttttattataatattattaagattggtaaagtgtaatgatatattaaattgtaaagtttagtaaatattgtagtaaattttaaaatattttttatcgtttttttaaaaaagaaaaagaaaatatgaattaaattataattatattttttagggtgaagacgatttgtgtatttttttgtatttgttaggttgagtttatgttttatatatggtagtttttaaataaatattatttttaatgatgataaaaataatagggttattgttatgattattattttttttttgtttttgtttgagtgtgttatttcgtgttaataagttaggatttaaaaaataaaagtttagtgattatttttgatagaatagattttattaatagtagttattgttatattagatgttttttattgttaaattaattttttgatattaaagtagttattggtttttttatatgattgagtgttatttaatgtattgttgttttttagagtcgatatatggaaataaaatgaatgaaattagttattttaaatgaataatttaagaagattatagtaatattaaagataagggtaaaaaagagatgaatagataatttagatgaaaaagtatataattatgattatagttgatatttttgaatatttattataggttaagtataatattaaagattttatgtagttataatatttatgtgtgttaatatttataataattttatgttggagttattagttttattttaaagatatggaaattttgatatagagaagttatttagtttataagtaggtagtgtttttgagttaatttaggtattagattttatatttttgtttcggatttttatgttttgttagtgaaaatgaagattatagatttggttgttttagtttttattttttggatgagtataattatttttaatagtatttgataggaagtttttagtgttattggttgttattgttttttgtaaatttttaaggtggaaatatagtagtgtgcgaagagttataaaaagttacgtttaggttttttgatttaatgtatttattgagtaatttaaaaatgagatgtttattagtttttgttgttgtagaatgtatgatattatataatagaatagtttatatatttagttattggagtggtttggtaaattgtgatttattaattgggtggagtgttgattaatatttaattatatttgagaagattttgttagaatatgggtagataataattagtgattatagcggtaaatttaatagaagggaagttatgttagaatataatgtgtatttgcgtagagttttttttttttagatatttatggtttgttttttttttttatatatttttttgtttagtttttgttttttagagaggttttttgtgaataattatttaaaatagggattggtaaattgtggtttatgggttaaatacggtttatggtttgtttttgttaataaagttttattggaatatagtgatattttttatttagtattatttgtggtagttttagtaatataagggtagagttgagtaattgtgatagagaatatgatttggaatgtttgaaagataaaagtttgttaattttggtttaaaataatattttttttttatttttattttgtatttttttttttgttttattttttttttttttatgagtaatgttatgtgttatgttttttatttttatgtttttttattgttattgtttatattttttattgtatattatgttaaattaaaaaataaatgttttattatttggttattatttttcgtgattaattgaaaaagtttaagttttgtttaatttttaagaattattttaggttatttatatatatagtttttttatagttaggaaaagatggttgagttttaatttttaaatttttaaaattttgatgagcgggtatataaatttagattcgtcgatatatattttattttgcgttaagaaataattataaaatagataaattgtatttaaagggtgtatatttttttttgttttgtagtatttttaatgattgaaatattgaattcggtttttagttgtagagaaagtaggttttaattatagtgtatatttagagtttgagttttagttttttggataaaatttttgtgttttttgtgttgcgtttagtagtacggtttaggagtagatattgattgaggtatttacgtttattgaatcggaagtcgtcgattttatagaggttgttgttaaatttgttgcgggggtttgggaggtattgggttgtaatagatttttttttttgagtataatgtttttatttatgttaagtttggttttaaagaaaatagaaatttattgttgttattttatttatttttttaagtatgtgtttgagaaaattgaattttaatagaatttgttttgatgggaagatattttgaggttaggtttatatggtgaatattgtttaaattgaagttttttgtagttttttttatgtggtcgttttttttttatttaggtaatagagttttattttttttatttaaataaagatatgttattttttatagttatattgtaagttgagtttattttagattttttttcgggggaataaaggttaatgatatagggttgtttgttatttattgttgttattgttgtatttttatttttgtttcggggaaaattatatattagaaaataaatgttagtagatatgtttttaggaatttgtttgttaattttttgagtatgaagtaatagattagttagattttggatttttagtgatttaagtaagttaagtatattaaaaggaaataggaggagagaggtggattttgaaatttatttttggagttttgagaaaattagggatgttttggtagagagttatattgaaataaatttgaaaaatataattttggttatttttagttttgatgtggattttgtaaaaggtagattagagtagaaatgggtatgattgtgttgtagtttagtaaaaattaataagttaaacggtttattggtttgtgtttattttttgtgttgatttagttaatttggtgatattgttttaatttttataattttgtgttgaaaaatattaagtgcgatgttagaaatatattttgtttttttttttttgtgtgtgtttatatacgtgtgtaggaagaaaataatgtagggagaatggttagagtggtaggaattgttttagagtatgtgagtgtatttttaataaagataaaagtgagtgtttaatttaaagttataggtttttaaaaattttattatttaatattttggtatgtgtagtattatatatgtttataagtgatagatatttaaaatttttttatgtaatatagggaggttatagatttattaaaagaaaaagtttttagttgggatttttatagggaatggaagtttggttttagattgaaaatttgaattaatattaaaatgaattgtgtgtatagttgtttttgaagatattttttttaaggttttttttttaaggtttttttatatagggttttttattgtttggaagtatttgtaaattgtttttaaggagttttgtgtatattatggttaagtttagtatggtttaggtagttagtttaagggagttaggttaattgggtatagtaaatgatttttttaggtttgataaggttaatatgttttttaaaatttgggaataagttatatatgaaataggaaaattgttaatatttttttaaatatatttaaatagtatttaaatattgttaagtttattataagtgaatagtatttttattatttgatggggagtggggagagggaagttttagagttaaatgaattgttttatttgtaaaataaattattaaattatgttgtttgaatatgttttatatttttaagatagtatggaaataaatatttttagtttattaaaatgttttttgtttttgtttaaagtaatttttggtttttttatagagtaaaatttttatatttttagtatttattgtcgttaatatatattatgtatattaaggaaagtttttaggaataaatttagaattgtaagtttataacgtaagtaattagatttttgaaggggtttttgattttttatatgttatttgttagggatataataaattaatattagagttatgttggattatgttaatatttttattatttgttatgttgtattgatttatttaaagtaagtattttatgtttttttatatatttttattatgttattgtatatgcgtatgtattcgtatagtatttatttttgtttgtgttttttgtagtattttaagtttgtttttgggattagttagttaaagatagtatggttttttattttaaaggaagtagttaagagggggaaaagaaggttagttttaagtattttaattttgttttaatgattaaagttattttagggttgtagtgatatacgtagttattggattgagggaagaatagtttaagttaagagtttattggaaatagaagagtgaggttggagttgtgagtagaggtgtagttttttttagaaagttatgttaggttttattttcgtaattgaatagttgtacggttgtggatgttgtatattgtttgtgagagagaatttttaaagtttaaatttttgaatatttttggagtttttttttattttttggaatgtggggagtaggttgtggggatttgatttaggaggtgggtatatttttaaaggttttttcgtgatttgaagtgcgatttagagatgtattgtattatatttaatttgtgttaatttttttatttttttttattttttaatttagatagattggattttttagttatttaggttattattggtggtggtttttgtgtttgttggaggagggagttgagttggaagttgggagttgtggaagttgaattggaaggagtgaaaagtagagtttatttttttttttcgagtgtattggagagaaatatttttttttggtttgtttgttttgtaagggtgttttttgatgaggtttttgttttaggtatttattgaagttttagtgtatttaagttttagaaaagtttattggtttttttttgttttttttgttgaattgtttattttgttttttttttatgaggttttttggttttgttttgataacgtttttttgtatgaattatattttttcgagttataagttttttaatttttttagtttatttgatttcggtttgtgtgattagtttatggtttcgattcgttgtgggtttttgttaagtagagtgtttgttaagtgtttttaacgtggagatttaaagatattttttaattttattagtgaggagagtagtgttttattttagtttaataatatggttattcgaattattattagttttaaaattagtgaaagaggttattaagttatttggtttttttttagtgtgaataaggttattgaaggagggtagtttaggtgttatatttaagtttaagttagtaatataaattatttcgtgtagggtgagaggggagtttattagttttatttgagttaaatttatatatttaaagaattttattataatttgtataaaatggattgttttatgtatagaaataatgaataataaaaataaaattattcgagtattttattataattattatatttttttgtatatatgttattttttgaagtatggtttatgattgggatagaaatgaatagttgataaatttatgaattatgtttttaattttattaataaagagtaaatattttattttttaatgtattatatttttaatgtagatagtggtaaaatattgtgatatagtttgataaaatttagttgttttaaaagtaaaatttttatgaagggtatatttagttgtttttatttgtttttttgtgtatgagaatttttatttttaataagtaggtggggtgtattgtagttaattaggggtttgtatttattgataatgtatttgggagtagttttaataataatttaaaagtattaaataataatatttaattaatattaaaataataattttaataaattataaataaaatataatttttataaaataaaaataataaaaaagaggattaaaaagtttgttaggaatgattgaatatatagtttgtgatgaaaatgatatagtataaatatttatttttaatatagaagtttttttttaaagaattggggaagtattaagtagtggggttagggtttggttttattggtatttttttttttttttgttgggtttggtttgaacgaggttttttggggtttgatttttgtgagtttttaatatggttgtgtattattggagtatagacgttattgtgaggttttttgtttgtgttttatttagtaaataaatattttattgtataggattaagttgtttttttatagagggaggatttattaggaagatgggagttaaattttttttggttagaaaaggtattttttgtttggagtgggttttgtaaatagaatttttagtgagttgaattgtagtttttataatattttttgcgtaatatagttaaatattttttatgagtgtgattggattatggttttgttgaatagtttttttgagtatattttttttttatttaataatatgttggttatatttatttatgataatgttatttggttgggttttaaagtgtaattttagtaaatttaaatatagtgttgttggtatatggttttttatgattattttcgtaaaataagttaattatttgtttttataatatatgtggattttagtgaggttttatttttaattttattataagttaatcggatttttgagtatttttcgttatttttgtaggttttgtttttatgtataaaataaattaattaaatgatttttaagattttttttagtttttaatattttatgattatggaaaaatttaaatttgttcgttgtttttttttagagtgtggatatttataaggggattttatgaaaatattgtggttttgatatatgtatgtttatatgttatttttttttttaagttataaagtttgttgtttgtattttttttatgtgaagttttgttgaaaagttttgtttgaatggtggttatattttttttattattttttatattttgtaagtgatattttgtgtatattgtagttattagtgtgatttgttatggtattataatttgaatattaatttaaatagattttttttggaagttaaggtagttagataattatattatttttttttattaaaagttttaataatgttaaaaatgtaagtgtaggtatatatgtatatgtgtatttggtttggggtagtttttttttgggtttaaaaatatagattttgaagtatagattgggtttgaatttagtttagatatttattgttagattattgaatttgtttaagttagttttattatttaatattattttatattaaggatttagtaaaggagtatatatatagtatttaatatagtgtttgttatagtataggtatttgacgaatggtaggattgtttattatatatttatttttatatttaaattatttattttaagtagtatatttttttttttattttttaatatttttgaagttgggatgtattttataatttatagtgttttataattgtttattggtgaagtggtagttatgaggaagttttaggtattttttaataaaataattttgtttatattttttttttttgtatatgtgttggaatgatatatgtttaaaaaatttatgtttgaataattttaaaagagtttttttaataagtaaagtaaaaattaaaagtgatagggaattattatttttttttagtggtatttaatataattttgtatttttagattagtaatattttagagttgaggatatgtagtatgttatatgtatttgtgtgtgtacgtatgtatttggttaaaaaattgatttattgttaagatttttttttttgagagtttagttatatttttttaaatgttataataatggatttagttgtaagaatgtaaagttaaaaatgtaaagagaatgtttttaaaatgttatagttgtttaaattttgtaaaatgaaaaacgagtatttttttagtttggaatagtttataaaggaggtaagtatgtgttgtgtgatggttatgttggtgtatttgtgtagatgtatagtataggttttgagagggtaagattttatgattaatggtgtttatttttgatagaagttttttttatttatttgtaatatagtttagcgattttattaggtatttgaatgaaaaatatttagttatattaatattgtagtgtaaattgaggagagttattttttattatatttttttgttttattatttgtatagtaattttttagtagaggtttgatatggaaaggttggatttagttgtatttgatataaagtttttttaattttttttaaaagtttaggttgtttttagaaatgtgtgtgtgtgtgtgtgtgtgtttgtgtgtgtgtataatatataaatttttttttttatttaagtaattttaggatttgaaagaataaagataaaatgtataaatttggatgggagaaatgttgttaatataaaaatagttgtgaatttattggtaaaagtttttttagtgttgaagtttgtggtttagtattgaattttttgtaaggttacgtggttttatttttttttaattaattattatttaaatttagttagtataaagttagattttatcgttttttttgggagtagtattaaagttgaagattatagtggtttagagaggatataagttgttgtaatgattgtgatgttattttcgagaaaggaaaaagaaaagagtttttatttgtaggatatttaagtgatgggttattaaattttaaataaaagtgtatttaagtaatagattttataatatggttaaagttaagtaatgatagataggggaatatggtttgaattatagaaagtattggattttaggaataaatggggttttaaattttgtgagtagaatggagattatttattttaaagttttttatttgatagatgaaatagtgaggtttaaaaagttgtttttgataagattatggttttgtgtataggttttttaagggtaatatgaataagtaatttttgtatattatagatatttttaattagatgaatttttttttttttatggtattggaagatttgttttttttttgaagaaggaattgtagaaggagattttgtagttttttgttaagtagttagatttatttttagttttttatgatgttgttttttacgttttgagtaaagttttcgaaggttatgataataagatttttaagaaaagtatttttttatgtagaagttgatgttgtttttttgttgaataatatagataaattgttttttattattatatatattttatagtatattatatatattttttttttatatgtaatttaattttgaaaagttaatattttttaaggggataaagttttgaaatattgagaagtatgtttaggatataaagttttagttttatatagtagttttataagttttatttttagttatatttaaagagtttgttattttaaaagggtttattttttttatttttatgggattaatggttttagtaaattttgaagattttattttggaggagagttattgaattattaatgatagttttttgttggatatttttatataatttaaaataaaggtgattaaaagaattaggggaagtaggagtgagatgttaaggtttaagggataatttaaaaaatagattagttagtagttaatagtaataataattatgatgaggatgatgatgatattaatatggaaaaagtttttatattagttagaagatgagattattgttgataaaagatttattttgatttttgaggtagttttattgtttttttggtttagaattttaggtgttttttgtttttgttataaatattttttataatatttgttattagatttaagattaagtaaggattaaatagttggaatttaattttttgtttttaattaattatatttatttagtatttgaagttttttgaggggaaagtttttgtttgaataatagattttgttttagtgttgttgagatttttaaagtagttgtttattttgaattgttgagatttttatgtaaatgatataaatatgagttggtttgtttgtaaatagatttaattgagttttttgtatgtatgttagagttatttttttttatatttgatgtgtattatggtttagatttaaaagtttttgttaaaggaaattatgatggataagtttttgtattgttggaaaatgtaatatttatataaataaatgttatttattttaggagttttttaggtatagttagtttattatagagggatttagttgtttgaggagttattttttttatattattgggtgttaatatttttttattttgttttgtatttttttttggaaaggatattattttgtttatttgagtattgtttttgagatggaattggtaatttattaaattatagaaaataggattggtagaattaatggaaaatagagaggaaagttatagaaattaaattgattaaaaaatttttgttttttttatttttaaagataaaagtttttattttttttttttatggtaatgaagttgttgaattaaaattatagaattattatgtttttgaatttattttgaagaaaaaaaatttattattttaattaaggtaaattaaatcgtttaatttatttgttaggagaaaatatgagatgggtgcgtttaagtaatgtcgaagtgatattatagttgaatttattcggttataaatagtttattttttattaggtttttgagggaaattagtatttaataaggtaacggaagttaggtgattttggttttaattaatttagagttttaggaatggtagtagtagtaggaatgaaggtgttggttgtaggggttaatatttattgagaatttattatgtgatagttattaggttatatgttttttgtatatttttttgttaaaaaggaaatggtatagtgttgtcgtttttttgtttgggtttaagtagttggagagtaaagtaggtttttaaggatttagtttatttaataggtaaatttaagtttaagattttgtaattggtgtatagaatagtttattgaatgtatatttttaggtatagggagtaggagagtgagatagaaggaaagatttttttgattttttgggtttggttggattggtttttgtcgtggtttgttttattggaggaaaagggattatttaagggaaaaagtttggttgattaaaggtaattatttgttattttaggggaagaggagaggaaaggatagtatttgtgtgtttttttaatgtagattagttaggaaattgtttagaaaatagagttttattagatgttatagaatttaattaatgagagtagttttttatcgtttatttaatatggtatttaggtggtaggaaaagaattgtaattggatatatgaatgttttttttgatagcgatagttgtttttttattaaggtggtatttttgtggatattgtaaagatggatatagtatattagtttttttaataatgaattatatttatttttattatattaattaatttataatttgtaattaagaattataaatgaatattatatttatttatatttattaattttattttatatttatataatatatatattatataataaaatattttatataatagttattggttttattttttttattaattttagtaattaggggaagaagataagaaaatgttttttatttattagatattgtagaaataaggatatttttgcgtgaattatttggattttatttggaggataaaaaagtttgttaaaataataatttaatatataatgtgtatttatggaattaaaatatttaaaatatatgttatttaaaaataagttgttatttgttatttggtttaggtacgtttttttttttattttttttttttttttgtttttaattttaaaatgtgagaaatatatattgagttttttttaaataaaagttagtgggatagaacgtagttttatgttatgagatgtggttatttagtttttaagtatttatttgaattagtagtatgtttattaagatttttttttaataatagtgtattgtatgttatagtggttggaatggattttttttttaattttttgattttgaaattttaatttattaatgagttatatttatagtatagagtagagataaatttggtatattgttttttgtagttttttttggaaggaatgaaattaattttagttataaataattgtattgtttttgtatagtgatatttgtataatattgttttagttgttggaagaatatgattaatatgtatttgtttggtttttttttttataagaagtttttttgattggtttagcggtagtttttgttttttttaaagttaatatatagatgtttattttttatagtttattttgaatttagattaatgtgttagttagattatttttgttttatagtagtagatatgttattatttatgttatttttaaagtattaatattttgtaagttttgagaaataaaaatgtgtattaatttgattttttgaatttaattgaaatggttgaaattattgtgggaaatttcgatgtatttggtatgtatttttttaaaaaattattgatgaataatatagagaaagttgtataaaatgtatatatgtagtttagtaaatgatgatgaatgattatggagtgaaaatttttaatttaatagttttagaaatagaatatttttatattttataagttttttttttatattttttatttatttgaaagttaatattattttgattattttaatattgaagttgatttttgtttgttaaagaattttatataaatgggattatatattatatttttttgtgttagtttttttttttttttagttaattttaatttttttttgatgaattttttattttatttattatatattttttatttttaaagtttttttattatatattttttattttaatagtttttggggtataagtggtttttggttatatggatgaagtgtatagtggtgaagtttaagattttagtgtatttgtgatattagtagtgtatattgtatttaatatgtagtttttttattttttattttttttcgttgatttttcgttttttgttgttttttagtttttaaagtttattatattattttgtatgtttttgtatatttatagtttagtttttagttataagtgagaatatatggtatttggttttttatttttgagttattttatttagaataatggtttttagttttattcgagtagttttaaaagaaattattttattatttttatgggtgttgggttttttttatttattattatgtttgtgagattttttatgttgtagtttgtttatttttatagttgtttattgttttattgtatgtattatttgtttattttattgttgatagatattaggttgtttttaatttttaagtggatgattaatgttgttatgattttttgagtatatgtggtatatatgtatacgtgattgttttatatattttaaagaaaaggattgttggaatatatggtaagaatttgtgtaagtatttaatgtttgattgttttttaaagaggtagttttagtttgcgtttatattgagagtttttgttggtttaaatttttattaatatttgttattgttagattttttaattttagttattttagtgggtgtttaatgataatttattttggttttaatttgtattgtattataaatgatgtttatggagagttagttaaaagataatagaaaaattttattatattaagaaataaagtataatttaaaatatatgatttttatttttaatatgtaagaagtgtataatgtttgagaaaatgttggaagtaattatgttaaaatgttgatattggttagtttggatagagtgaatggttatttttttttttaaataattatttgttttttttatttatggaatattaagtttttttatatttagaataagagattttttttttttttttttgagacggagtttcgtttttattgttttggttggagtgtaatggcgtgattttagtttattataattttcgttttttgggtttaagcgattttgtagttttagttttgtaagtagttgggattataggtatatattattatgttcggttaattttttatttatttatttatttatttatttatttttgtatttttagtagagacggggtttttttatgttggttatattggttttaaattttttattttaggtgatttattcgatttagttttttaaagtgttgggattataggtacgagttattatgttcggttaataaatttatttataaaaattttttgaagtaatgttttattattaaaataaatatttttttttttttttttgtttttaaaaaaattagttttagtttttaaattttttatgtaagaaaatatttattattttagtattaatgtatacgttaagtaatattttagtttttatttttagtggttatttttatttaaattatatttattttttgtgttggtttattgtttatattttttatgatttatatgtttttgggagttttttgtgaatgttttttagttgtgttattatttattaggttatatttatttatatatattttttttgagtgtagttttttgttttatttgattgtaggtttttttagagaagagattatgtaattatgtattatgttttttgaaattttttttaagtgtagaaattatagcggatttttagggaatggatttttaataaaatgttatattagtttatttttatgttgttgataaagatatgttcgagattgggtaatttataaaagaaagaagtttaatggatttatagttttacgtggttggggaggttttataattatggtggaagatgaaaggtattttttatatggtggtagataagaggagagagttcgtgtagggaaatttttttttataaaattattagattttatgagatttatttaatattaggagaatagattcgtttttatgatttaattattttttatatgttttttttaataatatatgggaatttaagatgagatttgggtagagatatagttaaatgatattaaatgtatatttaatgaagagattattgaaatgtttatttgtgtggttatatatgtagtttttaaaaattaaaatttaaatggtaaatttgtaaaaagtatatgttaattaagaatttatggaaaaatattttatagttataaagatgatgaaaataggattggaaatggaattattttattaattaggggtttgggggttgatggagtgggtatgtatagaggtgtgggtagggttaaggggataaataagtaatagtaaagtttttaatatagttaaagttggaatgaaaaagtgatttagtgagggttggagtagtagaggagggttcgtttattaggaatagtggttttgggggagtaatgttatattatagagttatagttagtagagagggaggaggggatttgttttttttttttgttattttttgttttgttttttttaagtggaaatcggagggaaggcgagttagttgatttagattttaaagacgagattttttatataggttgtggttttggggaggaggaagagtagatggaaagtaattattataattatttgtattttttagggttacgtggtgtttttagggtagaggttatttgaaagtttattttgtatagagggaaaaaaaagtataggattgtgtagatttatgatagtgtttattgttttatttttgaatattttagatatttgttttttttagtgtatggaaaggaagaaaaatatatatgtgtatatatatgtgtatatatatatatatgtgtatatatgtatatatatatatatatgtatatatatatgtgtgtgtatatatatatgtatatatatatgtgtatatgtatataggtatatatatatatatttgaggtaaggttttatttttttgtttaggttggagtgtagtggtgtatttatggtttattgtagttttaattttttaggtttaagtgatttttttgttttagtttttcgagtagttgggattgggattgtaggagtgtgttattatgttagtttaatttttttatttttatttttttagagatgaggtttttttatgttgtttagattgattttgaatttttaggtttgagtgatttttttgttttagttttttaaagtgttgatattaaaggtaggagttattgtattgggataaaagtaaatttttttttataaattttgatttattaaaatggtatttattgaataattaattaattggttaaaaatgtattaaaaagaataattattttttgttttttattagattattgtttgaatatgaagaaggatgtttatttgttatatttaaaaaaataaaaaataagtttatgtaaaaaattaatatattttagttttttagtagttggagtagttatgtagagatgtaggagatatgtgtatatttttagtattttaagtaatgtgcgagtaaattgtaataatttggtatgtaaattttgtttaatgtttttataatgggtaatgtaagtgattaaatattgtgattttaattttggtattttagtaatttagtaagatagatgaaaaggtagtaatgaattagattatataataatattttattttaatttagaagtttagttattttttgtaatatgttttaagttttttatggtgtattgttaaaaatgttttgataagaattttttatttttttattgtaatttatttttatgattatataaaaaatattttgaaattaagttatttatattaataaatagtttttattgggtaatacggaaataaaatgttagtgatttattaggtttttaatgttttggaagatagaggggtagaaatagtataaagggttttatttttgagaggatatagaggtattgtatataggagttaagatatagggataatggggcgaggtatatttttttagttgtgttttgtagttttaataatattttatagtttgggaatttttggtgtttagatagtagtttgttagatttagtttggagggttataggtatatttttatatttttttgttgtaatataaatagtatggaatgtttgtttttggattagttttgaattttagtgttttttttagaatgtttgtttgttgtttttttttttttggtttgtgtttttttttaatgattgagttatagatagttttaggatagagagaaggtggattgttataaagatcgaaagcggtgatttttagtttatttttgtgtgtatttattaaaaatgtgtattaagtagatattatagttttttttttggtattatttttaatttttaaatgaagatttttaataagttcgataaatatttattaggttaagttgatgatagtttgtaggaaaatatatgttatttttatgggaaattttgtggtcgttttttttatattttttttgttttttttttttagtggaatttagtttttttttggttataattttgagtgttttttatatagtagtgaatatacgtttgtttgataaatttaaggagtttaatttttttttttagatttgttttttagttaaaaatataataattgggtcgggagttatggtttacgtttgtaattttagtattttgggaggtcgaggcgggcggattatttgagattaggagtttaagattggtttaattaatatggtgaaattttgtttttattaaaaagataaaaatttagttgggtatggtggtatatgtttgtaattttagttattcgggaggttgagataggagaatcgtttgaattttggagggcggaggttgtagtgagtcgagattgcgttattgtattttagttcgggtaataagagtgaaattttgtttcgaaaataaaaaataaagttataataattgataaatgatttagttgttaagaatttgaagatggtttcgttaggtaaggttaaaaatatttttatttaaagattatttatatgttaggaggttgtttggttatggtagttgaagtttggatgtttagttttgtttgtttagaaatttatttttgttatattttagtattagagaaatatgttaatttagtttacgagagtttaatgtggaaataattaataagtgattatattttaatgagaaattgaatattagttattgtttcgttagggaataaatcgttatttggatttttttttttttgagtttagaattagaagaaaagaagtgttgttggttggttttataagaatattaataattatagtatttaggtattgtgtttttatttttatatataggattttagtttttacggtagtttttggagggagttgtgattgttttaattttgtgtataaggaaattgatgtttgagtgagggaataagtgaagaaatttttaaattttatttttttaaagtttttgtatttaattattgattttatttttttaattattttatgtgattttatgattttattaagggaggttttggaaaatttaaggaggtgtttttaaggtgttgttagggagaggagtaaagtcgattggtgtgattagatttgttatggaaaggggatttttttatataaaaaatttggatatagatgtttatagtagttttatttataattgttaaaatttcgaaataattaagtttttttttagtaagtgaaagagtaaataagttattttatataatggaatattatttagtgttaaaaggaaatgaattttgaaaaaatatggaggaaatttaaatgtatattacgaagtaaaagaggttaatttggaaagtttatatattgtttgatattttggaaaaggtaaaattatggcgagggtaaaaagatgagtggttttttggggttgggggttgggagaaggaagaagggaagaattggtgaaagaggatttttaaggtagtgagattgttttgtatgatattgtaacggtagatatatttgtttaaattcgtagaaaggataatattaagagtgaattttaaattatggattttgggtgacgatgatgtgtgagtgtaggtttattattcgtaataaatgtattattttggtagaagatgttgataatgataggaggttatttatatgtagaggttgggggtgggggttatatgggaaatttttgtattatagtttaattttgttatgaatttaaattgttttaaataaagtttgttaataaaaagaatgttttaatattttaatatttgaaattatatagtatgttgtatttgttatttttattatgtatgtatatatgtttatatgtgtgtatatatttgtgtatatatatatatgtgtatataaatatgtttgtgtatatgtgtattatgggtggaatatgttagtatagtatgtgatgtatatgttatatatgattttatatatggatgtatgtgtatatttgtatatatgtgtgtgtgtgtatgtgttgagtatttagtatatattaggtttagtatatgagattttatttttgttaattttttaagatttttacgaggttattttttttattggatttttaaggaagaggagaaggtgagtattaaggttgaggtttacgtatattgagttttattgtttggatatatttgtatttagaatttttgatgatttttttatgattgtttgatgtatttgtatttttatttttaaattttggaggaatttttttttttattgttgttttttagtagtatgtaaaaggatcgtagagtttagtgtttttgttagagaagatatgattaggttttggagttttattcgtgggaagttggtttagtaggtatttttagtgttttggtgggaaaggtttgaatttaagtgaagtagtgatagggatattagatttgatagatttttgtgaggagaaaatagttttttaggttttttttgggattgatgattattttagtttggtcgttataatttttgtgtttttttagatgttgattggtttttttgtgtataattttttaaaatagaatttggatttttagggatatttttattattttttttaattttggaattttggagaaataataggttttaatttttgggtaaattaagaaaagttagtaagaaatgttattgtttattttgatgtttagtttatgttgtttagattaagttatttttggattgtaaaagttggtttaggaggcgttattttatggtttttttgaaatagtttttttgtattcggtggtattagttttttagtggaaatttataaataagtttgtgtttagaattagattggaaggattgtttgtttttttttgtgaagaataaatgaatgaattagagtattttttgtattttttaaggtagtaaatatatttaaatacggtgtaagatttaattaatggcggatacgtttaaatggagtttaggggttgagttaataaagaatagaaagttaatttgttttgtagtaaagagttaaaataggaaagattaataggttatgttgatttttatttaaataagttattttattaatttttgattgggtgtgaaagttttaagttgttttgaaaagaaatagttatttgttggtggtgattttttattttttttatgtgtaaatttagaaaattttggatttttattttgtttttttaaagtagtatttaagtaataaataaaaagttttattttttttttagtttaaaatgaaaaaagagttagaaggagaaagtgagaaaatttatttttattattatattttaattttttttattttttattgagagaaaatttattatttgatttttgattttatttattttagtgtttgcgttgtgtatttagtggagttggtttttattaagattatattttgatagggtgatgggggtcgggttgtgcgtgagtatttgttttgtaaggagaaaatgtgttttttttttttttttattttatttttaaagttagtggtggaagaggaatttgttgtttttagttgatttttttttattagggttttttttttttatggtcgtattttttgtgaatgaggaaaagcggggagtataattgtttaatttgttagagttagttttttgattatttatgttaaatgtttttcgttagagaaggaatttggtggtttaggaggttatgtagattggttattttagaagtggttgttttagggtgtggttgtggttatggggtagtaggtgtgaggggattttgaggaatttttttttagaagtagattaggatatcgtggtagtaaggtgtgttttagaatttatttttattaattaaaagtttatattttattttagtttattataatcgacgtaagggtttgattgaaaatgtatttttttttaattttttaattcgggagtatttagttgttattgtttattgaacgtggtttatcgggatgttttatggaaaagggtttgagtagaaagttgattttaggtgttgttgtataaaggggaggagttgttttttaagtatttatatttggatttataaaagttattttatttattattgcgaggttttgggaagttaaatagatatgtgtttggatttttagagtgatcgattttttatttttaagtagatttttgtaatgggtttttttttttacggatagttttgttatgtgtatgattaggtttttagattagataaatttgggattgtatttttttattttgttttgttttgtttttttttttttttttttttttttttttttttttttttttatttttatgtaatattatgttagtaagaggtaagttttaaatggtaatattaatatttgggttaagtggaaaatataattgtagtaattattttaagtttagttgtttgttatttagaatttttttttatggaagaagttataggttgatttttattttattattttggagtgtaatgaagttttttagagattaatttatttttttaaataattgtatagcgatgttttgtttgtattatattatgttgattttaaaataatagtattaatatgtatttgtttgtagttttttttataaggtttttttgaatttatttaaaattttatttatttttttttagagatagtttttgtttgtggagatatttgttttatgtatattttttgtatttggttttttttgtatttaggattttcgttttatttagtagttttacgtattcggatttgttttttattaggatttttttatatcggaattttattgttgttttcgagtttttttttagttttttatatttttatattaatttttatatggattatattcgttttttgtatagtagtttatcgttttttatgattttagtaattcgtgggttgagttttatagatggtaagtttaggatggattttgtttttggagattatgtagtttttttttcgttttttattcgggacgtgtataaagtagatttgatgtttagtgagtgttttttatgtgttaggcgttgtgttttgtgttttatatgtatgattgcgttttagttttgtaatattttattggtagtggtgttattatttttatttttatgttagaatagtagcgtgtagtggggtttatttgtaacgtagttaattttatggttagtaaggggtagaggtggaatttattgaaaatgtttttgatttttaaatttttgttggtaattagggttttgttttgttgttttatatatgattagattggttttgtagttatttatatacgtgtatgtgtaatatgagtgttttatttattttttgatgaatatttttttgttttgtgtgtttgagtatatttatatagatgcgtttgttagaggagggttttttaaattttagtgtgtttatgaattatttggggagtttgataaaacgtgattttgtattaggtgggattaggtggggtttgagattttgtgttttttaaaagtcgatgatgttagtgttgttggtgtttggattatattttgagtggtaaggttttagaaaatattatggtttagggttgttgtttgtgttttttatttttgattatgttatatgaaaattcgaagaagtatgtattgggaaaggaaatgagtttagatttttttatatttgttgtttattttaggtttttaaggatcgaatttttgttggttttgttagtttttttattattttttatatgattttttttaattggagttgtgtatttttttggtgttaatttataaattggttttttgatttaggaaaagtattttttatattacgtatatataggaatttatttgtttaataattattggaatttgaattaaggtttagaattgtattatttattaattataggtagtaggttttgaattttttgtaagagatcgtaaattattattgtttgttttatattagagaaatattaggtattttattttattgagtagtgtttgatgcgatttttatgttttatttatattttttaggtagacgtttttttgaggttgggtgtgtatggtgagaagttgtatgaagtgttttaggaaatatttatttatttgggtttttagaaatagtttttttttagtaatagttattttttttttttttgatttagtgtattgaatttattggttaataatagtaatataggtagttaaagaataagttttgttttttgggtaggattaatattttattttattttgagaaagggttttattttgttttttaggttggagtgttttggtgtaattttagtttattgtattttagatttgttgggtttaagttatttttttgttttagttttttaagtagttgggattattggtgtgtattattacgtttagttaatttttatattttttgtagagatagcgtttcgttatgttgtttatgttggttttaaatttttgagtttaagcgatttatttatttttattttttaaagtgttgggattataggtatgagttattgtgtttggttaagatttatattttaaaaataaaaattaaatatgaattagattttttgttttagattttattttgtatttgaagaattggagaattattttttttaagtttttgggagttggtggaaatgattaataaggagaatagattgagggagagagggaggttagttgataatggatttggaattatgtttggtttgtagaaatttattcgggttagtggaaagttatattacgagttaaattattgaaagtatttttattatttgttttgtgtagtatttgatgacgagtatatatattatattttttgattggtttatttgtttttttttttttgttttttaagaatttagttaatataattaaataaagtaatatgataaatattttttttgtggtttaaagtttttttttttaaatttttatttttattatgtattatggataaaaagtatatgaaataaatataaaatatttataaatttattattagagtgttggtatttttagataataatcgtaaaatttttattgattgaatgttatgtgttaagtgtgttatatatataatttaatttttgtttttgacgattttatggagttagtttaaatttagatttttatgagtttggaggttatttttagaattgttataatgttttgttgtttttgtacgaaaattggtaggtggaaatcgattattattttgttagaaagttgagttttggtagtaaattgttttagattgataggtatattttttttttgattttgtaatgaagaaaaggaaaagagagtttttaaattatggaatgtaaaattgtagtttattatttagttgtgttattaaagttgtgttgtttttttttatattggtaaattttgattttttatgtgagtgagagttaatttagatatttttgttagaaagtttagaaaagtattttaagtatgtttggaaagatattatagttttttaagttgtttattattgtaagaaatgtaaatatatagtgatttgatataaaaatgattttatttggggggtaaatgtggttatgtatatatatatattttaattattttgatttgttgataattttttagattaataataaaaatttagtaatgtattttatttttttttattttttttttttagttttatttttaaataaaagatgttttatggaagtaagagtataatttgagttaaaggagttttattttaataagttataaaaggaattgttgatgtgggttgtgtaatggattttgagatgttttaagagaaatttttagttgattttttttcgttagtaattatatattttttgtttttttttagcgttttatgtaggagttagtttagtagaatattattattagatggttttgttaattggttagcgtagtttttatgtagatattatttttttagttgttatcgtcggtacgggggttatttatatggaatatttttatgttatggatagtaagtgacggggttggtttttagagttttgggaaatggtaaaggtaattttatgaaatagagaagaagatataaagattaggtgattgtgtaattttttgatttggaggagaaagtggaattattattatttggtgttttggtttttttcgttttttagaagtttttatagatttggatattttgagattttttgtttagtttaaggatattagtgaattgatagatgtaggtaattgtaattgatagcgatatataaatattagttggttaaaaaaaattttagtttaggtgatatagcgagatttatttttataaaaaattaaaaattagttgggtgtagtggtatgtatttgtagtttttgttatttaggaggttgaggttgaaggattatttgagtttaggaggtcggtgttgtagtgagttttggttacgttattgtattttagtttgggtgatagagtgagattttgtttttttaaattaaaaaaatttttttttgtcgtgattgttttgataataaaataagggggaatggatttgatatatggatggattttgtttttttattttttggttttatggattttatgttttaaaaattaattttaaaaaatatttgttttaataggttttatatttttgttttaaatgattgtttgttttatatgttttttttatattaaaaaaattgtattttattaagatagtttgtagttgttgaatatatgaaaggattagaatagttattaagttattaatagttgttaaatagtttatttggaaaaaataaaaattttttttaaattagaagggattatttttagtatttagtagtggaataaggtgagattatttgatgtatgttgtattatttattttggggttttttaggtgtgtaatgatttttgtgggttatttatgtagacgtatagataagtaagtttataattattttttattagagtattttagagcgtttatttttttagattttttaaggatatattcgtttgtaaggcgttttgaagtgattttaaagtattatttaagttatatattagtaaaagttattatttttgaataggataatagtatgattttgagtagggtttttgtttagcgttttgtttgttttttttagtagtagtaattaatttatatttttttatttataatttatttggatttttttgtgatagagggcgagtatatgttttttagttatttagttttgagtttcggattagaaagaaggtgattattttatataggggtaaaaattttatagttttagtttgtttattattaagagttatttttgtgtgttttattggaatataagattttgttggtttttattgggaagtttattattatatggaaagtaaaagaaatgtgttacgttttttttaggcgttttgttgtttggttttttagtatagagagtttatattttagatttattataattatattttaattagcgattgttgaaaaaaaagttgtgttattatgtaaattagttatttaaaatttgtaaataaagaattaaaataagagagaatttttggaaggttagttcgtattattttttttatttgatgagaatgtgtttagttaggtagtggcggtttttatttaaataaaggatgaagttatttttttattttgtaaaaattaattaaaggaattttaatttgtttgagtatatggtaaattgattgttattaagtaggaatttagatgttttattatttattatataaaaataaattttttttttttttgttagaattttttattagaatagggaaataaaataattaatagaaagttagatcggagatatttgtgttagaataataagaattttttggtttatatttaagaaggaagtggtatgattagtgaagaattgggttattttttttttggttgttttgaaaatgtttattttgtattttagtagttttttttaatagagtattttaaattattgtttttaaatgttgattttttttttttttgtttgtttattaaggagttgggaagaatatattaaagggttggaaagtttttaaggtattatattttttttttttaaagtaattgaagtagtatttattaatagttatttagttagaatataagaagattgtttagaaatttttattataggagattttttttaataaagaagcgaaatattaattttaaatttttatagtggttgtttatttgtagtggtagatcgaaatttgggatttatttggttattttttattttttgttatagatatttaggattttttaattaatataatttttaataaattgggtttaggtaagtatttgatttttaaatagtgggtacgtttaggttttagtaagatgtaggatagagtgtttatatgtagtttgttaggataaattagtttgtttatggttttaattttattttttagtgttggagtgattttaaaagatgagaataaatattttttataaggaatattttagagatgagggtttttgaagattattatttatattggtggaaatagatttaaataagagttagttttggagggaaaaatatagagaggaaaggttttagttaggttatgagtaagttaaagggttttatggaaagggtgaaaaggttttgagaggttttttattttttttggaggatgtgagagtgatttaaggtttttagggtttgagagtattaaatgggttttttttttttgtattataattagtgatttaaaatattagagattttttagggatatatttacgttttgtttagtatgtgttgttatttttaattttgttagtgattattgagtattattgagaagggtaattattgtttaggattatatggaagttgataataaatttggtttgttatttggaagtgatatgtatttttttattgaaaaatttttatgatgaaattagttttttatggtgagtaaatgtgaaggagttgtgtttaataaggtagatgttattataaaagtaagatgttgatttaaatgttttaaaaatatgtataggtgggcgtagtggtttatttttgtaattttagtattttgggaggtcgagattggcggattataaggttaagagatcgagattattttggttaatatagtgaaattttcgtttttgttaaaaataaaaaaaaattattcgggcgtggtggtgtgtgtttgtagttttagttattcgggaggttaaggtagaagaatcgtttgaattcgggagatagagttgtagtgagtcgagatcgtgttattgtattttagtttggtaatagagtaagattatattttaaaaaaaaaaaaaaaaaaaggaaatcgttgggattgttattttgtgttaatatgttttaaattaggttggtaatgaaattattttaaatgaaggaattcgttttagttgtgtttgaaagaaaaatttgagtaggtattatatttattatttaagttggtttttaagttttatacgtggatggtattaatttagtaaattttagtttgtggatttttttttattatttttatagtattgataatgaagttatttatatttatttattttatttaattaaatgatttttaagtatgttggattgttattttgtattaagaattatttttattgaataaaatatttttaaagaattttttggagattaagagtttggatatttttttttaaataaagaaagattatttgttattttagttgttttgggtatcgtaaaattgttatttttttataaattggtatatttattttatgaggtgttagaaattttttattttatttaaaattaattatgttttgtttgttttttacgtggtgagattatgtttttattcgtttattaaattttagtttgatgattttgtaatgtaaatatgatttttaaaaaggtagaatggatttgtgggttatatttatttttgtgttttgaagtttatatttttaatatttattaaatttgaatgtaaattggtatttaattttgaattttttaggaagaaattattgtattaagttggtatgtatttaagtttgagttatttattttcggatttggattttaggttaagattttattagtggaatttttttgaaggttaaaaattttaataaatttattattttttattgggtttgattagagaaataaggtttagagaagagttaaaatgttttataggtttattgtatttcgttattatgttcgtaagggttttttttttgttttggaaaatttgtaaataagtaatatttttattttttaaatgttttttgggatttatttttttatatggggaatgtaaggtagaggtttttaatttcggtgatatttgggttagataattttttattgtggggagggtgattttgaatattatagggtgttttgtagtatttttagattttattttttagattttagtagtatttgttgagtttcgaaaattagaatgtttttagatgttgttaggtgttttttggggggtaaaattgtttttagttgagaagtattgatttagggtaattatgtagaagttgttttagtaatgttttaagtatattatagagtaggtaattttagaaattattgggtattgagggtataattgagttgaatttttaattttaggatattttaatttattttttttttttggtttatgatttaaaatggtgtgtgttggggtggggagggtggtatgttgttattgtgggaattattgtttttgtcgtttgtggtgaattaatgatgggaatatttaagtagtcgttagatttataaattattagaaatgaaagggataatatataaaaattttttttttttgtttagtaatttattattttttttgtatattaataaatagagttttttcgaggtaagtttttggaagataaatatttttttttagtttttttaattgtagttagtagattatatgggggaggagaggtgtttgttatcgtaagttgttagttttttattttttattttttttacgtaggtaagtagtaataaatagttggtatagagtttaattgtaggtaattaggtttttttttgtttatataataggtattagattttttagttttaggttgttagttaggtcgagtcgaaaacgtatattgtttatattattatttttcgattatagttttgatttttagattatgataaggacgttttttaattttttggttacgatttttaataattttcgtagtagttttttagtaagtggtttttatggttatttatttgtaagtgtaattaggtatgtatttttttgaatttattatgtgttttttaaatgtaatgttagtatttgtttgtatttgtagtgatgtatttttagtattaattgtttatgaggaagaataaaagtgtatgatgttgtgtttatattaagaggtaggttaaatattataatgaattgtaaaattagttattgggttttagattattttgtgtttgtagatattagttaatagtttttatatagaaatagtagttattgagttatgatgaaatttatttcgtagagatagtaagtagggtaaatttttttatttagttttttttttgtaataatgttttttagaggaaaattgattttatatttggttgtatgatatatgtatagaatatgaataaaaataaaaagattagttatggtagaagttttgttttataattttgaagagaaaggagtttatgggagggagagagaaatagtaggatttttcgtttgatggaaaataagtgtagatgatattggaaagtatagatattagaggaaatttggtaaaagaatatttttttgtttttttattaagtatttttagtttaatttgaaagatttttattttgattatatatttttgttaatcgtggatagttttttgtttgatagaaagtgttttgatatttttttttatgaagtattttatgtttgtttttgtatgtgaaggtataagtatagatttttgtaaatatgattaatataaaatattttttattgttaatgattaatttggattgatgttagtaagtagggaataaaagtaagttaatatatgaattttaggtgaattatttgattatttattgtttgaattaagttagtttataaatggttgagatatagaattagatagtattttaattaattaatttagtaattttggttataaattttaaatttttattttttttaaattttttgttaataatttaagaatttagttattagtaatttttttgaattgtagttttgttaattgtgaataattttttgtttgaaaagtatatattaacggatgtttttattagtttttgttttaataagtgaggttttgtttgtttttatgaatgagcggtagcgttagttgtttattgataggttttttatggtagattataattagggaaattttattagtttagaaaaaaaagtgtttgtagtagtaagatatttatatttagtaaaaataatgaatattgttgtttttttttaatgttttttattatagttttaatttttgtttaattattagtaatgttttttagtaggtaagttaatatttaaatgtggtaaattttaattttaatatgatgttatttttcgttgtttttttttgttttttttatatggttattgaagtgtggaaacgtggatagttgtaagtaattgtgatagtagttagtgtatagggaggggttttggggtattttttagattaattattgtagttataaatataggttttagagttggatatgtttatggttagattttagttttgttattaattagttatataaatttaatttattttttagttttttgaagtttagtttttatatttgtaaattatagataagatattttttatataggaagaatgtatattttattaaagttggtgtggatttgtaatggtaggatgagatttttatttggggtgaagttttagggggagttgagttgggatggtttatttaggagaggagttattttgtgatggttgtttatgttatattgttttttattttagtttggtttcgaggaagtatgttagttttagaattttggtttggttgtttttgtatttttggcgaatatttttgggttatagattgatatggattggaggcgattttattgtaattgtgtaattattatatggtatgattaaagttatagtatttaagtagtagaaatgtggtatatagtgatagttagaaagataatatataaaattattttatgaatatttattttttttgtttttttttattttttttttttttttgttttttgtttaggttttttgattttttatagtatttaaaggatatagattagaatatggtatagaaatggttatgatgttatttttatttatttttattttagtttttttagtttttacggttttttggtttttttatttttatttaggtaagttagtgatagtatttaatagattgttaatttgttgatttgaaattattattgtttatttcgtttttaaggagttatattataattttttatattattagagatggaagaagagatttatttaaagattagttaggtttttggaggttgtgatagttgggtgtttgggtttattgtgtttttatttttttttttgtttttgagattttcgattgtatttttttttttttagtgtaatttttttttttttagtatatatttgttgtattttaggattatatgtttatttttatatagagtaggtaatgtagataatttaagatgagattagttttttatataatgatgataataattgttattattggtattatttgttagttttttagttggaggagtgttagtgttttgtttatttttgttgtaagttttattttttgagatttaaaaattgattttaggaataattagttagtggtagtattagaggatttgggaaaggaaagaagtaaggagatatttagaaaaggtaattaatttttttaatagcgaaaggtataggagagaaagtcgattttaggtgcgtttagtttttgcgatatgttgattaatagggtaggtgtacggtttatgtttatttatcgtttttacgttatagttatttggtaaagtaagtggtgttattattattattatttttttttgagatagagttttatttttttgtttaggttggagtgaagtggtacgatttcggtttattgtaatttttgtttgttaggtttaagcgatttttttgttttagtttttcgatagttgggattatagtggtttattattgtgtttagttaatttttgtatttttagtagagattgggttttattatgttggttagtttggtttcgaatttttgaatttaggtaatttattcgttttggtattttaaagtgttaagattataggtgtgagttattatatttggttttatttttgttttatatataagtttagtgggtttttgtaagatgaagttagtaaagtttcgtgtttggtgggtattagtattagtattttagttttttgtttgttaatttattttaaatatatttgatttttatatttatatgttttttaatatttaatttgttgttggtattggtagtgtattagtaatgatgtttatatttttaaatatgttattaaatgtttaaagatatttatttagtttttaagaaatgttatagttgttttttttatatttatgttttagtgtaaatgtggttaaagacgtttgtaatagtatttattattatttgacgtttttatatttttttttttttttagtagtttgttatttatttttttttaatagaatataagtattaaaaagttaattattgtgtattttttgttttaatttttgtgatatttgtatttttttatattgatgttatttagtaaatattttttgagtaaataaattaaggagtttttttatgagtaattagaatttttattatttttttattaaagtaagtttttatatggtggatgaataattttggttttttgaaagttgtaatttgtatgagtgttatattattatatggttagagattgatagatatagagttagaggggtgaatagaaaataaaggattaaaaaagtaaatgtttattttaagtttgtgtgtggtttttttgtttatatatttatttaataatttagattattataaaaatattatataaaattaatatttatttataaaagtttattgatatattataatagtatttgattatgttagattttttaaaatgtattgtttagacgtatttgataagttttttaaaattttataattaaatagtttttaaaaataattttatgtatattggaaagtatgttataaaatattgtatgttttaagaagttgtggtttttttattatttggaagattttttatttaagattagataatttatatttattaaatatagttagtaatttttattttatatagttaaggttaacgttgtaaatagttagtgaattatagtaggttaaaatagtgtatttttgttaaaatttttttttttaggaaattgggttattattggaagagaaggtgtttaaaatgattttttttttttgtagtttttcggtaaatgtaaatgggatgaagaaatgagtattttacgtatttttaatttattgggtattatttttttattttttatttaatggttataatgaaagtggttttatatttttagtggttttaattttggtgtgattaggaaagagattttagtgaaaatgatatttttattttgtatattatttttttgagtgttaagatttttagcgttataaaatagtgtaatgtttttttgttgttaatattgatgagtttagtttgatgatgagagggtaagttgtgttttttgtttcgtggattattagttttgtttgatattaggattttggagtaagggtgtatttggtaggtttattgatgttgtttgaggtagggtggaagttagttcggtttttatagttttttggttttgtgtttagtaaatattttgtttatgttagagaaataatatataaatgaattgagaaatatattgataaatagataaatatagtgttaaattatcgacgtttttaaaatttttattttgttttttaaaaatttggagatgatattttttttttcgatttttagtaaagtagttaatattattttaaaaagatagtttttatttatttttttaaaagtaattaatattatttgaagtggtagttagttttatatagtattttatttaattagttattaattttttaaatatttagttgagtttaattttgtgttagtcgttgtattgggggaatgggggttatataaatgtttgagagagatacgatttttatttttatggaatttatagaagggaaaagtttttaagtatattaataaacgaatgaatgagtaaaagagttagtgagggaataaatgaatgaataaaggagtaaaggagttggtaagggttttggttagtgttgtaaaggaaatgatttagatgttaagaaagaatagtattacgggtttaatttagcggattggttattgatttataggatgatgataagatattttggaaagttttttataagtttttaagaaggaggttaagtaggtgaaggttttgaggtgggaggagtaaggtattgggggaattgttagtagatgatagttaaatacggggtaggttagttaaagtataaggttggcgatataggtagggtttaagttatattatagtattttggattatatatttaaggataataggaagggtttaagatttggggttttagatttggaagagtagaaatttaagggttttttttggaggttttttataaggttgtttaattttatagataaggaaattgatgttaagagaggttagtagattgaattaaaggtatttagttatttatatggtagaattataaatttaatttggtgggtcgaattttgagtgtttattagatatattttttttttttttagaaatttttaaatgagaggtatggtgaaaagtattggcgggaaatgttatttataatagaaataataatatttgatgatattttgaagaaacggattatgtatatattaatatgatttttttaattatatttaatatatttgatgagttagattttatgtaagagtgtgttattgttatttacgtttattgaggttatatttatttggttgtttaatggtaagtagttttttagttttttagattagttttataatgtaaaatttaatgtatttttttttaaagtattatttagagagtatatgtttaaatgtaaatgttgagatatttaagagtatgtgggtttttgtgtattttatttttgaggttgggttgggtttttaataaatttgttttggaaatttttatagatggaagtggaagttttattttttttttttttaaatagaagtatatgtgtgtatgtgtgtttttatatatatataagtaatgatagttgttggtttattttttgtaaaattggaaaaaaaaaatggttttttggatggtagttgttgtgtagtgaattttatagttgtaattagagtgaggatgattttttagtgtaatagttataaagtagttaggaagtttggtttggttttgaatgtgttttttttttttttttttttttgaagttagttttttatattttggtattatgttattttagtggtttttgttgtttgattttatttttaattttgattttatgagtaaaagaattaggagaggtgggatatttattggattttttttcggtttgtagtaaattaggtttgttgtagtatgaagttttttaattttagtgttttgatttaaaggaatatattttgatattattatatgagttttttttaaggatgttgaaaaaatttaaatttgaatgaaatttaataattaaagtaattggaagaagtgttttataggtggcgggtagatagagttgattttatatttataagatattttttaagaatttagaagtgttatatatttattattttttatattggattgagagttggcgtttttgtgatggagtgtgattattatttacgttagggtttgtttgtggtttagttttttaatgtattatttatttgtttagttttgtgtatatcgcgttgggttattgagagattttagagatgaatttggaaattgaagagtttttttttttgtttagttttttatatttttttgtgttttttttttatatatatcgtgtgttggtgtagaaattttggtattgtgattatatgggagtgagatattttatggtaattttaggaaaagttgttatgttagggaagggttaagaatgttttgtggattgaaattattaaataataaaatagtagtttttatttttaagtgtgtggtggttggatgatacggttttttgatatttttcgtatttttttttattgttttttttatttttatataaaaataaattttttgaatattgtaattagtttttatttattattttaatttaaagggttatagtaagttatattatgttgttttatttatagtattattgttaaggaatttagtatatttttagcgttttgatttttttgttttatatagaatttttgaagtatttaaaaaatataggttttttttatatattgttttaattgggttttatttatttgatttgaatattaatgattttgaagtgtttatatgtatagtagggtaaataaatgtttaatgattgattttttataatatgaattttgtgtttttattttatatattattttgggaataaatataaattgtattagtagaatggattataagggtttttgtataaatgttgatttatattatttttttggtgtgaaaaaaataaatatttattgtgaaagttaaatatgattatgtatttttaggtttaatgtattaattataaattatatgtaattttttggttataaataattttttttttttttggtaatataaatgggatttgtataaagtatttagttaaaatttgttgaattaatgaatgagatgtagtgtgtagattttaggatatttattttggttgtttagtagttttttttttatttgtattttgtttagttttattgggtatagtttttgagatttttagaagggagatttttatgtaagtgaggtgttattgtgttgtttattgtaatgttaagaaataagaattagtttgtaaattttgattatattttttaagagtattgataaaattttatatgtttgatttttgatgtatatttatattagaatttttttaaagatttagattttgataattttattttgaagttttcgtaaaatagaaaaaatggtttttagttagataacggtttgttaattatttttaattgagtttagagttgaatatggagatgaaattgattgagaaattatttttatttagattttgtatttagtggaatgtttttttaaattaataatttagtgattatatatttgttttggttagtaagttatttaataattatatttttttttttgtttgttttttagtaaaataaagggtaaattaatttttaaattaatttattttggttttataattgttgttttagaagaatgttttttaaagtgtattgtgaggaatattggtttttggaagtttttttatattttgttgttatttgtatttggggtggatattaggaatgtatagagaaataggtttgggttgtatttttaagagtttgatgattttggtatttttttttttttttttttattatatttatttattttaggaggtttttgattgtgttagtacgttgtttgggaagatttgggttatttaatattttttttttattgattttattgattaaatatagattaatagttataggttatatttttataaatgtttgttgttattgttttaaattattttattttttatatagttatttagaaataaaagttataaaagtaattttagaaataataatagattaattgttgaatgtagagaatttagaattagaatgtaaaattaatttttggtgatttattggaaagagtggggtgaatagaaatatggaggttatgaggatgggaagtataggtattaaggtttagattgtagattatgttttgttttagagaaggtataagagattattaataattttaattatgtttgggtgtggtggtttatgtttgtaattttagtattttgggaggtcgaggcggtcggattatttgaggttaggagtttaagattagtttggttaatatggtgaaattttatttttattaaaaatataaaaattagttgggtatggtggtgtatgtttgtaattttagttgttcgggaggttgaggtaggagaatcgtttgaatttgggaggcggaggttttagtgagttgagatcgtgttattgtattttagtttgggagatagaacgagtttttattttaaaaaaaaaataagaaataaaaaaataaaaaaaaaaaaaataaattaataatagtaataatttttatttgtaggaaattgtggaatgaatatatgaattatttaggaaggtttttatttagggtttttaaaaatagaatttattttttgtttttaattttgatatttttaattagtaaagtttgttttgtgttattgaagtgttgtagaaagaaatggatgtagatattagtttcgtttgtgtaatattgttttatagatatgttgttaaattgtagtttttagaggaaaatatagttttttttgaggtgatttttttgagtgtggtaggtaggataacggttttaaagatgtttatattttaatttttaggatttgtgaataggttattttttatgttagaacgatttttgtaggtgtgattaagttaaggattttgagatgagaagatgattttcgattattcgggtggtagtgatgtaattatagggttttttgtgagagggaagtaggagaggtaagttagggttagaggaggaggaggaggaggtttgagtgatgtggatttttgagttaaggaatgtgggtagtttttaggtaatggaataggtagggagtttagatcgtttggaataatgtagtttcgtcggtttattgtagatttttgatttttagaattgtaaggtaataaatagtgtttgtttttttaagttatttagtttgggttgtttgttgtagtagtaatagggaattaatagatattgaagaatggatttagttatttattgatttagtattgcgtgtttgttttgttaggtatattgttcggtttagttggattttgttttttagatagagagatagaaagagttttagagagtattgcgtgttgttatgagaatagaattgttacgtagtagaaaacgatggggtaaggaggtgtagaggggtttcgttttgatggggtatgagtttaagaaggtttttttgaggaggtgatatttaagttggaacgtgaatgtaaaaaaggaagtggttattgtgagttttggaagttaagggttttaggtaggggatattgtgagtgttgaagatgtagagggatttatgttgtgataggaggtaaaaggatgtaggattttttttttttacggttttttttattttgatttaaaggaggaggttgtggtggtttaggtttttttatttttttagtgggaaaattttaggagaatttttttatattttgattttgtttaagagagttgagggtatgcgtgggaggtatttttttttatgggtattttgtttgcgatttttgatattcgtttgttgtgtttagttatcgttcgttttttgttttagtattttgatggtagtgttttgagagtagaggagttttgatttttaaatttgttaagtgatattgtgttagagttgagaattttttatttttgttattaaattttaaattggttttgttatttggagtggagtagtttttttgcgtatagtttttggtaggagtagtagtagaaggtcgagggttagtttttttgggtttagataagttgttttatattttgttttggtttaggtttgtgtacgaggaggaggagaatgtttttgttgttggttttttatgaataagtattgaaggtttaggattatcgtttattgtgtgtttttttatagtttttgtagtttaattgttgatgtggattttagagaatatttattttcgttatttggttttattagtaaaaaggtggaggttttgaatggggatatggttaaagtatgtgaagagtttttagaatttttatttttgtttttcgaggataaggaggatcgtagatttaggaaattgcggtgggaatgttgagttttattttttgtaaggatattttttatatttttttatttttttatttttatttattattattattattattattattatttatttttgagacggagttttgttttgttatttaggttggagtgtagtggcgcgattttggtttatcgtaattttcgtttttttagtttaagtgatttttttgttttagattttcgagtagttgggattataggtgtatgttattacgtttggttaatttttgtatttttagtagaaacgaggtttcgttatgttggttaggtttgtttcgaatttttgattttaggtgatttattcgttttaattttttaaagtgttgggattataggcgtgagttatcgcgttcggttttttatattttttttaaaatgtattttttttattcgtttgtgaatgtttttgagttgtttttgtataaaattaagggtatgttttttgaatggtttttatttttaattaagtattgattttttaagtttttaaatgtcgtgttttttagaattagaagtataaatgatttttagggatttttttttaattttgttagatagtttaggtttttagaattttggaaaggtgtttggagatatatgtaaagtcggtgtgttatggtaattatatgtgaagtgggttattttggtttttgtttatttaatgaatagaataacgtagttatatttagtaatatttatttatttaaaggaaggggggttgttaaattattgtgttttttgatgaatggtttgtatattgaaaaataaattggataaattggtatagagtttagtgaatatgaaattagttattagaagaaagtttgtgaataaattttgaggtagatatgtattttttgattaatgttttattaattatttatatagttattttagttaagttttgttataattatttatgtttgtttttggaaatattggtagtaattataacgttgtagaaacggaatattattattgatttttttttaatttattgtgaataatgattgtttttattacgtttttgtttttttttattaaggaaatataatgtagaatgaaaggagagttttttaaagtttggtgaaatttttttagggtatttttaatgatatttagttttaaatgggtaagttattgtaatgtaaggttttttgtaggaatgatagtaatgtaattttattgaagttgtttgttatggattgtagttaaataggtaaaatgtagagttatattaatgaatagagtatatttttggaattattatttaaagttgttgaaatggtttgaattttgttattgtaattattttatttttttttaatgcgtttaatagttatagtaattaatttattagattggaaatttgtatgagttttaattttgatattataagaaattttgattttttttgggtattatatagtaggatagggagaaatatatatatatatatatataaatattttttttattgattatttttttaaaaagaaatttttatgaatgtaattattagttttttatgtatttttaagttattggtaaattttttaagaatattttatttttttaagaggatttgattttagaattatattggtataaagaatgatttggtattgtttgttagtcgagaaatttttaggtattattattgtttttttaggatttattgtagtttgggaaatagtgtggtataataaagtggtgatagttattagtatgtataatgggttttaatagatattaaatgttgtttagttagaagagggagtagtgtttttttattggaatatttttttatcgaagtttattgattattgattttagcggggagaggttaatttattagtttttgtaattagacggtattgatggaaattttttaggtggtattttggatgaattaagttttttatttttataaataaatgagtgatatgataagtatggtgtttaaaatatatttaattaattgattttttttttttttgtaataagatttggagatatatgaaagcgtgtagtgtgagttaagattaaaggaattgttttatgtataggaatatacggaattaagagttaataaaagttttataaagtatgtagttatttattttttttttatataaagtttgttattgtaataaatagttattattgaattgatgttttttattttcgtttttgtagaattttgttttaggtttgcgtgtatgtgtgtatatatatgtgtgttttattttagtgtttattttttttttagaagtttttaagatgtttggtaataattttatttttttatttaaataaatttgatttgggatggtaaaattatagatagaaagttgtagattttgtgtatttgtttgagtttagcgtttaagtgatgatcgtttttttttatttttttcgtgtagttttgttttgagttttatttattttttcgcgttcgtttttttttatatgtattagtagattttaagtcgataatagagtttaggtttagtttttggatatagttttttatttatttattttgttttaatttttttaatatagaggtttattttagggatttttacggttttgaatttcgtttaggttagtttcggtttttttgagtttttataggtgagagggataggtcgatgtattcggtcgtgttggttagtcgagggtgggggtaggttattacgttagttgttaattaatacggtatttttgtgtttttatagtttttgtattagtattttgtttttttaatgttgaggtttagtttttagttttggtggacgtgttgtgtaaatgttttttattaaatagtttttttttttagggttatttttttatgggtatagtagtaggttgtttgataaggttttattgtgatttggtgttatttgtaatttgtattttatgttagtgtagtatgtggatgtattgtttttatttggttattgtttatttttttcgttagaattatagttgcgatttattattaggtggtattttagagtaagattaaaattgtgttttgttttgcgttaattgttgttattttgatattgtttggagaagaatttggttgttttaattaaagaattttataaatggaacgtgttggttttttattttttttataattttgtttttttgaaatattttgttggagtttgttaaagtttagggttttagttttatttttttagtttttaaaagttatagggagtttatatttacgagttaaaaatgaagagttgtcgtatgaacgtattttttagttttgaatatattatttgaattttgtttatattgggattggagaattattagagttattgttttatagttaaataagatcgtttgtttcgagttggtaaggttttaattatggtattgttttttgttgatgaaaatttttttgtttttggttttgtaaatgtgattagtagaataagtttacgagtgagtttgtagtgagtagtattggtgattcgatgtataataagaggtttaagattaaattcgatgaagatttttttagtttaggggttcgggggtagtaggtaggatatcgaggtcgtataggttagcgtttattttttttaagattggtgtttttgggttagttttcgttttttttttagatttggtgttttttttacggtagttttttgtttattgtattgttgattttggtcgtattttatatgttgtataaaaggttagatatggagtgattaaattatttttttagtttagaagtaaatataggtagtgtaggaagttatgcgggatatatttttttgatagtttaggtagtttgggagtattggtaattgtagttcgtagaggaaatggttgtattaatttgttgttggttataggtgcgattaggttttagtttttatttgtgattttgggtttgaattattgagtttttggatttaagtttgagttgtggcggatttattgatggtttttatattatttttttttattttgttattttttattttttaggagagtttggcgaattagaagggatgaaaatataattaatttaaggttagttggattttggtatttagtttaaaattttgaaaggaagagtgtaggattttaattcggatttcgtttttagttatttaaattttttgggttttagtttaaggatgtgtaggttatatttataatattattttatagggtttttagtttgatgtaggaaggagttttatgaatgttaattttttattatagagattggataagagtttagatgtttatagaatttggattttgttgttattaggttgttttagtttaaattttagattgtttgtttaaattttttttttagtaagaacgtggaggttggagtaaattgtgttacgggttttgaaatggatttttttttttgtatatcgttagatagtaataattttgttggttatattttaatgtttgtatatggtttttattatttagttttggattgggatttgaatttatataagatgaatttttaaaatgatttgtattggtattgttgtgaagttgttataggggtttaggaaggattgtgtttttgagttttgatgttgtggtttttgggttttgggtagtgagtatatttttagagattagaggttgaatcgagagggtattatttttataaagtttataaaagtgttttatatagtttttaatagtagcgaaaatagtattagaagtattagtaaattatttttttggattataaaatataagaataaataaagtaatagattaaaaataattaaaataattaaataaaatagaagtattaattttttgggtaaagatttgatttgatttatttttttatgagttttgttttgttttttgtttgtttgttttacgttttgttttgggtttttttttagatgatatttgggtttatttttagttttgtaattagggtagtaaagtttgattttaatttttaatttataattttgataggttgttgttttgaattagacgtttaaaatttttagagtgtatttggtaaatttgaaaatatgtatagatatgattttattgtttgatttttttattttataaaattttagatttaaatttaaattgggtttttattttttttttttgtttttttttttgttgtgtttgattttttttttttttttgttttttgttttttattttttttttttaggaatagttcgaaggaataatttttgttaaggaggaaggggataaagatgaaagtaaataggagtttgaagttatttatgagataaattgttattgggaaggttgcgcgagggagttcgatatttaagagtagtttgtgtacgtaagtggatggtatttaggaatcgagttttatagttttgtgatattttttagggaggttagtttttttgattttgagttgagttaagttttttaggagtcgtattgcgaattggagagggttttatgattttttgagaataaagaaaattcggagttacggtgtttgatttgtttagttagttaaagttgagtgtaaaatttaataaagtttttaatagagagtgtaatgattttgattttgtaagttagaaaatattattttgagttagcgattttgatggttattgagtaatagtaagttggatatgaattatgattaattttttaaataagtttgattttttttttaagattcggtaataatggaaaaaatgtggagatgagggattttttttttttttttttaaatttttaaagtttaaggaagttttcgtttttttaagttgtagttagtattttatatgagttaggtagtataattttttggtttgaggttagtttttgtggggttagtagttttatggaaaaagttgtaagtgtttttaaatgtatttagtgatggatgttttggaaattgtagtatggttagattgagaattatatttttttttttaaattaggtttagaaatttttatatatttttttgtatattattttaaaaaatgtagtgtgtataaagttttttttttattttatgtttgatttgtgatattttttttttagtgttttattgtttttggtatttttttgaaggttagtggagttttttttggaaaatgggattaggattggttgacgtggagggtatttagatgatcgagaataaaaagatgtaggtgttataatttttggtagaagtatagggttttgttgaggtattaagtgtggtagttttttaaatttttaatatgaaaaattggataaagtagtatttgttgcgatttttttttttttgttttttttttttttttttttttttttttattttttttttcgtggtatatttttttttttatagtaattgtatttttaggtaatttatgttttttgataatttttttttatttagattaaatattaaaattatgaagttttttttatattttatacgttttataggtagtgtgaatttttaatgtgtgttttttgtaattcggcgtattttatgtaatgtattttacgtattgtagttatattatagtgttaagtacgtaggttgttagattttgagttttgttttatatagaatgttttgaggattttatatgatatcgttagggttttttttttttatttttttttaaattatgttttttggtaattgtatgggaagaattatagatttttgagtatagaaaaaaaaagttaaatgtttttaattaaggtatatttttagaatttttttatgaatttaattcgattttttttttttaatttaatgtaagtgttattttgaagttaagtttgatttaatggtcgtttatttttgttgattgttttaatggaaattataaaaatattggaatattaaaggggaaaagtttggaatttttgttttattatggggaaatatttttaaagagtagtatatgttatgtgtatttttagtgatataacgaatgattaataaatatgaagagaattgtttgtgtaaaagttgttattatagaatagatgttggtagggtgttttggtttttaaaatattttgaaggtgatagttttatggtgtcgttttggaggataagttattgtagtttgtaaggaatgttggatattggtttagttattattaaattaggaatgaaataagagtttattttaagtttatatttaaaatgaattgtgttttttataagaggtagggtttgaagtaatattttttggagtgcggtagtagtttaatttttttataatttaaatatagtaatgtgaaagtttttaaaagatggtgaaattgtaggtatttgaatttaattttagtggtcgatggtttcgatgttttaatagagagatttgagtagttttaaaggaaggttgtttaaaattattaattaaatgattattatattgtttgttttatcgaaatggtttttaaaaaatatgaatgcgtatatatatagtggattattttaattttagattaattagaagaaatttatgttaggattagaagaaaatttaatattttatttttatgatattaattttagtttgagataaattatatgagtaaataaatttaattaaatgaattaagaattataatttataataatataaataagaatattagtttatgttatttattttttatttttttatttattgtttgaggtgtaggaattttaagtttgtatgtttaaattgattttatattgtatgatatgcgtgtatttttttatttatgagtatatttggtagtagtaatggtggtttgttatagaataggtaggtgttttgtattatgttgattgaaggaatagttattttaagtttatttaattattttggtggtagaataaatattagttgtaaaaattattttttttttttttttttttttttttttttttgagacggagtttcgttttgtcgtttaggttggagtgtagtggcgcgatttcggtttattgtaagtttcgttttttaggtttacgttatttttttgttttagtttttcgagtagttgggattataggcgttcgttattacgttcggttaattttttgtatttttagtagagacggggttttatcgtgttagttaggaaaaaattatttttttatagagggaagtattaatagtttttatttttgtgattttttttggagagaggatattttgtgaattagttgaatttttatgttatatataattaagaggtaaggtgttaaattattttgatgttttgttttatttatagtcgtgatttatttttttttttttttttatagttaatagaaagatttatgattttttatggttgtttatttagtgtttgatagtttcgattgtttgttaaagtaagttattatttataattgatattttttcggggaatagggtgttggttgtaattgaagggttttgttgaaagtttttaaattttgataagttttttttttgttttggtttagtcgttgagttgtacggttggaattttagagttatttgaatttgagatatgtgttttatattagtaaattataatttgatttgaagaagagaattagaaatttggttgattttgttcgttaggtagtttgatttttattgtaatgtattttatgtatttttgaaaagattatttcgtttattattatttgaatagatgggttaaatattcgttttttttttttttttttttttattttaagttttttttttttattaattatgtgtttattttaggtttgttgttgggtttttattatagggatgtttaattaatttttttttttagtagtataattataattgggtttagttatttttaagttagtattaaatttgttataaatttatttttgtgattagaagttaagaagataggtgtgtatttttgttagttttgtttttgtattttattttttttttggtgtcggttaaaattgaaggaaataaaaaagtaagaggagtatatagaaagaaaattaattttaagtatattgaagattgaatttattattgatttgttaagatgtaagtatttttttttgttatttgaaaggtatatattttaatattttaaaatgagttgaaagtttatatttttttttaattttaaattaattagatttttttttttgttgagtattatattataaaagacgtgaattataattttaaatgtgtttttgagagttgtagtgtatttatttttaaagtgtcgtttggttttgttttttgtttatgttatttggtttgtgttgatgttatttggtttagtttatgtttattatgtaaaatagtttagtttaattttttttaaggaggaaggatgttttttgtttatacggagatttattttttttatgttttaattttgttcgagaagtaagttttatttttgggtttttgatgtttgaggtgtttgaaatatgtatagtttgtagtatacgttagttttaggttttttgaaatttgtatattttggttgtgtatgatattgtatatattaattatgttttgagaggttttttaagaggaggaataggaataaatataaagaatttttattttagtgtggagttattattgttgagtggttggttatgtttgaaaatattagtgttgagatcgaaagaataatagtattattattatattttatgtttatttgtttgttgtaattttgtaattttttatttttaattttaataatttaatttcgtatttttgtgtaagaaataatatatgtaatattatttttaagggtttttaaaaagttaaatgattttaaaagttttattttttagtttaatttttagtagtataattttgtagggtttttggtaatcgtattgggggatgttgttttttatttgtggggtagaatcgtagagaaagtgagatgtatttttgttagtatttagttttaattgggtggcgtttaagtttttgtaattttttatttgttttcgtgaagtattgtgttaaaaatttatttttttgtagagtgattaattatttatttggattttaaaatgtttttatatgttgcgaattttgatttttaaaagtatgttgaagttttttttattagaagaatatagttataattatttttgttgttatttggaaataaattttatatattagtagtatgaaaatgaggggttttttttttaatatagagatttagatataaagaaaatatatttaatttgtgaagaattgatgtgtttgtagaaacgtaaggaagagttaggatgtgaagatattttttttatattaatatcgtgattttaaatttgtattttaaatgttttttatataatttcgatttttttgttaaagttgtattgtttatttttatttaagagaaaattgagtttaagatgcgataggggttttagatatgaggtagaaattagttttgtgtgtatataaaatataaaataaatgagtggagattttgattttattttttttatatggagttgttagttaattcggttattttaattatttggaaatacggtatataaaatatagattaagaattataaattttaaagttattttttgataattttgttttaagggttacgttttttttaaagttgttgattaaattgtatttgtagaaattgtttttataaagagatatttaggagattagattgattgcgagggtgtgtgagggttgtgtggtttatcggttagagttttttaggtttagttaggattttgagtggtagttttatttttgttttgatttttgggatgatttttttagaattatttgattttttagaacgttatttttttatttattatattgtgaaatagttatgaaaataaacgttgtttttaacgtttaaggttaagtatagattatatgtagtaggtttaatgagaaatagatagagggtttcgaagaggttatttagttttttattgttttatgtgtgtgtttcgttgggttgagtgggggaggagaatgcggtggtattgtcggtttttgtggtttattttatattaattgttgttaaattgggatgtacgttagattgaagttaagagattttttttttttttcgtattgtgtgtttgttgaataagatttggttttgtttcgtttaattttggttttagttaaagaaagtaaaaagtttgaattggatagtttttaggatagggatggtaaatagatttttttttaagtgcgagttagttggttggtagttattaggagtattgtgtagagtttttttttttttttagtttgggagggagtttggggtgggttgggagtggcggggggttgtgaatagttatgggtgattgtttttaggtggagtttaagaggcggttatgtattagttatttttttaatttatttattcgttgtatattttttgaaatattttattaaaattttttttcgagtaattgtttttgatatttggggaatatttttttattgaaagttttttagttggtttttaatgatattttaggtgagattttagattttgttaatagttagtgttttggaatattttgtatggatttattttagataagtgggaatggtggttattttgggttgggttgtatattttatttgaatatgtttgtttatagtagatgttgttggtataatgtatttttttgtttattaggaaaagtataagttaatattagtggattagttatttgtttaatagtttttgatgagatgtgtagagttttggtaggtgttatatgggttggggatagtttatgtggtatttatagttttagttttgtggtggatatatgatttatatttttaaagattggatagtttgattgggaggaggagataaggaaatataaaagtatagtgaataataagaggtgaaatataaagaagttataattgtgtattgcgattttatgggttgagagagggaggagtatagaggaatattggaaaagatttttaggaaataggtggaaaatatggttagggttaaagtaaattatgtaggtaaatttttgaggtttgatgaaatgatgatggtggtgatgatgatgatgatgatgatggtggtgatgatgatgatttgagaagaattagtatttgatttgaaggaataattttgttttttattattatttagtggtagtatagtgtgaatgtgttttaaagtagatagatttgggtttacggtttgttttgtttttaaggaaaatagtgatttttattatataaaacggtgagggaattagttaaaaaagttatatttaataaaatgttagtgattttgtttacgagagaaaaatgttaagatatttagaggttgttgtgtttatgtatgttacgtataaaagtaggggttaggttaatatttaggtagtgttggggttggtatgttagtatgaaattagtaattgtagaaagatgtcgataggtttttagtttatgaaatattgtaagagaagaattggagcggcgttttgggtttattttttttattgtaggtttttttttgtgtttttttgtagtgcggagattttattttttttgtttatgtgttttgatatttttttggaaatttttttcggtggttatattaaattaaggtttttttattgtagtatataagggtagattattttttggcgttgggggttgttttgggtattgtagggtgttaagtagtattttaggtttttttttatgagatgttagttttttatagtgggaggttgttttgcgtattttttttttcgttatgataattaaaattgtttttagatattgttagatgtttttgggagatagtattgtttttagttttgttttaaatatttttttttgtcgcgtagtgtggagaaagaaaaatatacgtaagaaaaataaaaaaaaattgtgattaaagaaaaagttttttttgtttaaatgttttttagaatgtttagattagaaataagagatgattttattaaaatgtttttagtaagaagttatttaaatatatttatgtgtgggggggtgggtgtgtgtgtgtgcgtgtgtaaattggtagagtttaatttaaaaattatatttgttaaggttaggtatatagtagtttttagtaaggtttataattagttaagttcgtttttttggtggagaaattttattattatttttttttttaggtttagggaagttatatagattttaatttttgagattatagtaagtagagttggagattaggtttttgttttgatataaaatagagtttcgggaatagaaagtagttttttaatgcgaggattttttttttaagatttggggatatttaggtttttttgggattagttaaatattattatggaggtatttttattttttttagaataattaatgttgtaagagaagagaattgtaaatgggatatttttaggagataatgtgtaagttaaggttttaaatttaaattaattttattcgattttatttagttattagtaaaattagtattaattagtgagtgggggatgggaagaatattagataatgtgttggagatttgttttttatttttatatttgttagaaattgtttttgaatttaagtaagttattttgtagtaaatttttcgtgttttatttgtaaagtggagataataatatttattttaggttttttattgggttttttaatttgttttttgtttatgaggatagaatgagattttataatggaagtattttgtaaatttaaaagttttatttaaatataaggaaaaatttatagtaagtagtattaataaatttatttaattgaagaatggagagattaagtgtatttttatgaatatttaaaaatagttataagtatattattgattttagttgtataggttcgtttatgtaggttgttgtttattttatttgtttatttatttgttgttgatttatcgttattatttggtggttattatagaaattgtaggtatagtagttagaagaaaacgttttatgtatgttcgatttagggtgttggggttgggggttatttttttgagtaaggggagtatatagggtaggttgttatgagtattatcgatgtataagtaggatagtgggaaaatgagtaaggtgaaggtatagaagaaggaatgaaagatatattttatggagattggatatgagtatggtatggaataaattggtggatgtaaatatagaaagattattgtagaaaggtattggggattttatgtggagaagatagtaggaagaagttaaagggtatagaaagtatgggaaaattttatttatgattatagttaatataataaaagattgaggtttttggtatttttttgaattagaaatataattataaatgatttgttttatgttttttggttgaagagtggtatgataagtaatgtagttagagtagaattaaagtatgttcggaaggtagaagggtagtgggtagtaagattaaagagtcgagtagtattatgttatgggagatgtgattgttagattaggagtttgatttttattttaggtggagtaaggataattaaatgtttttgatgagaggaatggtttgagttagtattagttttagaaagatggggttgagttttgtaaaatttggtaagttgtaagtatagtgtattaaagagggtaaggttagattggggtagggttagaagtgagattttgtagtggaagttatttgaaattattttttaaaatttgggaggatagtttggagatgttttacgagtatagtttgagtagttgatgtggatgttttgtatgatatttagagagaagttagaagttttagggttgttggttgagtgttgggaggagacgttatttatggaatttttgtgttttgtttgtgtggtattaggttttttattaaagggtattaagattttgttatttttttttaaaataggattattagggtcgttgggataattatttttgatagtttatgggagatatttattatagtgttagttaagtttttagagttagttagtttttattgtgattgttattattttttttttgttattattttgttttgtgtaaaataagatgtgttaggttaagcgagtggtatatgtttataattttagtattttgggaggtcgtggtgggagaattatttgaatttaggagtttaagattattttgggtaatatagtaagattttatttttataaaataataataataatattaatttagtcgaatatggtgaggtatatttgtagttttagttatttgagaggttgaggtggttgtaatgagttatgattgtattattgtattttagtttgggtaatagagtgagattgttttaaaaaaaaaaaataaggtgtgttttattttttagttatgaatatataattttgtggtatataggtattatttggtaaatagttttatatatttatagtggttattttttttttaattagggtaggattgttttggacgaatatagagaatgaatatttaaagtattaggtttggtgggtttagataaataaaatagataggtaggttaattatattttatttttaagtggtgatttagatgaatgggatgtagtttttgatttgtttggtaggaatgaaaatgtttttttaattaggaaaataaaattgtattagttgttttttgttagatttataggatttttttcggttaattatgtttttaatataatcggtttaattttatttcggttgttttatttgtttaaagggatatggtgtttttttaggtttttttttgtgttttagtatatgtgatttgttttaaggagttttttaggatatgcgggagagtttagtttgtgaagaggaggtttttttggtggttttttttgggggtagggagagtttgtataggtttttttggtgtagtttttattataagataaagtagttaagttgtaagtgaaatatagtttttattgtattttttttcgtgtttagtagagataaattttattggaattttagtattgagttatttggtttttggttgtagttttaattgatataatgtagatttttttttttttgattaagaggggattatttttgttattagtttagagtattttattttaagatgaaaagtttttacggaattatagatgttagtatttgtataaagttttttggcgattgataatttaaagagaaagtatgatttattagtttataatggttaattttgagtaatggtttaggttttattgatttgtgaaattgtttaacgtgaattgtttttttatgttatataagttttaggttatttaagtaaatgtagtgtttgtattatatgaaatgttataggagagagaagaagaaaagggaggggggagaggagtaaggtggattttaaaatttattttggtggtgttttttatagtagtttggttgataagtcggtagaggaaagattaataacgaggtttgtcgttattagtatttgtttgtcgattttttgtaatagggttgtttgtttagtatggaaattattgattaaataaaaatggttattagattgtgacgtgatttataattataaataatggtggatattttttttttagattttcggttatgtattaagtcgtttttttttttttttggtcgtaatttatattgcgttgatatttgggtttattaggtttattttttttgtttagaggtacgagcggtgaggattagtaggaagtcggggaggaagagaggagagatgatggtttcggttagggatttggttagtgtatttattgggttagtataaatatgttgtagtaaaatatatattatatagtagttattattttgtttattttgaagtttgtagttttgtgtggtattgagcgtagttatagtgttgtgtaatcgttaatattgtttatttttaggatattttgattattttataaggtagttttgtatgtatgaagcggttattttttatttttttttttcgttagtttttgaaaattattaatttgttttttgtttttatggatttgtttattttggatattttttataaatgaaattatataaaatgtgattttttgtacgatgtttgttttttttgtatttattatgtttttaaagtttattgatgttgtggtaggtattagtgttttgtttttttttatggttgaataatatttttttggatggttggttatattatattttgtttattcgtgtattcgttgatggatatttgagtttttattttttggttattgtgttattatgaatatttatttataagtttatgtttgaatatttgtttttagtttttttgggtatatttttagaagtgggattgttgggttatatggtgattttttttgttttattttagaaattgttaaagttatggtagggtttaagttgtaggttttgttttttttaggtggttttatttttaattttattttgttttttttagtattatttttttttgtttgagtgttgtttaagtttttttgggttggggatttagtttggttgtggagtgttttatgatattgttatttgtgggtatataggtattatttagtaaataattttatatatttatagtggttatatttatagtggttatattttttttaaataaagtgggattgaatagttaaagtattaggttaggtggatttagataaataaaatagattggtagattgattatattttatttttaaatggtgatttagaggaatggggtgtaggttttgttttgttttgtaggaatgaatataatttttttttagtagttggtttgtgtttttttttttggatattattgttgtggttttttttagttgtggaattttaaaaatgatttaattaattataaggaggtttagtaaggttaaaaaatatattgaaggttattaaatttattagtgagtggtttgttattgattaattagtttttttatatataaattatattgttttaatggttgtttggtgtatataaggaaggtttggtttttagatgtttttaattattaaatgtatgtattttattattttatattttattttaataaagatagttttttttttttgtttattttagttaagttgttttaagtttgatatttttttatatgtttatggttagttagatattattgaaagcgaatataatattttattagaaattttagattttttgattaaaatataggtgaaaattatatgtttatttataattgaatatttttatttaggttgaaatttatgaatttatttagaagaggtatttgtttattgatgtggttaggtgtgttatcgattattttaaatttaaagttggaagtaatatttagaagaagtataattttttaatttgaatttttaagtttttagtgtatttttttatttagttttgtgttatttatcgttttattttaagtcgtagttttatatggagagaggtagagatgaggtttttttagagggaaatagtttttagggtagtttttggagtttcgtgtaggtataggagtaggtgtttaggagtagtttcgagtgttaattttggtttttttgggggttttgttgaatagtaagagattttggagaaagtgttgtaagttagttgaggattattttagaaagttattgtaagtatttatggattatttaagaaagaaaagattaagtttgaagaatatagattttaatggaattttttgataaagttagatatatataaaagattgaaagaaagtaaatatgtggaaataagaaagaattagtgatatagatttatttgaatatatttagtttattggggttattgtgggttttgatggttatagagaggatgttgtgggatttaggaacggggaggtatattttttggaatgaatggtttataattaacgaatggtagtgaaagtaagtagtttattttttcgtttgtttattttttgtgttggtttaagtgaatgtttatttgtttattttgttatttgtttggaacgagaattgagaggatagtgatgacgtcgatgagattcgtttttttggggttttttattgggaatagagatagtaggaaaaggaagtatgcgtgtttagttgatataagagtaagatcgttgattggtaagggagttagaggttagttgagtggtaacgttaggattgtaattttttataaatggtacgatgaattaatattagaaatttttgattaattataaaaaaaaaaaaaaaaaaaagaataatttgttgggggagatagaaagtggtgattatcgttttgtatttttaaaggggataagaaaatgaatttagaaagttttaagggtagggttaagttaattttagagaaaattttatttttattattataaacgtgttgttttgttataagataaaatggtgattattgatattttttgggtttattaagaaaattgttatattagatcgggttgatatttttttttataatattattagattggttgtttaggaaaatatagtaaatatgattgacgggattttagtaaaatttttaataagaaattacggttaaggtagaggaagatggttgtgttaaatagtagttaggagatgtagttgttgggtggatgataagggtatggtttggtattagttaagggagttgtttttagaatcgtgttgttgggttgggtttttagttttggtttgtataataatttggtgtatttgtttttaggatgaagttgtggagtgtaattattattagagttgtttgtgaggaatatttatatttagttagtgattgaattaggatttttagagattttgaaaaataaaaaatatgaaatagttttaaggagattaaaaattatgataataatataggatttttaattaattataagtttattattataagataaagatagtttttattaagtttagttaatgtgatttttaattatagaaatagaagtatgttattagaattatatttaaagtatttttggaaaagagtattttagtttggtattttattttttaaagatatattgatgtataggtattggattaggtagagaaagaattagatttgtttcgtgtagagtggttgatagaattagataagaaggtgtggtttgcgtttatagttttagttatttgggaggttgaggttggaggattatttgagtttaggagtttaaggttgtagtgagtatttgtgaatagttattatgttttaatttgtgtaatatagggagattttatttttgaaaaaataaagaagaattaaggaagagaagttttgtaagttgaaggtgggtagaaagtgttaagggatatgataattgtttttaaatatttgttggtggttggttgttttgtgggagttgtatttagtttgtttttaatgtatggattaaaggtttaatgtatggaaattatagggagatagatttaggtttggtataaggaaaatcgaattgttttttgagattcgtttaaaatgtttatttaggggaaagggagtttttgtattgtaatgtgaggttgtttaaattgtatattatgggtgtggggtattatagaggtaatatagagtatttagtgggttgttggattagatttatttagttttattcgaatttgagtgaaattttttatatcgtagaagttttttgtaagttagttatatgtttatgtttaaagtagggatttatttttatttgtttttaataaagaataatattattttagttttataatattttagtagttttttttttttatttaggttaagatttttttttttttattttaatttttttattataaaatatattattatttagtaaaataaattaggtcgatatattgtttgaaagggtgaatttttgagttttttaggtaattgatatggggtaagaatgtgggtattgtgaggttttagtttttttttgtatattagagttatttttattgtaaaaattttttagatttttttagttttttttattttattttgatgtaattatttttgttatgggtattatatatgaaaatttttatataattttttttagaaattagttttgtgttgtgagtgtttttgtattatatatattttattttgagattttttgagataaaaatattagtgtcgagtttattgagaggtaaataattaagtattttgagaatattaggaaaggcgtttttttttttaataagtattttttttttttttgggtttgtattgtggaaatgtgtgttttaatttttaatttgaaggatataaaatttggtgtgattattgagtttttaaaattattttttttaaattgtagtttttagtagagtgtattttaattttgtttttattttaagtatataagagatgatataagaatttttaatttggttgagtttttttttattttgtttgttgcgtagtaatattttgttgttgggtttttttttttttttttttttttttttttttttttttaaattttttttttagtattattattttggtaatttattttattttatttttttgtgttttgggtggagttaagatatttttggtggtgttggttaattggttttttatttttttttttttttttaagaatttcgagttaagaatgaacgtttttttttgagagattgttggttttaagttgaggttgagttaaaaatatttgggagagttttatttgttgtttgtggaatttagttatatttttgttgtttgagaaatgatttaattttgttattatttttattttttaatgtttttattgttaggaatttttgaaatgtattaagaaatttagaaattaagaaatgaataaaaagaattaaatagaaatgaattggtttttaagttttaagaaagtgttttgtgaaatgtatttattagggtttttttggtaatttttgttagggattttgtaagtgttagaaatgtttttttttgagaaatttgggttttatttggttgggttatttgaagttatttatgtttttttggaatagtatatttttgatttgggaataaattttattgtttttagtttttaaaattaggagttgtagtttttgttagagttttttgggtttgttttttgataggatatttgtagttttatatatatgtaggtttatatattgtatattttaatatttagaagttgtaagttaagtttataagttgataaatgaatgaaatgttttatattttgtttaatatatttgtattgtgattagggagggtaggttttatagagaatttttggattttttagagttttttgttagtacgtggtggtttagggatagttgttttttagtttatttttttttttttttatttttggagatgtttgtttttgagttttattttagagttgaggaataatttttgtgtatatagagatttgagaattattgtttttattaattttgtattgagggaagtattaggtagtttgtgttttattggagtttgaagtttggtagataatagatagttttgttttgggtaatgttgtttttcgagttcgggtattttttatatttttttaagtatagggggatttatattttagtttagaatttgttttttgtgttatttgttaaatttattttattttttgagggatgatatatttaaattagggataagtggtaaagtaataagattttttatggtagaaatatgtatttggttggttttaagagttgtaatattatttcgtttatggagattatgttgaatttgggattatttttagagaataatgtgagatatttattttttacgttttgaaaatagttttatttttttttttttttttaattttttttattaattagtgttttttagaggattttaaggggaattttgtttttggtttttagaattcgagaggaataaaataaggaaagagaaattgaataggaagttagagagatagtaaaataatattttttgtttttatacgtttttttttttttttacgtcgggtagtggttaatgttgtagtagagtttaatgggtcggtgtttgaatagtggataggagatttggggaggcgagtatttgggttgtattttagggaggtaggtattagttgttttttgttaagggtataaaaggtagtatcgtgtttatttaatggattttaaaatttagaggaggtttatttagatatgattttgaatttgtgtgtgtgtgtgtgtgtgtgtgtgtgtgtgtgtgtgtatgtgaatttaggataaaaaatgttttttagtagttaagtattttgtattatatttatttatttatttatttattcgtttttaaattttgacgttttaaaatatggtaaatattatagttatatacggtagagagtttttaaagagattacgtttattaaagtatttaataaggggaatataatgaggtttattaaagtaatagggaaacggtaaggtttagataattatttttttaaagtttaaatttataatttttttaaaagtagttaaaattagaggtaatttttattaaaatattaatattttaaaatatttttgtttttatgtatttttaaaaattgagtttgtattttatgtgttggttttgtgagtttttattttgtgttttgtttttattatatgtatgtgttattattattgaatcgttgtgtgtaatttacggttttttttattattttttttgttattagaaataataaatttttttgtgtaaaattttttgtttttaatttggattgttttttttagatataatttttaaaattaaataattgagttaaatagatgaattttagaatgatttgaattaaatttaaaagaatatattattcggattttgtttggaatgttattaaagttttgaattgaaaagaatattattttttaaaatttagttttttggtttagtacggtggtttatgtttggaattttaatattttgggagatttaggtgggtgtatcgtttgagtttaggattttaagattagtttggtaatatagtgagattttgtttttattttaaataatttttttttaaatttagtttttttagataataatggagtatatattttttttattttttgagttttttattttgatttattttatattttatttttggtttatttttaggtaggaagtttttttttgtatgtatttttttttttttggttattgtttttaatagtaaaggtatattgggtttttgtttttttttattttatgtgtaattaatttattgaatatttttgatatttttttatgtttttgtattttatgttttgggttttttaataatatatttttgtgatttgtaagtaagaataattttattttgttaaatattagatatatatttatttaaaatattagatatatattttatttatgttttattgtattggatagattttttggtattgtgttagataattgtgttggttgtataatattagttttgtatttggtattaaagggaataatgtttttggggtttaatttttattattttttttattgtttagttaatatagataatgtttgggtatgtgaatgaagtgtttttttttttttttttaaattttttaagatttttattttaagtgattgtagttattttattgattgtttgttatatagagattattgtgtggtatgatatatttttatgttttaaattatttttgtattttttgagtgtgttaggtgagttatttttttgatatgttgttagatataggttttttgtttatttataagttttatattgttatgattgagatttatatttttgttttattttttgtgttgttttgatattagagatatggttagatgtataaaaatatatattttacgttatatttattattttcgttttttgagtgttttacgtagtataataatttgtttttggaatttttgaaataatattttggtaaagttgtttggatttatagttttttgagaataaaattttttaataatgatttttaaaatttttttttatgatttgggttatatttgaatgaatgagttatttttattttttttagaagaatttcgggttttgatgagatttttaattttaatattattaaattgtggttatttaaattaaatgtttgttgtatattttattaaattatttttattattttatttttttgttatttgtatttttatttatttgtttagttattattagtggttttttttttatttgttttattttttttttaggaatgagtttttgaaattagttatttatgttgttatgttaaattttaattgtgttttttaggaaatatttttttttagtattatttttttgggttgagttttgtttttttttttataatttttagtgtgaaatgttgtttttatttttttttttttttttaaataatatatgtatttcgagattataatatttattttaatttatttttgatttttatgaattttgattgtttttttttttttgatattttaaaatagtttgtaattatatttgtgtgatttatttagttattaattttttattgtttaataaatgtttttggatttattgttattagttagatattgttttggattttggagatatattagtgaatgaaatagttaaagatgtttgtttttatggtgtttgtatttttgtaataatataggttttgaaattaatattaggtaattagtgtttggtttgttattacgtgttatatgttaggtattattttaagagtatgtattaatttaatttatttagtaatttaatgaggtggatattattattagttttattttttagatgatggaaataagttattgtgagtttgagtagtttgttttttgttatattgttagtaagtgggagagttaagttggttttttataaattgtgttaataagtatgttatgattttttatagtttttggatatgagattttgtttattagtgttttagtttgtggtataattttataattttattttgacgatagagatttaaatattttattgaggttatttttatgatgtgatatatatgatattttgtggttaagtgaaaatagatttttaggtaatattgattgttatgtgtttgtttttttaggatttttaatgatgtttaaatttattttgtttttatttgtttttttgtttacgtattttattataaattggtattggtatattaaattttaggtgattatggttttagttatattttttttattttaataggttttattttatgttttgatgttttgttatttggtggagaaaagtgttgtttttttttaatgattatgttagagaataattatagttgttgtcgttatttaaattttttgttataagtttaatttgtttaatattaagattattattattaatatatttatttgtttattttttaataattttttataatttttagtgatttttttatgagtattatagttgcgtttattattttttgagaaattttgttttaaagtgggtggtaatgagttatttattttgaatgtgaatttttgtgtgtttttttaatttttttttttatttgtatacgtgtgtgtgtgtgcgtgtgtgtgtgtgtgtgtgtgttttgttatgttttttttatttttattatggttaatttggaagtaaatatagtgttttaaaaatagtgtttttgtttatatatttaatgaatatataattaaatgtatgatttttaattgtggaaaaataaatattattttttgttttttaaatatatatatatgattttgtaagataatttataatttaaaaatttttttattttttgtttttttttttttttttgtttttattaattaatgtagtagatttagttattattgtaaaatgattaattattttattattgttttttttgtttattattttatatgtttatttttataatagtttttaattttgttttatattttgttttgtgtgttagttgattttaacgttgggtttttttatgtaatggtttttttttttttgaaatatttttgttgttatttttttgttttttagtaataatttaagaatttggtagagaaaattttatttttttttatatgtatttattaataatattttttaaaatggattgtagtatattagttttgtaggatgtcgataagtattaggtgaaaatgaaagttaggataaatagagttaattatatttggttgtgagatttatttaagttttttttatgttattatgttttgtagttttttaagaggagaatatggttaggttggttttttaatattattgattatagaattttatttttgattagtatatggtaaaattatgttaatttgtgtttttttttttgggaggatatttttgtgtttgttttttttttttttttttaatttttttttttttttttttgagatatagttttatattgtcgtttaggttggagtgtgatttcggtttattgtaatttttattttttatagttaaatgatttttttgttttagttttttgcgtagttgggattatagacgtttattattacgtttagttaatttttgtatttttagtagagatagggttttattatgttagttaggttggttttaaatttttgattttatgatttatttattttggttttttaaagtgttgggattataggtatgagttatcgttttcggtttttttttttttttttttttaaaatgttttaatggtgttaaatatatttaggttttatacgtgaagtttaggtttggtttattttaagaatgtttaattttgttgtgatttaatttattttagttttttttattttattttttttttttaggatatgtgtgggtttatgagttgatttgatttggtttttttggtttttaattagttttttgttgtttttattgtgggttttgttttgttgttgtatgtttagattgttttttattttttttagttttttagttatatgtttttttatttgaatgttttttttttttataggtattattgttttttttatttggggatagaaagtagatatttttaatttttttttgattgttttttaattttttgtttataagtttgtttttatcgagtttttagtggtttttttttttgtttttagtaagaaaagaatgttcgtggattttttatgattgtgggggtttttggtttgtgtgtaaggtgtataaaaataattttattttatattggaatattttttattttaattcgtaaatatttttaggttgttaaaaatttgtttgttttttttgatttattttatattgtttttagagttttgaattagaatgtatttatgtatttaaaaaattagtaagtcgtaaagtttatattgaaaaattttttttttttttttgttttggatttgtttaatttttattttattttataaattaattatttttaatttttgtatatttttggaatttttttgtagatatataagtaaatatagtatatattttttttttttatttttttttaagatagaaagttttcgtcgtgttttttgtgtgtaatacggttaatagatgagcgtgtttggtttagtttgaattagttttgtgattgacgggtatttagttttgtaggacgaaggtgggatgttttttttttttgtttgggtaagatattgttattggtttttttttagttagtatagtatgttatagtgtgggtttttggatgtgtggtttttagtttttttgttggtttgaggttttatttatgaggttgttgtaggtgttttttttttttttgattttgtagagttttggggtttaaaatgtgttttatgggtagagaatggatagtatgtatttagaaattttgatggtattttgatattgttaaaaagtgtgggatttaaaggttttttttattaaatagaggatagatttatttggatgttattaaatttaaggtcgttaaggagtggtttttatttgttttagttatgtgtagtaggattatatatttatcggcgatagatgagagaggttagaatggttttttattatagagagttttagggtttttgatgtagggcgttggagatgtggtgtttgaaaggtgtaaaagaggagtggatgagggtaagaataattattttggatgattttgacgtatttgtggtttatgggaagatgtttgtttaattttgtggttagtgaagttttagtagtttagagttaatgaaaagtaatagtattaattagaatttttttttgtttttgtggatagtattgagttttgatttagaagatgtgtttaaaggttatattgtataagttaagattacgttgttttgtgagggtgtagtagtttgtggggtgagtttttagtgttgttgttgtgtatatagtgatgaaggtaggtgttttaggttatttttattttttttttatgttaatttagatggttttatttttttttttagtagtttttgttatttaaggtttagtatttattgatgataattttttattatggcgtaatgttttgtggaaaatgatatgttattttttttttaataggaaattttatttatttgaataatttattttttatattaagtaaatttttaattttttaagttatttgatattaaatgtggaaaattttggatatatttgaataaaattttagtgtacgtgtttattatattttatagagggtgaaaggttgtgtgggggaaaatatagaagattaaataggatattgaagtaggttggggtgaaaattaatatttttagtagaagagaaagatgtaaaataattgtaggtgttagtttatatttatattatagatttgtataatataaaaaagtgttttgattgttgatgtttaaagttgacgaataatttggtgagtaatgtagaggtgaaaatatttatagtttgtgtattaagttggttgtggagtgtaatttgtattgagttaatgttaatattatttagagtttttgttaataaaattaagtattttattgaaatgttttaatttattattttatttttttattaggagtaatggattttgtattttatagtttgatgagaggtgttaaaagttagaggtgaaatttatttttgaggtatttaagaagggaaaaattatataagtgagggttatggaataggttttattaatgaatgtataattagtaatttgtttgatatatttcgtgttttgttatggtgggaagtagttgtttgtagtatattttgggttttttttgaatggtttttataggttttttggatattttagataagaagtagtaaaagagttatttttttaatatgtataaagaaaatatagtgttttttgttatatgtttggaatttgagtttgtggtgtgaatattttagaagaggtgttatatattgattattttagttattttagtttatttgtaaaataaatgaagttagtttttggtttttttaagtttttagtgattatttttattttttatcgtttttttttaagtattattttagaatgatttggtggagttagtttaatgataatatgtgaattaaaaagaatttttaatttttgttttttgtaaaaaataaattaaaatttaaattaaaaaattttaagtgtgtagtcggtatataggagatgttttttgttttagagtagaagttttttttttttgacgtagagtaagaaaatattaatattagagttaaattgagaaaatttttttagtgtatttggattggtgaacggtttaattgtagttataatgaaatatgaggaaatagattattggtttaagttatatatttatgttgtattaagtattagtttttgagtatttgcgtgtggaagttagggtgaaggtttgtggggtattaggatgaatgtgatatagtttttttatttaggaagtagtttagaaggggttaaagttatgtttacgtaaaataaatttagttagaaagtaaagtagaaggtattatttgagggattttgatgtttaggagaattaggatatatataacgtttagttagaatattagttttttttttttttatttttaaatttttattatttggatattttttttttttgtttatttaattatatgatcgtaaagagtaatagtggatttgatatttagtattttggaatgattattggtatttgttagaattgttagtagcgtttattttagtaaaatgtgaatattgtaaaatttttaggttttagttatgtttagtgtaaaaatgttagtttgtaaagttggtaaagtttagttattatatagtgatttttaagggtgttgtaaaattttttttataaataatgttaaagaagaaaaaaaaaagttggattttttaaaatgttaggtttttttattagttttttaattaattatttagggatgttttttttttttgggagatggtattataggtttatattatattatgtatggaaatatttgggggaaaaatttaatttttattaaaaaatatattttatatagttttgaaaggaaaatagtgaacgtttatattatttatagttgagattacgggagtgttttttttagtagtttttttatatgaagaaataaaaattttaatttttttgtttattgttttatggttatatgggtttgtataggaaattaaggaggaattgtaaaatattgtatttatagagtttagttttattttattatatttgttatatatagatgtattaaattaaattagaataagatgtgattttattgagaaagaatttttataatattacgttatttttttttgaaaatttttttaagtatgtataaaatttagaagattttaagtagaatattgaagagagtttttaaggttgaaaagtaagttgtatttattttttttgtattatattatatatatatattataattatgttagcgattaaaagtattgttatgttgtattatgaattgtttttacgtttaggattagataattttttttttatatttttttagattttttttatgttttaagggtaaatttttttttttgggttaggaatgtaataaggtaggtttttttttttttgggatattgtgtttgttttattgtgtttaaattgatttagaaagttttttagagtaaaatatagtattttttttgtatatgagttagcggttgattaatttttggggaattttttgtgttgagtatttgaaaggtataggttgggtatgtttgaattgttgatgtttagtgaagattattgggaaagtggattggtcgtggttttgagagaggttttttttttaatgtggattcgaggaaaaaaaaaataattgttttaataaataatttttaatggtataataatttaggaaaattagttagtttattttaataagaatggattaagattaaaataaagagggaattatagtttatataaatgtatgaatatatagtttaaaggtatttagttattaaaaataaattttttaaaaatagtagttttttttttatttattgtatgaagtgttaatatattttttttgagagttgaattataggttttgggattaaaatagagtaaatttattatttatattgaaggggatttttatttagatttggtatttttttttagattattagttagtagaggttagatttattgttaattaaggataattaatttaatttttgtaatgttggttattggttttgatagtgttttagagtttaggattttggaatatgtattaagtatagttagagtattaggagtatattgtgtgtgtttgtgtttgtatgtttgtatggatgttttcggttttttttttttttttttttttgtttttttttttttttttttttattttatttattttaatgggtatatagtatttttttttttttgtgtattttttgtagtatttaattaaaaggtatttgggaaatgtttttttttgtcgaggtttttgatttttttataaatgagtaaatttttagattttgaaattgttatttttttttttagttatatttatatagtgggtagaaagtttagttttgaattttgtttttatttatgttataaatttatggtgtattattaggtaagtttttgaatttttttgaatattaggaaaatttttttgtgggagatgaggtgtgaggaggaggtagttaagtagaaagatatcggataagtaggttaggtagaagagttggtatgagttaaagtttagtgtgtgtagtttatatattaggtttttgtaaatagatgagagaagataaattaggaaggagtataacgtaagtagttatgtttttatatttatgacggatggatttatatttattatgggtggtaaggattttaatatttatagtttgggattaggggatatattttgattttttgttaaataaattatgtttttgatatttgtattgtagttgtgttatttgataaatgaaatatatagatattattttgtatgtattttagataaaataattaataggatatttttattttaaaaatttaggtggtaaaatttggtcgaatattgagttttagttagttttagtttggtttattttgtaagcgtatttattatttattttttagagagtgttgaaatttataaatttttaattagttgttttggtataattatattaaattaatattttgtttatatgtaatgtggagattattatgaaagttacgtatatgttataggtatgtgtttgaagtgttaaatgaaagattttaaagatttgaatgattatgtaatatatatcggttaaatatttttaagaaaatttgtttataaaaataagttttatggaataaaagtattaaattaaaaatatattttgaggaataaattagtattttttgaggaatgaaatttttattttggtggggaggtaaaagataaagtaagaaaataaaattgtagaaatggtttaaatttaagaaaagttatttttttttaggagtgattttattatgtgaagaatggtgtttagtataaggtaggttttttttttagtttttttttggaaggattatagaattttgtatatatatatatttttatttatttattttaaattgttaagtttaaatttgtgtttttaggtaaagtgttttttttattgttttaatgaaaattttgtaggattaattttattttttttttttgattttttaaatatgttagttatgatagggggtaagatttttatttcgtgaatgagatttttataagtagattaaggaggaaatatgttttttagttttttattcgttgatagtattgtattgggaagaaatttttgtgtaaattgtttataagaataatagttaggggtttaaattttagtgagatagagtgtagtttaattttgttaaggataatttggtttttgtttttttttttttatttgatgttttaatgaattattttaagagaaatttacgataaagtattagattatttttttttatagttagtgggatataatattgaaagttagggttattatttaaatgttagaatttttattttatagttatgttaatattgttatggtgggtaaaaataaattttaaaattttttttatttataataaataggagttaattaagataattttgaattatgttatgattaatttagaattttagtttaaaattatagtttgaaaggaggttttttttggtggattttataggtatttgtgatgttgaggtttattagattgtggggaatagagtaattataggaaattgttttcgttttttgtggtttttgatttttaaagtataaatttaaggtaggtagtcggttgggagtatattgaggtttgggattatattggttttaaagtttgttgtttttaataatatatttttaataatatatttttttagtaagtatttattgagtttttattataggttgggtattgttttaggtatttggaatatattattgaataaaattgataaaaatttttggttgtgtggaatttatattttggtgggcggagtagataataaatattaaataatgttagttagtaaattatagtgtgttggaagtgataagggttacgggaaaaaagggagagtagtagggtagggtttggagagtttaaggatggggaggttggatagtaagtggggttattaggattaggatcgagcggggcgatgagtttttgtaaggaggtggtatttgaagaaggattgttagaggttaagttattttcgtttagtgattttattttagacgtgattatacgtttttagttgtggatttttatgttgttagtttttggagggtatttttttttaaaattttggttttgttttgttttttttgttttaggggtggttaggtgtgtttttaggttagtgtggttttcgggtttttttttattttatttttttttttgtcggatattttgttatatatttagttgatttttggtgattatttatttgtattttgggatgaggttatagttttatttttttagtaggtttttttgataaaaggttgttgtatagaattgaattttgtaggtagtatgggagaaataaaaggtttaaaataataaattgtttaaaattcgagtgttatattgatttttatttgtaattttttagttttttttagtatagtaattttaaatgaattagtttttttgtttaagtttatattttaatatattgttagatattttttgttttttttgtttgatttttttaaatttattggggttggtaagttattattggtaaagaatttaatatttttttgttttaatcgttttttttggggttttttaaagatattttatatgatgatatgttttgttttttgttatttattgtgttttttgtttttttttttattttttttttttgtttttttattttttaaaatatcggtttcgttattgtttttaattttttttttttttattttttgtatagtttttattggttaggggtttttaaattgggttttgtgaaatttttaaaatattgtgtaggtgttttttagtttattaaagataatatggggtagggaaggggtttatatttttgtattagttgtagttttttttagatttttaaatttttatgtttaggattgttttttttgtgggatttttttattagagatgttttggaggtatttttattatgatatgttttatatagaagggtaatcgttattaaattttttggttttttaatattgttattgttttagattttttaagttggagatttcggtattatttgttatttttttttttaatttattatttataaattattttataatgttttttatatttagttttttattatttatttttttggttattgttgtagtttaaggttatagtttttttggatgattatagtaatttttagatggatttattgtttagtttttgtttagtgtttttatgatgttgttagagttattttttataagaataaatttgattattgttttgtttaaaatttgtttttggttgtttgggatttggttgttttagggtatttaattttttttataatttttttttaggttgtttttgtagtatttattttatagttatttattagtatgtgtatatatatatatgtatatatatatatatgtatagatacgtatatatattttttaattttatatttggtattattttttaatatattgtgttttttttaatattgggtttttgtattttttttttttttttttttaatttatttttttttgtgttagttttttttttttttttttgaatttagtttagttattttgtttatgaaatttttttttttttattattttattagtgtttattttattgttttttatttattttatttagatttaggtataatgtttatgttttatatatgttttgtttatggtatataaatgaatgaatttttatagtttattgtttgggtttatgttttttttttaaattttatgttttttattaataagttaaagaaaattataatttaggtatagaatatgtagtggatatttatattgcgtgtatggagattttgtttttatatatttagatgtattgttaatagggggttaagatgtttaggagggtattgtatattagggtggtttgtgaataaaagttgattgaaaaatgatagagttgatatttttataggttgaaaagtatgtcgaagcggaggggtttgttttttattttggtttggtaggataaatttggaaaagttttgggtaatgggtttgttagttttttatgatgtggggagtatgagtgaagtaaaagaattatgtatttttttgagtagtttatttttaattgttaagtaaatgtgttcgtgtattgaaggttaatttttagatagtattcgtttttgtattttcgtagttaattttggataagatttaatggatatgttttattttgttttgtttttttagtgttgagtatagtaattgttatattataaataagttttgagtgaatagtgaatgaatgcgttagtttagtagggattgtgggtagatttttaaagggataattttgtttatttgtttgtttttttttttttttttagtagtttttgagacgtgtttgtgtttttgtgattagtaattattatttatttttatatatatatatatatatatatatatatatatatatttgttttaatttatttttaattgttaatggaaagtttttttagtatttatcgtgtaagatttttttttagtaatgtgacgagtagtaggtttttagggagagttatgatcgtggatgtagtttggattgtggttggtattaaaaatatttttttattttttatttttaaaagattttattaaaacgaattgttaattttttttttaatattaaaaatattttttttaaatttatttgaaatttaaatatattttattgtaattatgattattttaatttatattttagtgattaaaattatattagaatttttaaatttgaaggttagtttaagagttgattgttttaatgtttagaattagattttagtgatgtggagggagtatggttgttttcgtagggtattgaagatagagattatttatttaaattggatttcgttttttatttacgttttttattttatttttaatttttgaatttttttggaattatattgtatgtttagattttttattagtaatatttatatgtttaggttttatgtggattgttgaaattataaaaattaggaaataaaggttaatgttttgtgtatttttagatattggtgtttttagtagtttgattttttaataggaaaattttgtgtttatttttgtaattaaggagattaaaaattaaattttttttgttttttttagggatagttattgtgtgtgtgtgtgtgtgtgtgtgtgtgtaagtaagtattaattattttatagttaaaagtgtaaatgtattattataaatattattatatttattcgttttattttttaaagttttaataggaaaataagtattatgttttttttttttttttttttttttttggagatagagttttgttttgttatttaggttggcgtgtagtggtgtaattttagtttattatagttttttaggtagttgggattataggcgtgtgttaatttttatttttattttttgttagaaatgaggttttattatgttgtttaggttggtgttgaacgtttgggtttaagtaattttttcgttttagttttttaaagtattgggattataggtgtgagttattgtatttagtttaaaataagtattattttgataataggttgaatagtaaaattgttattagtgtagagagaaattatttattaatttttttttttgaatttggtagaaaattaagtttataggtgagggaattttaatgttttgggatataatttggtttttgaaatttttaatttggatataaatgtaattgtaatggatggtaatgtttttttcgtatgttggatttgtaggaatgatcgtgtataagagtgataaatttatttgatttttcggagaggttgtatttatagttatttttttagtttttttggtttttttattttttttatttaggagttagttgtggaataggaaattgggatttaattgtattttttttggggttagagtttaaattagaaattttggtttttattatgtttgttggatttgtttattatagagatgaaatagaaggtgtttttttggagaatggttttttaaataatttcgttttatgattatatagttaaaataattttgtttatttgtgtttaatagttttttttaaaagtatttttagaatagatattattgaatttttatttgtttaattttatatttttttttttggtaattaagtttttaattaatttgtttaagaagagtttattggttttgttgttatttggttgaaataaagtcgatatttaaaaggatatggtataaaattaaatttgtttagtaatttgtagaaacgatgtgtatagagttttagaatagtttatatacgttattttatttttttatgtaaaattataataggatttaaatataggttattttaggaaagaaattttgagaagttttttaataaaaggtaatttattggatggtaagagaagttttttaagagataatagttatattttcgttttagtaaaataatttagaatttagaaaataaaattttaagagaaggagtatttttatagtttttagaaggaattaggggtttgttttagtttgtttttgttgcgataataaaatattttaatattgggtaatttataaataagagaagttgattttttattgttttggaagttgggaagtttaaggttaagacgttagaagatttagtgtttggtgagggtttattttatgttttatagttggagtttttggttgtgtttttatatagaaagggagagggttttttttagtttttttataaggttattaattttttttatgagggttttgtttttttaattatttttttaaggttttattttttttttttttttttttttgagatggagttttatttttattgtttaggttggagtgtaatggagtgattttggtttattgtaattttttttttttgggtttaagtgatttttttgttttagtttttcgagtagttgggattataggtatttgttataatgtttagttaattttttgtatttttagtagagatagggttttattacgttggttaggttggttttaaatttttgattttaggtgatttattcgttttggttttttaaagtgttaggattataggcgtgagttatcgtgtttggttaaggttttattttttaatatatttatattggtgattaagttttaatatatggattttaggggtgatatatttagattatagtagggtttttaaggtattttgaagaatgaggatgtttttttttgatttaaataatataaataatattaattaatattatgaatatttattttttagaaattttttttaaaaatttatattttttttagtttttaggttacgttaatattaagttattattgtgattttatttatatgagtttgagtttgcgatatgtgtattttttagggtagggtggagggttagttagataaattatgttataaattttatatttatatttagttattatataatttaaggtaatagtaaaattgaaaagatagagattttgaattaatagtgcgttaattttttaagtatttttagtaaattttagaatatattatggattagaaattatttgtttttttaaattatgtattattttgtatatttgaattgatgttagcgtatgatgttttttggttttgttttgttaataattttgtataaagtttaggtttttttatttttttatttatttttataatttggacgatgaggatagaggaatatagagaagtcgttatttatgtgaggtttttaggttattaattgaggttagtaagaaatttattggaaaatattgtattataaaaatatgttttatagtcgggcgtagtggtttacgtttgtaattttagtattttgggaggtcgaggtaggtggattatgaggttaggagtttaagattagtttggttaatatagtgaaatttcgtttttattaaaaatataaaaattagttgggagtggtggcgtatgtttgtagttttagttgtttaggaggttgaggtagaagaattatttgaattcgggaggtggaggttgtagtgagttgagattatattattgtattttagtttgggtaatagagtaagattttgttttattttgttttaaaaaaataaaataggttttattttgatttaatttatttgtgtgtgtgtgtgtgtgtgtgtgtgtgtgtgtgtgtttgtgtttgtgtttgtgtatgttgtagtagaagttgtgattaagatgtagttttgtgtttttatggaaaaatatttgtcgggttttattttagttagtttgaaggagaggtgtagttttggggaagttagattttattttatttggttgtttttttaattttttttttatttttttataattttttggtattagattttattattaagtatatttttgtgagtttttttttggaggcgtggggtgggggtggggggtaatatttttattgagatataatttatttattatgtaatttatttatttaaagtatatagtaattcgtatgttttgatatatttttaaagttgtgtaattaatattatatgaattttagaatattttttttattttataaagaaattttatatttttttgttgttatttttaatttttttatttatttattttttttaatatatagatttatttattttggatatttatataaatggaattatgtagtatttatttttttttggattggttttttttatttagtatgttgttaaagtttaattatgttgtaatgtgtatgcgtattttattttttttaatagatttttgtttttaaatgtgaaatgatagtgttttgttgtagtgaagtatagtttagttttttttggggaggtttggggaggtgatggggtggggtggggtgggggttatattttaggttagtttattttttttttttagatttaatattataaagttttttgtttagataaaatatttattttgttaaagaattttgttttttttatatataagaaaaaataattttgttatatatttgtatttaaaagtaggatttaaataatagttaggaagaagtttatttatttatttatttttaattaagaagcgtatttttttatttcgttttaatttttaatatttataaattagaaataagaaattgttttatttttataaagagaatgttggtttgtatttaaagttttgagttttttgggtattttttggtataattttatagttatgttagaaattgaaagatgttttgatatttatattaattagtttgaattgaaataggtattttgtgaagttttagggagattttttttatagtagaggttgttttaggtttttaaataatttgttaggaaggaagattgatgggtgttattaaaataatttaaattattttatttatttaaaattaaagtgtatattgatatataaggtttattttagttttgatagtttgtgatttatgtttttttttatgtttgtttagtgaagtatttaggaatttaattataaggtatttttaatataatttatattatgatagttgtaaaatttttaaaaatgttgtatttattaagtaatatataaaattggagggtatagattttattttaggtaggaagttttgagggatttttgtggaaagtgtttttttaggtaaaatattttagttttttttgtaaattagttttaatataaattaaattttaatagattttaaattatttttttatttttttttttttagaaatatttttggattattatttaaagagtaatattatttaaagagtaataggtttataatataaagttaagaaatattgaaaattgagtttatttgaaatagtttatttttttatattttattttatgttaaagtagaagatttttttaatatttttttttagtaaattttatagaagttttaaattatcgaattttgtttagtgtattaattaatttaagttgtatttatgagtttatttggtagattaatataaaaagattttgaaattattaaatatttttagtttgatattttgagaagagaatgttttagttttattttttgttttttaaaaatataattatcgtaataaatggtggtattttaatggtttaagagagagaaatgtagtaaaggtatgaattggaaatataattgggggtggagtaagtgtgtttagttttttattagtgatttattagtgaatttagtgaattattagttagaaaggttgttttatttttttagatgtttatatatggaatatattgttttttaagtttttattttattttttatgaaggttataatattatttgtgtgtgtatatgggtgtttgtgtgtatgtgagagagattatatgtatttgaaaattatgaatatatattttgtttttatatgtagtttgtgttgtgatgaatttggcgtcgtattttgtagaaattttttaaattgataaagtagttttgtgggatttgagaaatattagatattgatagaaagattggcgtgaaaagtatatgcgtaggggagttgtttggaaattggtgagggttgagtttgaagtttcgcgttttttttttttattgtttttagtaatgtttaaaggtaatatttttattataatagtggaatttatttttttgatgttaagaaattggttgatgtaaagagtggatagatttttgaggtagttaggtgtgtatttatggattagtgattttttcgggtagggtttgaatggggatgtgtagattttgtatatatatatttgagttttgtggtagtattttgaagaagttatttagaagggaggatatttatcgatttagagaattgtgtttttgagtgggaattggtggagaggagattgaaggaaagtagaagtgtattttttagttttatgagttgcgtgaacggcggttttatttggagagttgcgagttatggattgtatgtgtttttttatttggagggttaggaatagattaagggaaaattgtttgttttgagttaatagtgaaataataaagtgagaagaaaggattttgattagtttagtaaagtttattgtggtatttattttgttgttagtgaaagaaaagttttatttttttatttttttttgtagttttttaagtttttttggtggatatttagggttcggttttttaaagaaatttcgttaaaagaaagaagtattttttgtttttttgattgttaaattagtttgtgattttttttatttttttatgggttttcggagttttaaaggagtggaagaaatagtggaagaaatattgagtcgtggtttattttgtttttattcgatgatagttaaaaaaatattattttattggtttgttatgggtttatgaggtgtttatttttttagttattagttttttaaggttaatgtttggagttttaattggaaaattgaagatatggatttatcgggaagtttagtgtcgggatttggtttttttggggaaattttttggttttgatgttttggttttgtttatttagatagggagagtttagagtggttgcgtcgagagagttggtatgttatattgtaatttatattatttatttttttttgattttcgggtttttggtaaattgtatgtttatgtgttggattagtttggaatttaattatgtattattttttttttaattaaattatttatatatttgattaacgtttttattgttgggaagttaaatttttaatgaaattataaataaattcgtgtttattgaattttaggttagttttatatggggttaattcgtttatcgaatgttaagaatttattgtttattattttttttatttattttggattttggtgagaaaaagaatgtgttttttttttttagttttaggaatatgatataaatagtgaagtttggtttaatgtatggtttttttttcgttggggtattttttatagcgtaggattttgatttttagttttttttattgtttttttttttttttggtattagaacgtatttttttttaattttgtttttttaggtttgagggtttatttgttagatgttagtacgagaaggaaatagagtttatttattttggggattagtagttaatggtttataggttaaatttagttgtttgtttttgtgtagtttatgagttaagaatggtttttagattttttaaaagttgaaaaaaaagttaaagaatattttgtgatacgtgaaagttttttatatttataaatgaatagataatttatttatttaaatgttgtttgtggttgtttatagttttgtaaagtttaaaatatttattatttagtttttatagaaaatgtttgttaatatttgatttaatttattattttaattttatagatgagaaaagtaagggttaaataggtgaattggtttgtttaaaggtatataatttattagaaattgtttggaatgttttttttattgttttttagtgttttgtttattgtgatataggtttttagatgaatatttattgtagagggtaatgtataatgtatttttttttttttttttttttttgagataagtttttgtttttttaggttggagtgtagtagtgtaaatttggtttattattgttttgattttttgggtttaagtgatttttttgttttagttttataagtggttgagattataagtttatattattatattttgattttttttttagatatggggtttcgttgtgttgtttaggttggttttggagtttaagtgatttttttgatttagttttttaaaatatggggattataggtgtgagttattatgtttggtttaatgtagttttttaaaggaaagtaaatatttagaatatatgtatatgttaagtttgtgagtttttagaattttaatttttatttgaaatttagttttaggaaatatgttaagtttaaaatatatttgaattgtttaaataggtagagagatgtttttttttttttttatagtaattgattatattttttgtgtagtatttaagtagtaaagaagaggaagattgatttggttttttagttttttaggtgtagaattttatttaaagaaaaataattgtggttttaatgtaagtttgaatttaagagtagttttagaaaattgtaaaaatatattagttgggattcgggtttaagggattggaaagggaatatttttaagatgttaattttatgaaaatgaggttgttttaagtgtttaatataagttttttttatttttttttatatggagataatagtaagggtgtttatgtttgttgattggtgtgggattttttgttatttaaatttttatatattgttttagtggtaaaggtagaagaagttgggtgcggtataaataggaaatgattgggatttttttaggtattgttttttttcgttggttgttagtttttttttttttgtttagtgtcggattttttaatattattgtaggtagattttatatttttttcgttattttggataattaaagtgtttaatttaaacgtttaattttaggtttaatttagagtttttttttttttgttagtagcgaggtataggttttaagggaattggtaggttgtttgttttttttttgttattttatttaaaggagttggggtttgggagtgttgttaggagatgttttttttttttttttagggtttagtttttttagtgtgttggatgagataggaaaggaaaatatgagagtttttttttttattggttattgttggtattttttttttagttatttttgtttttttgagtagtattaggtttttttgatgtttttttttttaggggtagatatgtaagtttggtttttttttggggtgtatgtgagttttatgtaggggtattttttatatttttattgttggagatatgattgagtatatagtattttaggtgagttttggtaagttaatttaagtttatttacgttatggatgtttatttgatttatagaaaatttatgttttttcgttatgttaagtggtggtagtttttttttggttagtttttttttgttatgcgtggtttttacgttgttttttaaaggtattaggttttgtttttttgtaggtatttttgtgttatcggttcgttgtagtgttttatttttttattttatttttttttgtatatttgatgtgtttatttattttttaggttttgttttaaatgttgttttattggagaagcggattttgatttttgatgttgtatattgatttatgattttattatatgtttttataaaattttgttatttttttttataatgtttattataattgtaattgtatagtaatttaagttatgatttgtttttttttggtagatttaattttttggggtaagaattatgtttgttatgttttttagtatagggtttggtgtgagtggtatttagtatatttttataaaagtatgagagagaatagggaattaataagatatggatttaattttaagtagttggtttagtataaattataatttagttttttaattttattttttttttttttttttttgtgttttttttttatttttttttttttttttgttttttttattttttgtttgttttttttgttttttttttttttttttttttttttttttttttttttatatgtattaatttaaggatttaagttttatttttaatgatttggaaaattgaattaagagtaattgttagggagtgtttttgtatgattatttttttttttttcgtttgagaatttatagaatttttttgtaagatgtgagtttggtttttaaggttgggttttagtatatatttgggaaagttttggttttgtgtatgggttataaagatttattagaagtagacgtgcggattgaacgttgatttttgtttagaatatttgttttttttttatatttgtgtgtattattataattttaaagaaatattgatatggagtatggttggttttttataggaaatttatatttgtttgtcgtggggttgttttttaattattgtagtttttgtgttatttttggagttattgacgggatattggttttttttttgtgtgttgtaatgtattattttttttttgttttttattagatttttttgggaattgttttaaggagaggagatagagaataataattttttttttttgtttttatttagttttaaattttagaaatagtatagaaaattttatttttgtaaaatttttttttatttaaagcgaaaggttatttagtggagtaattgggaaaggtatattttgagggtagaattttatttttagatttatagcgattatcgttttaggagttttggatttagtaggaaagtaatgagaggttgtgttattattatacgaggtatggagttaaagggagtttttttttattgaacgaagttttttggtgatgtagttttatgtatattttagaaagtgtttttataagttttaaattaaggtaaataaaatgtagaattattagaaaataaagattaatagtattaatttaggatgtaaatgtttttagtagtttatagttggatattgaaatagtatgtttaatttgttgaaattgattttaatttgatttaaattaagaagttttttttttttttatgttgtagtaggtttttaatgatttttaattgtattaatttaagaaattaaatgattttaaaattatgaattggtaagtaatttagagaattttatttttatgttaaaaattgtattaatagaattttagagttagaaagttttttagtaattagtgaatttagttatttattttttataagaagaaaattaaggttttgaaagattaatttatttgttgatgattatatagtttttttttttagtataatttttttttttgtaatttttatttaggaagtagtttgattaattttgagttaaagttttatttgtaagtgtttttggtttttttgttttggaattgtgtatgtttgtgtgtgttttttttttttgaagtttaagtcgcggtgttaatttatggtttagtatgtgagagttggagaatatttttgtagttgtttagttttaatcgttagttttggtaaggaaaaatgatagagatttagaaaggttaatagtggtttattttattttataattagttggttttaaatttggaattgaattttgttttttagatggttagtgtattgtagtatattttttggaatgttaggttttatttcggttttgttatttttattggttaggaagtatgtatatatagttagtaaaagtaaatttatttgagaagtgtattaattggaatttttataatttgtaatatggtaaagttatttttgtggtttttagaatttttaagattggggtattttttgtatttttttttgtcgtttttagaaatgatgaatacgtttttatttgatttttttttttttttttaaattttagtatataaataacgattatatttatggagagaagaaggagttcgtgtgtaggtggttggattgtttaagagagtagaaattttttaaagtttagtatatgttggtagtgtatatgagaagatatacgggcgagaagttttataaatgtattgtgagtatagaagtgggtggtaggtatatttgggtttttttttatatttataagagttgtgtaaattgatgatattagtttaggggaagcgtggttgggtggtaagagaagaggattagagtattgtttggtgataaatgtttcggtgtttgagtgattgagttggatagcgtagttttgtatagtggtaagggggtagtggtggttggtattgggaatgaatagcgggttattttgttggtcgtagtttaatagtttatggtattacggggtttggaaggtaaagggaagtgttagtttttaatttatagagttgaagttgatttttaaaatagttaatttttatacgaggttttaaagtttttttttttttttttagtgagtttttaggtataggcgtatggaatgggaagggggtgtcgtaaggttgtgtattttttattgaggtgtttacgaggcgtattgggtacgttgagttttggtattttatattttaaaggttttttataaatatgattaaattttatgtttttgtatggatataaagttatattaatgaattttgtgttgaatttgaaattagtgggaatttgaggagattaatgagtagataatgaaatttattgtttatattgagcggtttattaaaaaaaaaaattttaggatttttattggtattgaaaattttttatttggaattatattaagttatatttgaattttaataaatgtagagtttagtggattttttgtttttgggttttgaaaagttgttgatttttgaaatattagttttttattaatttggagggcgtgttaggtataagttgttgttgttattgtgtagagtaatttagatttatttgttgtttttagtttgaaggttgtataaaggtttattcgagattagaaaatttgaaaatatatttgagattttatattggagagaaattatacgtttgtgagtacgaaggttgtaataaggtttttttaaatgtttttgatcgcgttaaatattaaaatagaacgtattttaatgaggtaagtatttttagtgggtatggagtttgtataaggaaataaagaattatttcggggaaggtatatgggaaggcgtagtgtgttttgttttgttttttttttggttatttttagtatgaggggttttgtttttgtaggtgaaggtttgagttttttaggtgggattggaaattggattttatttggagaataataagagatgaggaggaaattttttaaaatttttgcgaatttattagttttatgttgttttgaattgttatttattggttaaatagtgggagtatttgatttggaatttgagttagttacgttgtttaaaatagtaggaatttatgtaaaggatgattttataagttttaaggatatattaagaagtagtatgttgatagttgatagttttttgttaagttatttatttttatttgttttttttaagtggtatttttaaatggtattatattaaaaaagatttttatagagtaattagttttggttaaatgtaatttttagatattttaaattttaaaggattttggaaaatggttttagaaatttagaatattttttaggtagttatttaagaaaatatattgagtaaagttttagggtgatttttgttgtgttattgttatttttaggtagcgattttttttaaattgtagagaggtataagaataaaaattattttaaatttattgtttatattttagtgaatatttttttatagatttttaatttggttttggaggtttagtttaaattttggtttgtttgtgaaatttttttttgaatgtattgagagattaataaaaggattttttatattttgagtggaaataggatagttaattagaatttgttaatatgagatatagtttagtattatagcgtgttattagtttgtttgaaatgtgttagagaaggaatatcgtgtatatatgagattttggagtggttgttattttattttattagtgtaggttaaatatatttatgattttttagatagagagttgggtagagagaattttgatagaaataaagtgagttattttgtttagtggatttttggttttaaggtggtaaagatggtttttattatgttttttttagttgaaattgatagagtaaaaatatttttaaagggattaattgtattttgtaaaaagtatatttatttataaatttatatatgtaagtttatatatatattaattttttgtgtgaaaaggttatggaaattggagttattcggaattttattttttaattgtttgaagatattttaaagatgttatatttttatttttaatgtaaaaatgtttttatagtatgtagtagttggaatataatttattatatttgttttgtataaaattttagggagtttagaatagatagatatatagagatagaaagtagattagtggttgttaaaagtagaggggagagggaatagtgatgattgttaatggatataaggtttttttgttggggtggtgaagatattttggaattaggtaatggtgatgattatataatgtttagaatgtattaatgttattgaattgtgtaatttaaagggattatttttatggtatgtgaattatattttaatttaaaattttaaggggttttgatttaatagaatgtattttatatattttatagatttaagtgtaattttgattagaaatttagggggtatttatttttatagatgttaggttaatgttgttttttattattatggagaagtttggatagagggtatgttaggattagaatgtatatatataaagataattattaagtttttttgtttttttatggatttaaaatatttgtatatgtttgtttgttttaattgtggtgtagttgagtttgtgtttttttttaaggtaaaaagtgtaatgttgtgtgagagttgagtgtttgttataagattaaaagataaggatattttgggtagtaatgttattgattatatttgagtaatttatttaaattattaatttttattataaatatataattaaaattttatttatagatatatttataaataaattatattttttttttttatatgtaagattttggttttgtgtgtgattgatggatatttttagacgtattaaaattaagtttgtttaggaaatttagatttgtgtaattttataattttagatgaattaagtgatttgtttttatttatttttttttttatttgtaattttatttatttattgaataaatatttaaagttatttatgtgttaagttttttgttgttttaagtgtggttaagaaaataatggattgtaatgggaagggagtaattgttggtatttttttgtttttttggttgttttgtttatttagggttgttagattgatcgtagttttgataggattttttattttagattagatagtttattttttttttaaagatatcgttaaataagttttttgagttttgattcggttgaatttttttttttagaaagttgtaatggtttttttttttttatagggagatttgagattttttaaggttgtgtaagtgttagtttttatagggtttaagtttatttttttagttttgattttttattattatgattatgaatgaaattttttagaagttggtgttgtgtattgttatgtttaggtgtatgaagtggttttgttattggatttttgttgaggatatttttttttggtattttaagtaaaatgatttttaataaaagttttgtatattgagtgtttattatgttttatgtattttggtaagtattttatgtatatgatttaatttagtatttattgataatttcgtgagttgggtattaagtttagatatagaattttaataattgatgttttttatgattattttagttgaaaaatgattttttttttgtttatatttttatatagtttttatattttatattatagattattgtatttttttattttttttattagattttgtattttttatgattaaattttgttgtatgtaattttgtgtttgtagaattttgtattttagtaagtttgagaatattttttttagtttttaattatattttattttagttattgattataataaaatttgtgggtaaaagttgtgtgaagggttaatatattttgtttatgttatgttgttgtgaggtatatattttttgaatttgtatttttgtgaatttgtgaatttttgtgggtagataatgtgtatgtttatatataagggtatacgggtataggtgtatttgtatgggttgttgtttttggaagtgtaggagtcgatatatttgtattttattatatattggttgcgtttttggttttaagttaatttataatgtatatttatatatttataggaagagtagttttttaaatatgtaggttttgtgttttttttttttttttggtttttatatttttgttttatatattttagtttgtttgttgatggaataatttgttataggaatgttgtgagtaagtatagggtttgtgttagaatattgtaaggtaatggtattaattattagagttagttttttgtttttaatgtatagaatttgatgtgtttattttattatatatatatatgttgtaaattatataagtttttgaatagatgtaatttatagttaatgggaattaattttgtttaaaggagttttaggtttggaggtgaaattttttagttttaggatttttgttttattgtattaggatattttagtattttaggtagtatttagtttgtttttgggtttttagtgaaaaagtattttttagatatatattttataagatacggtatttttttaaatataataggtatattatagtaattttgttttttatgacgtttgtttacgtaaaagtttattttttgttatatatagatataaatatatatttatgaaagtatttttgcgtatattatattttaagttaagtgaataaatttataaattcgatgttggttatgagttaaaggttagtagttttgtgattttagaaaataattcgtttatataagtattcgtataattttttatgattgtatttttaggtttgattattgatttatatagaaaatgaaattagtatgaaataatttatagattttagttataaatttattgaggagaagaaaatagattagaaattttggtttttagaatattcgttagttttttgtagtttatgatgaggatttatggatagtttgtaatagggttttttaattttaaagagtagaaaggttttggttattttgagttttgaatatttttatatttgtaatgttatttaaaggagtatattttagtgttatttaatatgggagatgttatcggtaatttttaaattatgtttgtgtataaatagtatatttttaaaaggattagagtgatattagattttataattaggatatttataaaaaattttgttatataattttttttgaaaggtgtgtagtttttttttgattagatgatgggtgttttttaagttatttttatagttatcgttattattattattattattattaaatatttattgagtgtttattatggtatcgtgatattttttatttatagtgtaaatgtttttaagaatattaaggtaatttatatatttttagttttttttgagttttttttttaagttataatttattaaagttaaattttatggatacggaatagtgttttaatggttttattaaattattagtttttagaggtatttgaatattttaaagttttgtgaaagtgttttgaaaggattaaaaatgtaatgagtaattataaaggatttttgggttggggtatagttttttttataataattttttatttcgtttttgtgggatttggtagaaattatatgtgtgtaaaattttaggttgtattaagcgttatatagatttaagtttttttcggaaatatgtgaagatagtgtatggtttagaggtttatgttattaagaagtagcgaggggatatttattttcggtcgttattttcgagagatttcggtagttatttatagtttaggtcgtttggtcgatcgatttagggagtttttggtgagtagtaggattttagtaatattattttaaagcgggaagaatgtttttaggtgaaaatcgttaaggtagagaagttaatggtatgttatttattttttttttgattttatagtaggtttatttaaaagagttaggtagggtgtatagagggataggatttttcggtttttattgtgttaggttgtttttgatttgaggaggcgatgagggtagtgattcgtattgtttacgtgaagtcgattagtttagaaaaagagtttttaggttttttaattgatttttaaaattttttttagaattatattattgtgttatggaaggaagaaagatacgattgtttgtttttttagcgtgtttgtaatgtcgaaaattatttattgattttttttgtaaatatgttttttgttttttttgttttggtgattttaaggtaaataggttatggtttatattttttaggagtttatagtttagtgggatagatagattgaaaaataaatatcgtgtagtgtgatggaggtttatatataagtttgtgtaaagaggatttaggagagggacggattgtcggttagtcggggtagaggaagttatgggataggagtttagtgttttagagggaagagttgaggaggatgaggaggtagaggagtataggggtgggaggggaatagtatagtaggggtgagtttttttgtttgtttttttgtttttgttttttgaggaaattattttagtattagtttagaaattgggtaaattggagattatttttgtagttgggtttgaattagtaaggtagagtatgagagagggatttggaagatttagtaggtaatttttgtgtttggagattaataggatatgtgggttttgttatttttttagttttttttaaattttagttcgtgatttcgttttatgaatgtgattttataaaatatttaaaaattttaaagataataagaaaaattaagagtagatagtatagtagaggagatttagtttatttggttatgcgtagaatggatttaattgtgtaaatatattgggttttgggttgttattttttaatttgtgaaggaagtgtattagagagaagttttatgtttagattgtcggatgtacggaaataattaggtaaatagatttatatttaaagttagtatttttttaaaattagagtagtttatcggatggagagtttatgaatttatgagtgatgttatagtacgtgtgggtgggaaataatgtataattttattattgagacggtgagaagttatgttttaatgatttattgagtttgtttttgaatttttaagagttttagagagtgatattaagtttagttaaaaataatataaattagttatgtagatttattatgatttattagtgggtagttgtattttgttttaaaaaagtattttaataagatgtttatatattatggttgattattgtattttaattagtttataaattgtgttttatatattttttttgaaggggagtatatgtttatttttaaaataaagtttatttgtataataattgtatagaatatttaacggtttatttttacgtgtttaataaaataaagaaagttaatttgtagttttagattatgttatgaaatcgatgatttatatttttgggatattttaagaatttaaaattttttttatttttagtgtatatttttagtttaagaaaattgttattttttttttaaatatttattgtttaaaaagaaaattggtagaaataaaaattatagcgatttggtttagtaatattgagatgttttaatgtgtgaaatattttataaagtaatttagttatattaggttggtgttaacgtaattgtgggttttgttattatttttaatggtaaaatttatagttattttggtattaatttagaattataggattaaaagaaattatggagattaagattatgtttatattttgaggaagttgaggtttagtgaggttaataaattaattatatttttatagtagatattatgtgtgtatatgtttatatatatttaaaagtaggtatttttatagatatttattaataaatatgaaatttatatttttatttttttttaaaaaatatgtttttgatttgattattatgttataaattaaatttttttttttttttttttattaatgtaatattttttttgtttaatgtttttaaatgttttgtttttattttttaaggatagtgggtaataaggtgagggaattttggtttttttgttttttttgttttgtttttatttttttaatatttatttttttttgttaatttttttttagtttttgtggttttgtgatatttttggtagtgaatattatttagatatgttttaaatatagaagtaatgtgtttttaatatttagtatgtgaaaaatgtggagttagttggtgaaatttattgttttatttgtttaggtttttataataaattatattggggtttattaagtagatgttttgaaagatttattattgtattgattaatgtaaatttatttttagattagatgtgtattattttttttgaggaagatttggttttatttgttgttagtaatgtaatttttatttaaatgtggacgtttattgaagtaattttttaattgtgagtgtatttgtgttttatatgaagtgtgtttgtttgtgtgtttgtataaatgtataagtttatgtttgtatatattttgatttgatagtttaggagttaaagatatttaaaattttggaaataagtattttaggaaggagtaggtggtttggtattttagtattttgttgaggttaaaaattaagtaaggttttatatatttacgattaaatttgtataatttatttggttttgtttggttgttcgggataaagttagtgtattatgtagtatttatttagaaagtgtttatttgtttgggtgtatgtattatgatagtagaagaagtgaaagggttttattgcgaagagttttttttggtggtattgtgtattttatttgagattatagtattttgtaatcgagtgagtgtagttatttttttttaaagtattttttttttcggttgttgttcgtgtttatagtaatattggtgaaggcgttgtagacgtatggaagtagtcggtttaggagtttaggttagttgtattatttattttgtgattttgggtagttattaaatttttttgaatattattttttttatttgtataaaaaggattcgattgtttattaattaggatatcgttggaatttgagatggaataattttgtgttgtgtgattgttttgtgtattgtaggttattttatatagtaatttttagatattgggtattttgaatttttaggagttttgggagcgagaggaggtagtattttttttgattgaggattacggtggattagattaagattttattgtttgtagtattgttttatagagtttattcggttggggttagggaattattttttaatttttttagtgaattattagggagtatattaaggagaatagtgaaattattttatagatttatgacggttgtgatttgtagttttttttttttttttttttttttttttttttttttttttttttttttttttttttttttttttttttttttttttttttttttttttttttttttttttttttttttttttttttttttttttttttttttttttttggtatagtataagttaagtgattgaagttttattttttttaattgtttttattgatattttggttgaggttttataaaagtaagaaaatgtggaaggagggaggagaggttataaagagtttggttaattagttttgaatagtttagaggggtttttgttggaggaggtaatgtgtgttgatggcgtatattttatatttatgttttagttgagtaaaatgaattttaagattaaaattattcgggattataataattgttaatattttgtgaattaattgttattatttaggtttttttatatttgtgtgttttttgggttttatatttaattttttataataatttttgaaataaatggtttttgttttatagataaggaaattgaggtttagagtggttaagtaatgtgtttaaagaataaagtggtggagatgggattggaatcgaggaagtatgtttgtagagttggcgattggggtaggattttatggttgatattatgttagttatattgtagttagtattttttgttttttattgttttttgttgtttattagtttggtggtttattcgttattttggttaaaagtggttagtttttatttattagaatatagtttttttttttatttaattaattgatgattttgaagatttcgatatgtatgagtttttattattggttttttttttttgattttttttggtgatattttttttttttttatttgattttaatagatattttagttaagttttggtggttagtttttatgtagtagttaatagttttttattagtaattattttaatagtgggttcgagttttttttgatcgatggaggtagtataggagattttagtgttatcgatgaaattttaattatggatttaattatttttattgtaattatagtttttgttttgtaagttaggagaaattcggtagggattaaatggatggagtacgtaaaattagaaaggttaaaataagtgaatggaatgttttcgcgattgaattttattttattttttaaagtttttgcggtttttttttttataggaaatggtgagttttatattagattatgtatttgtttagggtttttttttttgtttttttaaatgtaggtttttagttttatgtttgttagtttttttattagttttaaaatgacgttgtaattattcgttaatgtttagtttatttaagttgttttttgggattgtttatattttaaaaatagttaggaataggataatattgagaaaaaaatgtgattgtgtatgatttatattttgatggtgaaattataattgttagattagggtaagggaatgttagtagtggaggtatttgtggttggaattttgtttttggtttttaaaatttaaaattacgaggttagtagttatttttatttatatttatttagtttaaggaaagttagaaatttttttttattgttagtttttaggttagtttgtatttttgagattatatttttgagagtatttaaggggtgaagtttttgtttgtattaatataggtgttatttgttggtaggatgtggtatgaataggacgttttgagcgtgaatgtgaaattcgtggagtatttttgtttggggatttgtttggaatttaagcgttgtgtattattataagattttttttgtttttgtatagcgtttggggaggggttttagtgaatcgagggagttgttattgttttgtttaagttaggtattagtaaattatagtttgcggttatttttagtcgtttttgtttttgtaaaggaagttttatggatatttcgttacgtttgtttgtttattgttttttgtggtcgtgttggggttatattgtagagttgagtagttgtgaggtaggtaatgtggtttgggatattagaaatagtttttagttggttttttatagaaaagggttgtttatgtttggtgtaagttatgttcgaagggaatttattttcgtatggtttttttttttttttgtttttaggtatatagtttaataatatttgtagtttgggtgggtttatgacgtttttttcgggtagaagcgatttttttggggtggacgttattatgttgaatatgtttaatagaagggatagtagcgttagtattattagttcggtttatttgagtagtcgtcgttttttagggatttcgttttgtttttttagtcgtcgttttagcgaggcgttataggtcgagggtcggtcgtagaacgtgagcgtggtcgatttttacgattttatttttatcgacgtttcgcgtcgttttagcgaagttagttagagcgacggtttgtttagtttgtttagttttacgttcgtttagtagtatcgttttaaggttaagtacgcggttgttataggagggtcgtcgtcgacgtttttgtttaatatggagaggatgagtttgaagacgcgtttggcgttgttcggggatgttttcgagtttggcgtggttttgtttttagtttatgtttcgaggaggtgtagcgacgggggagtttacggttacgggcggcgttatttgtagtcgtacgatgcgtcgggttacggcgtgaggagggttagcgattcggtgcggataggtttcgagggtttggttttgtttcgtgtgtcgcgttttagtagttttagtagttgtaatttttcggcgatggttacgttcgcggagaagcgtagtttcgtgttttagaattatacgcggttcgagggcggttagtttcgaaatttttattcgtttttttgtttttttagtattatcgagaacgttattttggagtttttgattatggacgttgatgttaatttgaacgatgaggattttttgtcggacgacgtggtgtagtatttaaatttttagaattaagtagggtacgagtagtatttttttagcgttttttcggacgatagtaaagtgttttacgggttcggtgattttgacgcgttcgggttgttagatagttacgttggttagtagttttatgttttcgagtagttttgtttcgagggtagtaaaatcgatttgtttatttagtggaacgaagttagtttcggaagcgtcgatttgtttttttttaagtttaagtgtgggtcgcggttcgttgtgtcgtagattcgcgtttttgggttttgtaacggtatggtcgtttattcgtagaattttttgaggagcgggtttgttgggggttattagattttcggggagaatagtaatttttacggtggtttagagtatttgatgttttataatagtttcggaagtggtattagtggaaacgttttttatgaatagttttgtaaggtttcgtagtatgggaattgttttaataggtagttagtggtttttggtgtattcgacggtgtttgtggtgtcgggatttaagttttaaagttgaagagtatttttatgtaagggagcgggggttagttgaatttcggtttgtcggtagcgttaaatgagttagttggtagtatggtgaatggtatgtagaattaggatttagtgggataggggtatttggtttattagtttttcggcgatagtatgtagtattcgggggtaggtcgtttcggttagtagatgtttgggtagattagtgttattttatatattaatatttattaagggttagagagttgtttgttaggggtttacggtatgggtagttagtcgttaagtttggtagttgttaggggttattagttatgtgttagttttgggggtagtaggcgttaggttatgtcgagggatagttttgttttgtagttaggatagtttagtgatataagttagatttgtagggtgaatggtattaagatggagatgaaagggtagttttattcgttgtgttttaatttgtagaattattttggttagttttatgattaaatcgtgggttttagttagtaagatacgaaagttggtttattttttattttagacgttagttgtttgttataggggattagcgttaaaaattttgagttattttttttaggtgttaattaggtgataagtatagtggatagtttcgatagttatgatttggaaggggtatagattgatttcgatgttattatagacgatggggattattttagtttgatgtcgggggttttgagtttaagtattatttagaattttttttatagtttttttcgttttattacgtttcgggcgttttttttatttttagcgttgtttatgagtattattaatatggttatcggggatatgagttttttgttgatttttttagcggaagaaagtaaattttttgtagttatgtaataggttttaggaaaaaaagattgtaattaacggaaattaataggagttgaagagattaaattgattttgttttggttgtttttttagttttgtatgtattttagtaattttattttatttaattgagatgtgttttaattatattttttttatggaaaaggattttgaaaaattttaaagtattttagggagaaattgttttttattttagttttgaattagtattgttatatttaaattattttttttttaaaaaaaaaaaaaaaaattgtaagtttcgttttttttttagtaaatcgatgtaaatttgtgatgtgtatattttttttttttttagaagagtagttaaattaaaggatttgatatgttttgttgttgtttaaaggaaataggagttggtgtgtttgtgattaaggggttatatttttagtttttaaaatttttttttata

SEQ ID NO: 55 - DNA, 260116 bp, Homo sapiens
ttttaatttttttatgtggaattaagagtgtgttgttttattatttttgttttaaaagtgtaatttaaatgaattgaaatatttttatgttttaaagaggttaaagagtatagtttattagaatgaattaggattaagaggtatattgtaatttagatatttttatgaaagaggtaaaaattattgattatttggtttgaattattttttgatttagaatttggagtaggtttttgatgttagaaattgttggattttttttaaaatatttaattaataattaaaaattttttttttttttggaatttgtttaaatgtttttttttgtaaagttggttatttgaagagatatttgtagatgtggttttaaaaagtaatgtgatatttgttttatatgatagatatagttgtaaattgagatttttatattgtttgatattaaatgtttagtagggatttgggaaaagtattatgttatgggtattttttttggtttttttttttgtttgtgtagagttttattggtttgttaaattttgagatttttttttttgttagaaaatttgtggagaagtgttatttatattttgaattttttaaagttttaggttttttttagatgataggtgaagtggatttttgaaagttttttttttttttttattattttggaaagttgatggttttgttgttttttttagggtatttttggttgaagagagttgaagtaatgagaagatattatggaggtttagttttatagttttatgattattgaaaagaaaaaagttgagaattttatagtgaagtgttttatttgaatagatgtgagtgagaaagttgttgtttttagtattatttttaatggtgagtagtatagggattattagtagtttagtttggagttatttttgtgttttttgtattttttgtgaattgagtgtttgtatttggattagtgtttgttttaggagatgttaaagaaagtaaatggagtaggggtggggggatggtggggggatatggaatgtagtaatttttattttggtatttaatttatatgttgatttttaaattttttaatttgagatgtaaatgtgataggttatttattattagaagtttttgttttggtattttggaaattattttgattagtttggtaagagtttaaaatgttttgtgttgtatatggattatttatattatttggaataattagtataaaagatataaaagttgttttgttaaaattagtgataggatagtagttttttttaattttaattttaagtagtttattttaaaggattttaagaattgttaatgattgaattttaaggtaatgttagtatttgagatgtaggttttgttgttagtttataaaaatttaatttatttatttgtgtttagagataatatagagttattgtttttgtattttgtgtttttaaagtttaagtaaagtgttgagaggtattttagtttaagtatggagtgttgaaaataaattttagagtatttttggtataaatagattgaatatgttaatggtaatttttattttttgtttttgttgtttttttattgtgggttattaatgttttttttttttgtagattttatagttatttttggtttttttgaatttttttgtttttttatgggtttttaggaagaatgagttggtttgttttttttgtttttggatattgtttatttgggtatattgatttgtatgagttaatttgttatttttatattttttatattttaagataggttttatttgattgatttataagtttttatatttatttagagagttagaattttttttggaaggtaattgtagtttagaatattagattttaagggtatatatttttaagtagtttggttatttttttttgggtttttttatgtttgttgagagtttgtgttttttatttgtatttttttatttggttttatgagtgtgttttgttgattgtattgggtagggaaggagttggtttttaaatttgttggtaaatgattttagttttaaattgattttgagggagatatatttatgtttgagttaaaataatgaatttatatatatgtgaaaatatttttttttttattgatggtatttaaagttaagattggagtttattttaattgagttagaatatttgtattttttatttaatgtggttatagaaggtatttttttttagaaatatgttattttggttttttttttttggaattggtaaaatttaggtaaatttattattttagaaatagaattagtatatgtagtgttggttatttggtaatttttatggtaattttgttggaataaatgttttttatgtatttggttttaggaatattagtttttggttatttttatagtttgtgtgagtgtatatgtttgtgtgtgagggtgtgagtgagtgtgagtgtgtgaggatatgtgtgagtgtaggtaaatgtatgtgtgagtgtgtaggtgtgtgggtgtgggtggtagaggtaattatgagtgtgtatgtgtgtgagtatgtatatgtgtgaatgtgagaataggtaagaataagtgtatggtagaagatgttgttgtattgtatggagtttgtagaagtgtttgttttgtttgttaattttagttgtatggttatagagttttatttttatgaagatgttgttgtttgtgttattattatatttggatatatttttaggaggttttttattgtagttgtatttgttttgagttggttttggattttgggttttttttatgattttgttgagggtgattgggaatagaattaatttgattagttttataataattagaaagttatgagataaaattagttagagaaggagtagttatgatttataaatgtttgtgttgtagtgttaaataattatttgtttttttaattatatttttttggttttttgttttgattagtttgtgtttttgagtttatatttttttttaaatgtgtatgaattttgttttgtttggggattgatattgattggttaaatttgtagggtatatgtttgagtgatagttgttttagaaatttggtgaattttggttagttttttagtgtttttgttttttttaagagatttattgttttatattttgggataaaaattaaataaaagaaaaatggaagtggtgtttttaaatatggattgtaagttgataggtagatttttggaaaataaataaatttaaagagaggaataagtaaaagaaaggataataaattttttttttgtgtatgtgatgttaataattattatggttttttttatagagttttttatagtttttatttaattagtttagagtttttttatagttttaggattatgttgaggggtgtggattgttggaagtgtagaggtttttttttttgtaatttggttatttgttgtttttgtatttagttttgattatagggattggtgtgtgggttttggatttggttttgtttgggtttagagtttgtggggtgtaggatttttaagttgggatattatttgtgtgttggttggtggttgatattgttatggttttttatttttttgtttatttatttgtttttttgtttttttttttattttttttttttttttttatgaatattttataaatgtttggatttttgtattgatgttatttgtagaaaggaaaatagaattatatggatgttataataggtagtttgattgttattgtttttagaaaggtttttgtgttttttttaataaagttttgaattatatttatttataattgaataattaaaaatgagtttagttttggttaggtttggtggtttatatttgtaattttagtattttggtaggttgaggtgggtggattattaggttaggagattgagattattttggttaatgtggtgaaattttgtttttattaaaaatataaaaaattagttgggtgtgtggtgggtgtttgtagttttagttatttgggaggttgaggtaggagaatggtgtgaatttgggaggtggagtttatagtgagttaagattgtgttattgtattttagtttgggtgatagaatgagattttgttttaaaaaaaaaaaaaaaaaagagtttagttttaaaaattaaatgaatgtgatatttgtatttttttttttatttattattttatgattaaaattatataaatgaataaaaagttttgttattggttgagttattggtgaggttgttttaattaatttttttagttattttgtggtgtaatttgttttttattgtgagttttttagttaaattatttatattttattgtatgtttttgtagatttgtttttgtattttttttagttgagtatttgtttttggaataatatgtgtatagagttttgtttaaatatatgtagatttataattaaaaggtatagtttagaaaatttgaatagttttttaaagaagtatttgttatttaatattgaaatttaaaataatgtaagtgaaaaattgtgttgtagattttgtatgataaaaaaaaaaggtaagttaaatttgatttttgtaatatttaggaatttatattaatatataaagtttttggtaatttttatgtaggaagtatagtgtatttgtagttttatgtgtttatagtttgattttaaattttattgttatatttgaagtgtaaatgatgaaggagatgatatttagttttttgaattatttaaatgtaattgtggtttaagtgattatttgtggtattttatatattggtttttttatagaaagtatgtatgtagattttaggtataattgttgattttaaaatgtttaagtttattaatgtgtgaagattgtaagtaaaatgttttaataatttttttttgatgtagatgtattattttataagttatatgttgtgttttttaaataataagagttttttttatttaaattttttaatgttttatatgtttttatttttttataaaattttttttaataatttgtaaatattgattttttaatttgaagtgttttgttttatttttggtttatgattttgttttaaaggagtaatttgatagtttttattaatttgtaatttggttttaaaaaagaaattaatgataaatgtatgtaggttgtggttttggggattttttattagatttgatagttattgggaatatattttaaagtgatagaaagtagaaattattattttaatgttgatgtaatgtgaaattaaagttgatagattaatgatgtaaaggaagttttttgtttattttgatttttttaaaaataagaatttggttttttgtttaaaaaattattttttttaaggttggtaaggggaaagtgttatggtttgtaaatttttaaggagttgtttttttttttgttttaatttttggttattttttggttttgtaatttgtttttaaattgtttattgtatgggtgttgttaggttggtgtaaaagtaattgtggtttttgtttttaaaagtaatgataaaaattgtaattatttttgtattaattattgattgtgatgtttgttggttttttagttgggagttagatggttttgagttttgttggaagtttgaaatttatttgttattttttattataagtttttgtttttttgatttttttttaatggtaagagtatatgtgttagttttgttttgaaatgggtaggtagtttatgttataaagaatataggttgtgagtttttggttttttgtttttatagaggtttaattttttttttttgttatattttattttttggtatatgatagatatgtggaaaggatgtttagataaaatggattttagattataggatgtttatttgtagtatatataggttttgggatttgaaagtttggtttgagttttggtaatatgaaggattagttatgtgagtgtgagtagattaattttttagtgttttagtttttttattagttttggaagataatagtaagatttattttatattttataggttgttgtattataaatatataggaaggattttgtaaatgttagtttttgttattaggataaagtatgttggtgagttaaatgttatgaatttaaaataaaaagattttgtttttttgaatatatatgttagtttttaaattaagggaaatatgtttgttaaaagtaatggtgaatttgttggatttagatgtttgaaaaatagtttaagatgttttataaattttaaatgtgattaagtttgtatattttaaggagggatggattaaaaaaaataaagtttttgtaaatttttttgtaaatgtttttttaaattggaaaatagggaagataattttgggaaaatttattttagtttttttaattttgaaagttagtgttgtattgattatatgttattgtattagaagtagtatatatatatttttttttttgattttttttttgggttgaattggtggtttgtgttgtatttgaattagattttattttttatagagagtttttatgtttttaaattaattaattgatgataaatattttgattttaataagagttttgatttttttgagttttaaatttatatgttttgaattttggttattattgtgttttttattttggttaagtatattattttttttgtggttagttaggtttgaaattgtattattatttttgattttttttttttttttgtttttatgttttattggttttgaggttttgttagatttttttttgtaattatttgtttgtgtgtttttttaggttaatttattgtattgtgtggtgaaaatttttatattttatgtttagatgattaaaatgattttttgtttaattattttgttttttatttttatttttgttatgtatgggatttgtttttgttaaattaggtttattatagttttgtttatgttataattttgttttaaaagttttagtgatttttagttatttgtagaataaagtttaaagtttttgatttaatatttagatattttttaaaatttggttttagtttgatagtttaatttgatatgtttagaagtagatatgttattattttattgtataatttatgttttagttaaatgtaagggtttttggttttttgtttatagaaatgttttgttaatattaatgtatgtttaaatttttaaatgtgaatatgtttttagtttttttttttttttataaggttttgtgttttttggggaattagtttataatattagatttttttatttttaaaattattattattttaagtaatagattttatgttttagagaggttttaggtttatagaaaaattgagtagaagatatagagagtttttatatattttgttatatatattttttttttttattaatattttatattaatgtggtatatttgttataattgatgaattaatattgatgtattgttattaattttttattatttatatgggggtttattttgttgtatagttgtatgggttttgataaatgtatgttatatatttattattgtagtatgttatagaatattttgaatgttttaaagattttttatgttttattagtttattttgtttttttttttatagtatttaagttttatattttagttaaattttttgagagtagtatttggtttttttattttatttgttttttgtttatatttagtgtgtttgttgagagggttttagtagatattgaataaatttgtaaattataatattttgagataggagggtaggggatatgtgtaatagtattagtgttgtgtagttagaagttagggtttgagttttatttttattatgtaattgttgtgtgattatgggttaagtatttaatttgtttgattttggtatagagagtatttaaatatgttagttattgatagtaatagtaatatgatttttatgggtataatttgttaggattaaatttattgatgtattttattttattttttttagtataatattagttgttagtattttttgaatggtttggttttagtttgattgaggattggttaattgaggattgaggattgaaggattggttaataggagatttttatatgaggttggttattaggttttagtttaataggttagagttagggaataatattttaaattattggttttgaaattggtataagttgggattttagttattggatttttttttaaaaagaataatttttgggataaatgaatattagataaattaggaataaatattatttttattttttaaatttaagagtaaaaagaagttatagtatgatgttttgtttggatgggatgtttttgggttgtttttgattatatgtgattatggggtgtgaatattttaaatttttagaaataagttgtttagaattagaaataattattaaatagtggatgtttaagtggtgaaatggtgatgatgggaggaaaatttttttttggagaggtagttggtggttttttattattttttgttttgatttttaaggttgaggagggtttgtttttttaggtagttttggggagattgggtgatagtaaaagtaaaaaattttttgttattttgtttatatagaaatgtttttagatatgtttgttttagtttattatttggtaaaatttatatatagtaagatttattttttgtggtgtgttgttttatgagttttgaaaatttgtaagtttatatagttgttattattattgagatatagaatggttttagtatttttttaaaattttgattattatttgtgttttaaatttagtttagtaatgtatatggtgtgagtttttagtaatgatagaaagtataggaattttagtagttgtttgatgttgtgtttattttatattaaaaataaataaataaataaaaaatttgttttttttgggttttgttagtaaaatttagtgttagttttttttttttatttaaatattttatgttgaatttgtagtagaatgaaaatttttttgaaaattgtttagaaatttataatttaaagtatttgttattttgaatttttttttttttttttttttagtatttagtgaatgtatattttaggttaatttaaaattttgttttatgtttaaaattataagatagttatattaaagggtttttagttattgtttttgttattttaaattaattatatgagaaaattagaatttgaatatttaatgtagttataatttaaagggaaaatagtaaatgttttgttattttttttttgttttttttttttttttttgaagtatttttttttttttttttttatttatatagattggattttgttttaggtagatagaatttttgtattaaagttatttttagtgtaatttaggttgttattttttttttttttgtttgtttttttttttttttttttgatttttttttttttttggtttttttttttttgttttttttttttttttttagttgtagaaagttgagttttattttaattattaaattttaggagattatttttatatggttttgtaaatggtagttttattttgtatttttttatttttttttttgttttttggtttgatagttgaaaaggtttgattgtgttatataatggtttgattggtttttttgggggagatttttttttgttttattatttgttaggtaggtggattagaaagttttttgatttttttgtttttttttaaagtttgaggtttttgattgaataaatttgttgttatgggataatttgttaaaatgagattgaaagatgtgagagaaaagttttattatttgggtgttgtattaatgaaataatggggttttggagtttgtaattgaaaaattattaggaatgtaatgggtggagatgggttttttttattttttataataaatttttagttttattatttaaagtatgtttgtttttttgtttgtttgtaggtttgagtgtgtttgtatttgtatttatgtttaagggtttttggggatagttttgtttggttgaaagttgtttgggtgttgtgtttagttagttattagattattattagtgggtggaaagaattttatatgatataattaaggttgagttaatataggatgaaaagtaatttatagataggttgtttttagttatttttgtagtttttgataaggttttattttagaatggataggtgatatttttatttatgggtttattttgtgatatttgtgataatagtttttggattttaattgaaattggttttaaaatggatttttatttttttttgtttgtggaaaatattgaatggatttagagttgttatagagaattttagattttggaaaatggagtagaaagttaggattattttttataatagtgttgatgatatgatagttttgttatttgttttattaatgaaattattgattatttgatgagggagataataaattatattttattattagttatgaaatttaattagattgttattataaatagggagggggagaaaataattatggaataaatgtagaaaaggttaattaaaattttttatttttgaagtgattattttagaggagaatatgttgagtgattgtagtgtaagtattttgaaattgtagtggttagtattatatttaaggattttttttttggttaatgtagagtagttggtagttttattaagtaaaattttattttttaaatattatttgttttattatgtaaaatttagaagtagaaggggaagttttgttttgtttaagtgtattataatggggaaaatgggagaaaaaaatttatagattttttttttttttatatggtgatgggatttggggttagttttaggtaggtatgttgggtaaggaagaataaattgaaaggtttgtaatttaggttttttgaaagaaaagtagtttattattttttttttttttaaagtgttttaggaattttaggaagatgagatgggaattaggtttggatttaatgaggtggttttattgtttggtgttgggttgttttggaatgtgttttttgttttttttgaaggaagggaagagatgttgatgattttttatgttttatagtgaattgtatttttaggtgtttttttattttttgtgttagtaaggattaatttattttatttgagtttgaaagaggagttgtgattaaaggtgttaatgatgttattgatttttgttgattgattaggagtagaagttttggagaatttggtttttttttataattttaaatttattagtgtttattaggattgttagtttttaatttgtaaaattagaaaaatgaatgatatagataataattgtgtttttttttatttatgattgttttttaagtttattggaattatggttatattttataagtaattttttttttttaaatatattgtaaagaaatggagttttttttataaattgggttaaatattttggaatttgatatataaattgggaaaaatatgtgggtgtgaagatatttatattgtttttaaagtagtttaattatatatagattatatgttagataattttaaaatatatttaagtgttttattaatttggatatttaggagttttttatgtagattttaaaattttttgagttatttttgtggaattatttaatattttttttttgttatttaagaggatgagttatttttgtgtgtatatttatttttaaaaataaaaataaatgtattttatgttaagagatgatagttttataattgggaaagatgtaattggaaaggaaaaaataaaaagtaagagggagagagaaagagtgagatgtttttttttggaattgtttatgattgtaattattggtttatatttatttagagtagggattaattgtaaaagtattgggaaaaattttgttttggaaggtattgtagtttaagaaagaaaagttgaatggaaaatggagaatgtaaattattattaaggttattattattttattggtttgttgttggttttttaggatttttgttttatgtttgtttatggttaattttttttatagtaaatttattttgaggattgttttgagtagaattgataaatgtgtttgtggttaagggtgggtataataaagagaagagatggtgtaaatgaatttttgggaggatatggtgtggtagttatgaatattaggtttagttaatgttgaagattttttttttatagaatattttttgttttagtggtaatgataagaaaaataatttgagatttttatttataattaaaagagaatttttagaaagatttagaataatggtatggttgaaataatggaatttatattaatgtaaatattttttggtaaaatatgaagttaatatataattgaagatttgttttaagtatttaaaaattagaaaatatatgttggtttattttatattaagtttaaatttaattttttttaaaatattaatgtttttaggtttgtttttaaattttggtaagtttgagagtagtagaaaagttttttttttataaatgttgatagtagtttttgtgtaggttaataatgttttataaatagagtttatttagtaaaaattatgtgtatgtttagtgaaataattttatatttatttattttttgatttatagaaaatatgtgttttttgataaagttttttggtttttttttgtaattaaaaagaattatgtttgaaaaaaatagttattgttttaatgggaaatttttttatataaatttaaagtattttttttgattagttttgtataaaattagaatatttttatttatttgtttggtttaaaaaattggatgatttagggaaaaataaaagatatttataaattttttagttgtttgtttatatgtgtatttatatatatatatattagtatatatattggttgaatattggggaatttaaggattaaataggttggtgtagtgttatagtagaaaaattttttttgttgtttgtttttgttagtgattagtgttggtttagtataaggtagtttgttggtttttttagattgaagaggaaatatggttttatatgtatttattgttaggtttttatttggatatatgtaaagtatttttgttttgattttttttaataataatagattgtaaggagagagagagataagataatttgtaaattttttgttatttttttttttttgaaaaaaaaagatatgatttttaaaaagtatgttttatttttgtttattatttttttaaaaagtttagagttgtgagttaggggtagaagagaaaaatttttttttaataaagaagtgataatattagttgggattaggttataaaatattgttgagttattattttagattagatttttggtatttatattgttttgggggtagggaggttggtggtggggagaaagtgagtttttattaaatatagaaattttataatattggggtatattaataatataagtataagttttataggtaaatgttagtataattttgtattttattttaatttggggggggggggggggtttttatttttgaatagaagtgagggattatatgtgtttaaaaataagagtataatttttatagaaatttttttttgtggtgataatgttagtttttaagttttaggaaagtttagtttttatttttgtaaataaatattattgattatagtgataatgatttgaagtttaatatgaaatttaagggaaatgaattatgtttgatagtggggtgtttttattagtaattttaaaatttttgattttgatggagaggtatttgagaatgggtgaatttttttggaattattttatatggtattttatggatatgggtttatgttttttttttttttttttttttttttttttttagatttttaaagagatgtatgatttagtatttgttagaggtttttttttatagggagtatttggagttttaatttttatttggaaaatttaggttaaatgattagaattttttttggaggaatgatgatttgtaagagtaagattgttttaaaaaaaaaaaaaaagagagagaattttttagtgattaggaaatgtggagttgagttttttttatatataatatgatgtgattatatagttgtagtttagttaattttgtagttggttgtatattaagaatttaaaagattttgtttgtatattattttatttgtgaaaatgaaggatttgggttatatgatttaaagagtttttttttttttgatatttttgatatttaagtttttatgataggggttttaatttttataggaattttgtagaatgttaaatgaaaggaaagatgttttataaataaggggagttggagaagaatgagttaatataatttaagtttagaataggaaatttagaattttttttaaattaagttgtgtatattatatgtatgggtttattttgggttaaaagttattgaagattttgtttaggttaaaatgtattattatattgttgagttaaatattattttagagattaggtatggtggtttatatttgtaattttagtattttgggaggttaaggaaggaggattgtttgaggttaggagtttgaggttagtttgggtaatatagtaagattttgtttttataaaaaaattattaaaaaattagttgggtatggtggttgtagtattagttatttgggaggttgaggtgggaagattatttgaattaggagattaaggttgtagtgagttatgattatgttattgtattttagtgtgggtagtagagtgagattttgtttttaaaataaaaattaaaaaaaaaattgtaagtattttgaagggtattttatagataaaagttttaggtataaatttagggagattttgtttaattttggttgaattgttgataattataattagttgttataatagtagttgattttttgaaatttgaaatgtgtgtttttttgatttagatttggtattatttattatttattaggttttttatatttatttttttggaagaagatgtgtgtggtagttagaaggaatattttggatttttgtgtgattaattttttttagattatggtttttttttaaattttttgaatatttttatagagtgttttgtatagttttttgtttggtatttggttttatgtagttatagtttattatggttttatttagagtttttgtaaatttttttgatgttaatttagttgtattaaattttttggagtggaaaaaagaaataaaattaagagtataataaattttgattattagatttttaaatattgaattttttaagtaatttatatttgtaatttatttttttagattggtatttataggtgggagttggggaatgttgttattgaaaagttaggtagtagtgtttagatgtagttgaagtaagggtattaaatttttatagggatatttggagaaggtgttgtattatttaatgaagattagatggtttattatatagaaattattaaaataatttattttagaaagagttttagtaaaaatggagtttaaaggagttttaggaatgtaggatgtttttgattttattgaaggttatatagtttgtttattttagtttgagattttagatttatttatgttattttttgtttttttttgttttaaatgtgtttttatttttatttttatttatttatttattttttgagatggagtttttttttgttgtttaggttggagtgtagtggtgtgattttggtttattgtaatttttgttttttaggtttaagtgatttttttgttttagttttttgagtatttgagattagaggtatgtgttattatgttttgttaatttttgtattttttagtagagatggggttttgttatgttggttaggttggtgttaaatttttgattttgggtgttttatttattttggttttttaaagtgttgtgattataggtgtgagttattgtgtttggttgtgtttttatttttatgaaaggaatatttgtttattgggaaatttagaaaagtataaaagaaaaatatgaagttggtttggaattttattatttggaaaataaaagttaatattttggtatatttttagtttttttttttgtttaggtaattatatgttaggattattttttgtgttatgaattatttttttttaatttggttttaatagttatgaatttatttaattaattttttattattggatatgtatatttttttttaattgtgaataatgatgtgatgaaattttttttaaaaaaattgtgtgttttgattatattttatttaattagttttaagaaatatagtaatttatatttttattagttgtttatgtgagtgtttatttttagaaatatgtattaatattagtgaaatattttaaaagaagataggataggtgaaaattttattttgttttttaaattttttaattgaaatataatatatagattaaaaagttatatagtataagtgagtagtttgatgaatttttttaaaatgaatatattatgtaaatagagtttaggttaagaaagaaatgttttgttgatttatgttattgttgatgggtatttgggtggtatttagggtttggttgttaggaatattggttgttaggtagttgttttttggtggatttgaatatatatttttattgggtataaatttaggagtggaattattgttttttagggtatgtatatattagttttagtagatattgtttaatattttttttaaggggttgtatagatttgttttttatttgtgttaatatttggtattttttgtattttttattgtagtttttttttgggttatgtagtggtatttagttgtggttttatttgtttttgatgattgagggatttaagtatttttttaagatatttattggttgtttggatatttttttttttgaagtgtttgttgaagttttttttttaaaaaattttttagttttttgtgggtagataattgtttattagtttttttattattgatttgaagtgatatttgtattggttattgttttaatatatattttaggttttttttttgtaaaattttattgtatgattaatttgtttatttttttgttgtattatatttttttagatgttatatatagagtatattttatttgataatgtatattattttttattattttttttttttaaatggtttttggtttttatttgatttttttttttagttgaatttgaggaatatttttgtagaattatgttatttattgaatttatatgtatgaagtgaaagtataaaaatatgtatggatataattatttttttaatagtggttaattttggggagagtggaaagggaataagatggagagggtttagttttatttgtattattttattttgttaaagagaagaggttttaagtaaatgtaataaaatattaatatgtattaaatttgtgtggtggatatttagatgttgtttatgttattttttgaaatatgttatgattaaaagtatttttttagaatttattattattattattgttattattattattattattttttagatggggttttgttttgttgtttaggttggggtgtagtagtgttattttggtttattgtaatttttattttttagatttaagtaatttttttgttttagtttattgagtagttgagattataggtatgtattattatgtttggttaatttttgtatttttagtagagatggggttttattatattggttaggttggttttgaatttttgattttagatgatttattagttttagttttttaaagtgttgggattataggtatgagttattgtatttaatttttttagaatttagtttggtgttatattaagttaatttattgggttttattgtaattatattggttgtgggaagtaattttagttgtttttttgtggtatttttataaggttattttttttttaggtgtatattaaagttatataaatgtatatttgttttggtgtttatattttgtatttatttttagaagtgttttaaaaaaatttgttatttataagaaaatatgtaggaaataatagttggtaagatttaataggtgtttgttgtgtttttattttttatattttaatatgttttggaagtaatttagttttatttttgttttatttgttttgaattgaaagttgtaggtatgttgatgagtattttggttaatgtaaatattttttatattggtttaggaaaagtatgattttttagtttttttatagtgggttgtatgtttattaagttatattagttgttttttttgttttttgagagtggtatttgttgtttggtgatttttttttttgaaatttgttagtgttaaggataaggattaggagtgggttgaggttgtttgttatttgtttgttgttgttgggagttatttaatagtggtggaaaaggttaaaggaatattggagtttttatttttgattttaagttattttaattttagggtaattttagttaattaatgatttataggtgttagatttaagataatgttggttgttaaattaaagagagaaggtatgtgtaggatgtggttttagttttgtatatggtatgttgttaggatgtgtatgtatgaggtggatttttataaaaagtattataaatatttttaagaatattatatagtaggttatatatttttttaaagataagaagtgttattgtttgaggtgtaattttagtagttttttaagttttaattttgtatatttgaaagtatatttataatttgttgttgaaagtttttggaagttattgagagatatggtttttgtttattttttaaattttaaattatgtagtgtttggttggttttttgtttgaggagatataaatttattatagttatgttaataagtatagaaaatttgttagtttatagagaaatttgaatttttttttttttttgaaggagagttttggggaagttgtgtatataatagaattttttatgtttagatttggtttaggagaattttgttttataagaattttttttttttttttagtatatttaaatggaattaagtttagaaagaggttggggatagaatttagggaaataaaatatagaaaattttggattatttattttttgaatttttttgtagttataagtgtaaggattatttttattgatgtgtttttatagttaataaatatttattgaggttgtgttaagtgttaggtattttatttgattgtgaggataataaaatgtggggtttgttgttaagatatttataattggataagtaaattagtaaaatttagtatatttattaagtgtaatgtaaataatatttatagagtatgaaggaaagttttatagaagaggtgaggagttaaattttttatatgttaatagtgatggtagggggaagataggagtgggaattgggggttggagaaaggtattgtaagttgagagagtagtagaagtaaatatttaaagtatgagtatttttggtggtttggggaaatggtattaattagggtaggttgtttgttggataggtatggtttggggagaggaggatggaggtagagaatgtgaatggagaggtatatgagttttattggtggaggtttatgaaggtgatgttagatattttgggttttattttttatgtgagtgggaagagtagagtggtgggatattatttgttttaaaaattattttttggttttagtgggaaaaatggtttggagtggggagaatgaatgtgattaggaggtttgggaagagagtaatatatatatattttgagatggagttttattttaggttggagtgtggtggtatgattttggtttattgtaatttttattttttgggtttaagtgatttttttgttttagtattttaagtagttgggattataggtttgtattattatatttagttaatttttgtatttttagtagagatagggttttattatgttggttaggttggttttaaatttttggttttaaatgatttgtttgttttggttttttaaattgttgggattataggtatgagttattatgttaagttttaaattaatattttaaagagatatttgtagtgttatgtttattgtagttttatttataatgggtaagatatagaattaatttatgtttatgggtaaatggagaaagaaaatgtgttatatatatagtggtatattatgtagttattaaaaagaaggtaattttgttatttttgataatatggatgtaattggaggatattatgttaagtgaaataagttaggtatagaaagaaaaatgttatgtgtttttattatatgtgggaggtaaaattgaagtagagagtagaatggtagtaggtaattagaggatggggtatttgggggataggattggggagatgttggttaaaggatataaaattatagttaggtaggaggaataagtttaatagagttattgtatggtatggtaattatagttaatgattttatattgtatttttgaaaaatgttgagagtggatgttaaatgtttttattataaggatgataattatgtgaggtaatgtatattttaattaagtagagttaattgttttataatgtgtgtgtatgtatattttaaatattatgtttaaataaatatatataattttttttgttaatttaaaataaataagtaaataaataaataaataaaataatttgtaggagggaggaaattagagtttttttgtatttgttttttaagattggggtgggaatgtttatgttttttatggttagttttttttttttttagtttttagtatgagattgtgaaggttgatatgaatagaagaattgggtttaggaatggtgaatattttgaattgtttttgtgaggaatgggaaaagatgttgagtgtataagagtgggatttatagttatgttgggggttttttgaggttggtgtggtggttttatgatgatgttagtgggatttttgtttatttattgtagtttttaatagagtggagaaaataggaggttgttttaagttaaggatggtagtttgggggtttggaggatattggtaaaagatgatgtatttatttggttgtttttagtttattagtttggtgatgtgtatgtttgtgagggtatttagttatttatttgtgtaagatggtatttatgaatatagtttttgtggatatgaaatttataattttgtttttgtttttagtgatgttatttgattattgatataaaatgaatataattgatattgattattgttttgatattaattattagttttagtggaattgttgttttatatgtttttagaattaggaagtatgtttagtgagtttgtgtagtatattgatttgttttgtgtgtgtgtgagtgtgtgtgtgtgtgtgtgtgtgtgtgtgtgtgtgtgagagagagagagagagagagagagagatagattttatgaattttaggtgaggttagatttttggagagaatatagattaaagaggggttaatgtttttatttttggaattttattataatttttatttattattagttttaagtattaaatgtttttaaaaaaatgtatttatgagttatatgaagatgatggattaataatggattgtatatatgatagttgttttataagattataatattgtattttttttttttttttttttgagatggagttttgttttgtttttaggttggagtgtagtggtgtgattttggtttattgtgatttttgttttttgggtttaagtgatttttttgttttagttttttgagtagttgggattataggtgtatgttattatgtttagttaatttttgtatttttagtagagatagggttttattatgttggttaagatggttttgattttttgattttgtgatttgtttgttttggttttttaaagtgttaggattataggtgtgagttatggtgtttggttaatatggtatttttattgtattttttttatgtttaattatgtttagatatataaatattattgtgttatagttgtttatagtatttagtatagtaatatgttatgtaggtttgtattttgggagtaataggttatgttatatagtttaggtatgtagtaggttttattatttgggtttatgtaaatgtattttataatgtttttataataaaattgtttaatgatatattttttagaatgtgtttttatttttgtatgatagtatagttttaaagtgatttttggtttttttgtgttagtgtgtttgtttatgtgtatgtgagggttattttatattatgatttgtggttatttattagttttgggttttggaataaagtatttaatttgttttttagttgtggtagtaatagtttttatttgatggattgattttgttaattgtttagtagttttggatatttattataggagtttttttttatttaaggtttttatttttgaggttttagttatttatggttaattatggtttaaaaataagtaagtgtagtataagaaaatatttttagaaagagatagagagagagagagatatattatatttatataatttattatagtatattgttgtaattattttattttattattagttattgttgttaattttttattgtgtttaattgatagattaaatggtattgtaagtatatatttataagaaaaaatttagtgtatataggatttaggattatttgtggttttaggtatttattgaaatgtatttgtggaggataaggggggattattgtattgaattttaatattatttaaaattaaattgtatataattttattgtttaagttttagagtgtgtttattaggtagtattttgtttttttagaaatggtttttatgtattttagtttgttttgtgtttttgtataggtttaggtttaattaatttatatataaatgtttattttttttttttgaaaagttttgattaaaggagagttttttgttttatgatttgtttatagtgtttaagaagttgtgagggagttaggataagatttgaagtttgatttttttttttataataggaattgttagattagtttgtttaaaatgagaagtatttgtttagatataagaaaattgtttttgttggttttatttttaaaatgatataatttattatttttttttgtgtggggtaaaaatttgtttttttattattttaatattgtttgatttttttttgtttggtgttttttaaaggtattttaaaatagtggatatgggaggtagtggagtgttttttggttttttgtatttatatgagttagtgttaattttttttttgtaagtatttataaatatttgaaggataaggttttaaagttttttttttttattttttttattttttttttgtttgagttggttttgaatgtttattgtttgtttatttgggtttggatatatggtttttttggaaaggataaagtgggttgtttggtatggtggatatattatagagtaaattatttttgttaatgggatagattgaattaggaaattaggttttatagttgtttgattttttgtgatttttatgatggaaggtgatattttaggtatttttttttatttgttgttaagttttatttttgttattttttgttgaaaatgatttgagtagtaattgtttggttttaggtataggtttttttttgagatagagttttgttgttgttgtttaggttggaatgtagtggtatgattttagtttattgtaatttttgttttttggatttaagtaatttttttgttttagtttttttagtagttgggattgtaggtgtttattattatgtttggttaatttttgtatttttagtagagatggggttttattatgtaggttaggttggttttgaatttttgattttatgtgatttgtttgttttgattttgtaaagtgttgggattataggtgtgagttattatatttggttaggtataggtttttatatttatttttattaaatattttttttttggttttagtttattattataggataaatttgataggatatggtttttgtttttaaagagtttattatgttgtttagttattaggttaaggtgaaaggagaggatatatgtgtgtttatatatatatatgtatatatatatagttttttgtttattttttatttttgtatgataattattgtatataaaaatttattgtaaaaatgaaagtagttgaggtagagttgtttgttttagttgggattgtaatttgtttggtgagataggggaattggaaggggagttttgtttgtgtgtttgtattttggttttttgtttgtgtgtattgaggtaaattagagttttaatgggtttttaatgtgttttttgtaaatttattagaaatagatattttgtttgatgtttgttatttattttgtatattaatgtttgtggattaataatggaaaatttttatttgttttaaagtaggttagaggtttgaaaattatttttagaaattttagaaatgttagtaatttagttttgtggtgagtagttaaaattatatttaatatttggatttagttttgtgtgtttttaaagttttgttgttttttgtatgtttaattggtatttttataattttgtttttagtatttttagtgtattttttttttgttttttgttgttaattgattgttttatagatgttatttgttatttattattataataaattttggggaaaaaatgttttgttattttagttggtagtgaaattgttttaagttttttttttttagttaaaaaaaaaaaaaagaaatttttttttagagtttgagtattttaagttatgtgtttttgatattattaattatgttttatttggttgtttttaaagtgttattatttaatattttttttttgtaagagagttaatttgtgtgtgttgtttgtgtgtttgtgtgtgtgtgtgtatgtgtgtgtgtgtatatgtattttaaggaggtattaaagttgtgttttagagggaagtattgatttttaaaaattttagatattatattaattttttaagggaagttttatagttttgatatttttaggaaggttatagttatttgtttagaaggttttgattttaggttttgttaaattatttttagatgaggtagagggtgtttggaaaataaatagaatttgttttggtttgtgagtatagttatgtagtttttttatatttttggagtttagtatttttaggattggttttgtaatggagattttaggatggttttttaggtaagtagtggagttgggaaagtttattttatggtgagtgtttttttgtttgtgtttttggattttttttattttttagttttagatatttgattgtttttttgaagttttgaatttgttttggtttagggttttttgttatatttttttttattttttttttaaggaattaattatttaatgtagttattttattttttgtatatttgtgtgtttattttttgtttttgtgtagaatgtaagaattatgagtttgttttgtgttttttatatagtgttttagtgtttggaataggggttgttatagtgtaggggtttaataaatatttgtggaatgaatgagtaggtataaaaatgattttaagttatatttggaagaatttaggataatttttattttttttagggaataaaatgttttagtttagttttgggttaagatgtgtttgtagagtagatgtttgggttatttatttggggtggttatatttatatgtatttgaattatgattttttgttttttgtttttagtttgatttattatttttgattggttttttttaaatatattaatgtgggttttttgaaggttatgtagagtgagagttttgtgttaatgtggattgaatttttagggatttgtatagttgttgtgatgtttagattattgttttagttttaatgtatgagtaggtgttgatttttttgtttggggtagttaagtttgatattgtttttaggtttgtgagtagtgaattgtattttttgttgattggaatatagtaaagtggtgaattttaggtgataaaggtttttatttttttttgtattgagtaagggttttgtgttttagtagtatgatattttatttggtttttaagttatgtaatgaagaggaatttagagtgtgtttgaatatatggttttaaggttatttagtggttaattttttttgttttttaagagtaagttgttttaattgtgattgtgttagttagaggattaaaataagaagaggatgtttaagttaatatttttgtatttttttagaaagggattatagtgttagaattttgtaatttttgttggggtattttggtatttataaggtgaggtttattggttggtattggtgtattaaataaagtttaaaaatggagtgatttttatgttattatttttagttgtatagattttggatagttgttgataggttgtgaagatttgatttttttagggattttgggaaaagttgattaaatttgatgatgttaagagggatatatatagtagagaaaagtagttagtaatgggggttttgtagatagttagatttggatgtgagtttaggttttgttttaagtattaggggttaggaaggtttaagttagggttatattgtaggttttagtttttttatttgtaaaatttagaggataaaattttttgaagggttgttattaggagtaatagaaatgaagtatatgatgtatatatgatattgttgattttttgtttatgttttttttgttgagaaatattatttgatggtttttttattattttgttttataagtaaatatgttgttaattaatatttagatatatttttttttttttttttattttttttgttttttttttttttttttttttttttttttgattagaaaggtttagtattttttaatattttaagtgagatatgaaatggttttgaagatgattttttgttaagtgtattaatagagattttagaggaaatttggaatttttatgttagaagtagtgttgtttttattaggtttataaggtggaattaagataaatttatagtgtgaattttaagtaataaaggtggtgatttttttaaaaatttatataaatttaatttttaatgttttaaaaggggatgttgaaggatgtttttgtgtaatatattttttggtgttttatttatatgtagatttttaaaagattttttttgggaggtatattttttgtaatgtaatgttaattaggatgtttttgtaggtagagaaaatatttagttttttgtaaagttggttttttttatttatattttttgtagtttttatttaatattggtgagaattaatagttgaaatttaaagagttgattgatattttttagtttagataatttaattatgtttttttattattttttgttaaaagagatttatgatgtatttgtattgagaggtaggtttttttaaaagatattttttattttgtaggattatgaaaatgtttttaattatgagtaaatgaagagagttagtattgttttttgaagaattttggggatttattttatttatttatgtattgttggatattagtgaggataggggaggttgtttttgtttttttttttattaatttttgtgtttaatgttgtttattttattggatatattttatttgtataatttggtaataaagttatgtatgaaaaatgattaaaaaaggaattatatttaattgtagtattttagttagagttaagatatatagaaattgatatattgtgtttgtttatttggtttttttattttgttagaggaagatagtaaattagatttattgaatatttatttatttgtttatttatttattaatttatgtatttagtaggtattttttatgtatgttttatgtgttaatattgtgttaagtattgagggagtgaattaaataaataatttttgtttttagggaatagatggtttggtggtgaagtttgattattaaataagttatattaataaattgtgatgattgttgtaatagagtaatattgtagggatatgagaggatttagtgggggtattggtattattgggaatagagttgggtatttggggatattttttggaagaagaggtatgtaagttgaaatttatgaaagaattagaaaaagtattgtaaaaatagatgtgaggaggtaggtataaagggaggttatgttttagataaatggggttgttgggtagattttttagaggtaaaagggaattttgtatattaagtaattgaaattattttattgggattggggaatggaagtgggaggtggtatgttttgatgaagttggttaaatagagtttagtttatgaatgtttaagaagttttgttttattttatttttaaggtagatatgatagtgtttaaggatgggagataggtttgtattggtgttatatgatttaagttatagtgtatgtaataggttagtggggtaatatagaagataggagattattaggaggttattttattaatttaagtgtagattggtgatggtttagattttattggtggtagtgggggtgagataagttgatgtattagaggttaggtatagtggtttatgtttgtaattttagtgttttgggaggttgaggtgggtagattatttgaggttaggagtttgagaatattttgattaatatggtgaaattttgtttttattaaaaataaaaaaattagttagatttggtggtgggtgtttgtaattttagttatttgggaggttgaggtaggagaattgtttgaatttgggagatagaggttgtagtgagttgagattatgttattgtattttagtttgggtgataggtgatagagtgaaattttgattttaaaaaaaaaaaaaaaaagagatagagagagaagttgatgtattagagatatgttagtttaaaattgatagggtttagtaggattttggggatggaggaaggagagttaaagatgttatttggttttttagttagggttttatgggtagatggaatgttgtttgttaagatagatgggagtagagtagatttagagataatgatgattttaaatttgttaggttaagttggagggtatttaagtggttggatataaagtttagaaatttagaaaagagatttgagttggaattgttgatgttaattgggaaaggatgaagtttaagaagtagagttagaaaagttggatgtaggtttgaattttttgggataataatgttgaaagtagatagagtaaaaagtgttgttttttgggagtttggttaattgagaatatggtgattttttttagattatatatattaaagtttggttttgtttttttttaatgtaaatattgatgagtttgttttattaattaattattttttaagtttattgtttttattttgatgtggtttgtgtatttatgatgaggttgattaatattgggataaatagagttggtgtgagttgaaaggtttttttgtaagtagtttgttgtatgaaatggatatgggttgggaataggggtaaggaattgttttttaggtatttttataatataaaaattgatattattattatgggtaaaaaagtaaaagtgaaagtttataggaaatgtatatattgatttatattatttgttatttttgtttttttggagagggagggagtatgtttttaggggatggaggaggggagttttagtggtatttgttttattttttttaaagttatttgaggtaaatatgggaatatgttaatattttttaaatttgagttgtaggtaatgtggataattagtatgttttttttagtatttttttgtatgttggaatattttgtaattaagagttattttttaaagaaataaaaataagatgggatggggtttgtgttgattgtttgtttgatttatatttaggaaattatgagaaaattataggtaatattgagttaaaaaggagttgtatttagaaattaggttttgggtggatgtgggtgtttagatagttttttattaaagttataaaatataaaaatttttgttttttgttgggtatgggagaaaatgttttatttgagaataaattaattttatgtggagatttttaatttttttttattttttgttattaatagaatttttgagtaatttgagttaggattttttttttttttggaattttagattaaaggtgtgtttttttgagtttaggtagagtgtgtttttggaggttaggtttttataggtaggaggaaagggagagtagttttttgggtggaggagatagaagtttttttgagggatttttttaaattttttttgaatgggtttattgtttataagaatagttttttaatggaaaaataaaaaggtaagagggtttgtaatgtgtttttggtttttttttgtttagttttattgtttatttgatttattaagttttaagtagttgtgtttttttgtgattttttttgagttgtttttttagagtatttatttattttatttagaaatataatatttaaaaattttggagttgagttaaaaaattgttatttttttgatgtggttgtttttttttttttttgaaattttaaatttgttggggttattaaagttttggattgtagttttttaattattaagtttttttgggtgttgggtttttggggtttgtggtttgtgtaaggttggagataggttggttttaggttttgttggtttttgttgtttgtttgtatgtaattagaggataagatgttagataatttggtgttaagtggtagagaagggattgttaaaggtatgaatttaaggtggtgttttaagggggtggttttgaagtggattttaaggtatgtttaagtagagattaggaggttttttttttttgttttaatatagttgtagaatgatttttgaattttgattttttagattaaatatttttaatagaagaaagaatgttgtaaaattagagtttgttttttatatttattattttttttttagtgtttttatttttttttggtttttttttgttttgttagattttttatgataaggatttgttaaagaaagtttgaaggttaaagagtagatgttaaatataattttattattttaatatatgagttgttttaaattttagtatttttttttttgtttttatttatattttgttttaggttttgttggtttttatgtattttattttttttaaaattaaggagttattaaaggtgtaggtagaattttgttaggaagttgatggttaggaagagatgttgtatggatttaagtgtggagattttagtgattagtattttagaggatatttttgtatttatgattgtaattttttggttggttatttatatttttattagatgaattttagagttattttattaaattttgttttattttaagtaaaatatagtattaataaaaataaatgttatttttatagattgtgattggaattgtgttaaatttattattttttaaggggattgatatttttataaggtataatttttttattgtgaaatatgatatgtttttgtttaaataggattttttttttttgtgattgtagaagtttaaatttttttatgtttttgtatgggttgtatgttttttttggttattgtttggtttatttttggtagtttagtttgtatgattttttggtttaattgggagtagtatggtaaaatggatttttatgaggattttgtatttatattgttagaatttattattggttttgttgtggttattagtgagattttgggtaggatatttaatttttttaagttttggtttttttatttttaaaaggtggatagtaatggtatttattttatagggttattgtgaaaagtaagtgagttaatatgttaagggtttaatattgtttttggtagttagtatgtgtttaaaaaatattatatatatatatatatattttttgaaatggagttttgtttttgttgtttaggttggagtgtagtggtgtgattttggtattgtaatgtttgttttttgagtttaagtgatttttttgttttagtgttttgagtagttgggattataggtatgtattaatatgtttagttaattttgtatttttagtagagatggggtttttttatgttggttaggttggttttgaatttttaattttaggttatttgtttgttttttaaaggatgaattaatgaatttaatggattaatggatttattgaatgaatttttgtttgggattataggtgagagttattatggttggttattattatttatttttattgattggtaattgttggtgaatagaaaagttatggatttttgtatgtttatttttaattttatggttatattaaatgttttatttgttttattgtttttttgttatattttttgtgttttttagattagtttataatattatttgttaataataatatttttattttttttttagttgttgtatagtgtatttttgttttatgtaatattgaattggttttaattttttggataatagtgattaataatgattataattattttggttgttattttaatattattttttttattaggttaaggaaatgtttttttagtttgggttttatttttttttttaaaaaaagtattaaattttattaattattttttattattttttgtttttatgatatataattttttttttttgatttattgatgatttttgtatgtttttttataatatttttaattatgttttttggtataaggtttatttgattttagattttggtataatttgatatgttagtattgtatttagtattttagtatttttgttgtgtgtttatatatagttttgatttttagttttttttttttgtttttataatattagatttggtattgagattgtatttgtttttaaaatgtattgtaattttttttatatgttttaatttagaaaagtttttataatatgaaattatttgttttttgagtgtttgaataaatttatatataatgttattagggtttgagtttggagtttttattggaaataattttgaagagttattttagttttttttattgttattgagttttttatatgtttttaagttaattttggttatttatatttaattaggattttaaaatttaattgtatagaattttgaaatatatttttttaaaaagtaaataatttttttttgtttatgtttatattttatttttagtttgtgtttgtattgtttgtttttttaattttgggtggatttgtttgtggtgttttagtttgttgtgttttttattttttaaatagtttgttttgggatatatttataaattttaatggtttttattttttttagattataatttatttttgttattgttgttatttttattttttattttttttaatttgtaaaaatgattttatatattgtttttttttttttgatagtaagatgatatttatgttgttgattttgttattgtataaaatgattgttggtaatattatttgtaaatgttaatatttttaaatattttttttatgtaattgtaaaatatagttttttgtgtgtgtgtgtgtgtgtgtgtgtgtgtgtgtgtgtgtgtgtgtgttgagtttatgtatatatatatgtgttgtttgggtatgaatgtttattataggatatatttgaatttattttggtataatattagatgatgatagattttgaaaatattttaagagtaattgatttagatttgttttttataatttaagaaaggaaatgatttattttgttgttaataattagtagagaggaagagagatttttgttatttttgttaatttattttagtattttgttaagttttggtaagaatatttttatttttgtgttattaggttttatttgttgtgttttgagtttgtttttttttttttattttttaaagttattagagtataaagtgggtgtttttagtaattttttatatgtttgaagatatatgttagagtatttgaattttttatattttattttttttattgatagttttattttgattttggttgattatagttttttttgattagtttttaaaaatggagaataaaagattttttgtttttataagggtatgattagtatttaatataggaaggagttttgaaatgttaattattgatgaagttatttattttagtggtttaatatttgtttttattttgtttttaaatagggtgattttttataattatttttttgttgtgtgaatgtgtttaggatttttgtatgttgtatgtttttttttgattgatgattgttttaagtttgtttttttttaaatattttattgattggttggattatagtttattttattagttttttattgttgtttatttaaggtattttttttaaaaaatagattattttttagagtggtattgggtttatagtaaaattgtgtggaagatatagatattttttatatgtttttttgtttttatatagttataattttttttattgttaatattttttattagagaggtatattggttataattggtgaattaatatggatattgtattattatttaaagtttatagattattttaggggatatttttggtgttgtttatttattttgtgggtttggataaatggatagtgatgtgtatttgttattatagtattatatagagtagttttattgtttttaaaattttttgtgttttattagtttttttttttttttatttatttatttttattatttttagtaaatagtgatttttatagttttgtgttttttagagtgttatatatttggaattatatagtatatagattttttatattgtttttttttatttagtgatataagttttttttatgtttttttatgatttgatagtttattttattttagtattgagtaatattttagtgtttggatgtatttatttattattgattgaaggatattttggttgtttttaagttttggtaattatgaataaagttgttataatttttgtggtgtgtttatgttttatttttttttttattgatataaaagtaggtggtggttatttttgtagttgattttttgtttttatttttgattatttttataaattttttaaagtagaattgttggattaagaaatagttatatgttaagggtttaatatatatttagaagagttaatttaatttattttttattagtggtgtgtgtatttatattattagttgtttttaatataatagatgttaggatagagatttttttatttagttagtttatttaggttgttataataaattattataaattgggtggttttattttttttagttttggaagttagaattttgtaattaaggtgtttgtaggtttatattttttttgatggttttagaaaagtatttttttttgttttttttattttttgggagttattggttatttttgttattgtttggtttgtagatgtattattttagtttttgtttttatttttatatgatgtttttttttttatgtgtattttagtgtttgttggtttattttttttttttttttgagatggagttttattttgttgtttaggttggagtgtagtggtgtgattttggtttattgtaatttttgttttttgggtttgagtgatttttttgttttagttttttgagtagatgggattataggtgtttgttattatgtttagttaatttttgtgtttttagtagagatggggttttattatgttagttaggatggtttggattttttgattttgtgatttattggttttggttttttaaagtgttgggattataggtgtgagttattgtgtttggttttgttggtttttttgtaaggatattattaattggatttagggtttattttaatttagtataattttattttataaattatatttgtaaagatgttgtttttatataaggttgtattttgaggtttttggtggatatgaattttggggaggatattatttaatttagtatgattgtttgatttttatttttttttgttatttagttttaaaaaataatgaaaattttattagaaaattaataatattaagtagtagttataggaatgatgataaatgaatttttattttttttttttatgttgttattatttttagtgataaatttgataaatttatttttgatttttttttttttgttaatataaatattaaataataatattttagatattaaattttattgtaatatttttaaaagaaaatgtatttggggtttatttagatatggggtgaatagtgttttaaaataattttattgttaatatttttttttatgttttttttttttttttgagatagggttttattttgttatttagatttgagtgtagtggtatgattggggtttattgtagttttaattttttaggtttaagtgatttttttattttaattttttaagtagttgggattataggtttgtgttaatgtatttagttaattaattttttttttttttgagataggtttttattatatagtttagtttggttttaattttttgagtttaagtaatttttttgttttagttttttaatgtgttgggattataggtatagttatagtatttagttattatgattatttttaatgttattttgttaggtttattttagatggttttaaaatatttaaaagtttattttagttattattttatttaattttaaaatgtagatattatgaaaatgagatgtggtggtttataaaagttgatttggtgtagaattagaagtttgtttgaattaattgaaaatttaggtatttagatttaggatatattatttttaaagatgatgtttgtttaggtttatttaggtaattggatttgttgtaaatgttgtgggttttttagtgattaaggtttgaaagattttgaattttgtgttttatagtgtagttgtattgatggttaggggtgttgtttttaggtagggtagttgttattttgttgttgttgtttttgggtgtttatgtgattttttaggtgttttatttgtgtttttttgtgagtatatgattttgttttgagatttttaaaaggttttttaaatatttttttttttgtaaaattaagaatgttattattttttttgtgagttttttatgggtatttgttatatgttaggtatggtgttggttattaggggtgttaattaaggtggagagggtggattttaaggaattttaattagggtgaaatgtagtatttaaatatttagttataatattatgttaagaatattatggttgagagattttgaaagtgttttggggagttggaaggaggaatatgaaattatttgattggaggagggttgttagggaaagttgttgagaggagttgagattttattgttttttgttttagatattagtttttgtagtataagtttatggtaagtttgttatttggtttttatatgttgagttatgttttaaggttgtgttttatatttgggattgttgatgatatggtttggtttatgtgattatttgtataatgtatggtgatagtgaggttaagtttttagttgttggtttaaataggtttagtgtgtgttaagagttgttgaaatggttgttttggtttaaagagggagtttagtatatgttttatgattttagggataggttgaggttttaagttttgagaggttggtgtttgtataaatggttaatttaggaaagtgagtatatattattgttgttagggtgtgtgtgtgtgtgttttttagattataattttttatttttgatattaatagtattagttgtaggttggagagatttattggttgtttaagaagataatgtatatatattttgtagtagtatatttgtggtgtataggagtgtataagggaagttgtagtatatttgggtagttttaaaatgttatgaataaagtatttggatatttgtattttttgagagttgtaagatagaagttagagtttatttgtagtatttgagaattgtttaagaaatggttttgagtattttgttataattataggaaaaatgtggtttgaagagtgtgtggattatattattatttgaaagtattttagtatgttttgtgaattttttttgaatggatgtaggaaaaagatgtgggagagtatgagtgggtgatagggaataagaaagtagtttggagaaggaagtggttttttaggtggtttttggatttttttttatgagttgggagaaaatatatggttaaattatagtggatttgaatatgtgtggattttgatggatttaggaaatatgttttgaaatttttatagtagggtgaattaagagttttgggtgttagttttgtaaaagtagttagtttaggtagaggaggggatttagtagtataggataggaagatattaaattgtgtagatttttttagtttgtttgtttgtatgtttaggtgggatgggagttagtgtttattttaataggtattatgtgtgttgtaggttgtattttttaggaggtagattttgagatagagttttgtgtgtaggatgtttattagggaatgtttttaagataggtatttggggaagagaggggaggagtaggaaggagtatagggagatgttaggatgtaatgaaggtgttatgttagttttagttgattttataggggtttagtggggagtaagagttgttttaagttgtattgagatggttgggtttttatatttttatataaattagttattgatttaataatttttgggggtgagggttgttttaggaatgagtgtttttttgtttaaagtagttttttgtggtataggtaatttttgtatgggttgagtgttaaagggtgtttgtgtttttgggttgggtattatgatgttattataatatatattatatggttttatttatttatttattaaaataatttatatttattgtgttttttttaaaattagttattgttttaggttttgaagggagtgttgaaggaaatagatatggtgtttttttattgtaggaagagtaggtttgttttttagttaggagatagttggtaaataaggtagtgaatatgaaggtattaggtggaatgggtgttttgatgattataaatgggttgatgagatagttggtgattgagggattttgagatatttgaaggtgtagttatagggagatttgtggtaggggttttgtaggttagggaatggtagtgtagagttttggggtagatttaggtatggtgtgttttataatagaaatagagattggttagagtagagatgaggggaaggagatgaggttgaggtaggaattttagttttattttaagtatgatgggaggtagagtagaggggagtgttttagagagggtattttttagagagtgtttagtatgtgtttattttattttgagtgttttgtatgagtgatgtatttaatttttggtaattttattaagtggttattgttattatttttttttattttatagaagagggaattgaggtagagatatgtttaaggtttatggttagtgttggagttggggatttaatttgaggaggttaggtttatatttttggtttttgatttttatgttgtggttattgttttgaaaaggtggtttggttaatatgtggggtaggaggagagttaggaggttatttaggaggttattgtagtttggttgagtttgggtgagagggggtgatggtttagttttgaagagggagggaagtggatggatttagtttatgttgtggagagaggaatttaagatgatttattgttttttgatttgagtaaatataaaatataaatatagatataatataggatattttatttgttttttatttgatggtggtgtagggattgggaagtttttaggttgttataggttttttagtgatttggaaagaaaattaaatttattttttgtaaggggtatggatttttgattaggaatttttttttatttgttgtttttagaaattgtttattttttaaagtttgattgttttgggtttttgttatggttttggttggggtaagataaggtaatgatgaggtgttttaggtttttttttgatttgttttttatttaaataatagtttggtatatgaaagtttattagtatttagtttgttgttatttgtttttgtgttgtttgtttgtatttggtgaaaagtaaatatggaggttggtattattaatatgatagtgtttatattttgaaaggatgagaatgttaatattaatagtgatttttttttaattttttgagatagagttttattttgttatttaggttggagtgttatggtgtaattttggtttattgtaatttttgttttttgggtttaagtgatttttatgttttagttttttgagtagttgggattataggtgtgtgttattatgttaggtttatttttttgttatttttagtagagatggggttttattatgttgattagattggttttgaatttttggttttaagtgatttgtttatttaggttttttagagtattgggattatagatgtgaattattatgtttagttaatttttttgtgtatttttagtagagatagggttttgttatgttggttaggttatttttgaatttttggttttaaatgatttgtgtattttgtttattttggttttttaaagtgttgggattataggtatgagttattatgtttggttaaaagtaatttgtttgggatttttgtttgttaaaaaaatttttttgtgtgtgtgtgtgtgtgtgtgtgtgtgtatttatatgtgtgtatatatatatatatatatgtgtatatatatatatatatatatatatatatatatatatatatatatatatatatatgtatataaaaatgtgtttttttaatattatgtgaggttttgttttttattgaatattggaaagttggtaataagtttagttggttagaagtgaaatgtgaggttttttggtgaaaaagtttaaggagaaattttggttttttgggtaaagagtatgtgtttatagggattattattattatttttttaattttaaagtaaggatataaagtagggtttttggtattatttggagaatttagatagaaaagaagaaaggaaaagtagtatttgtttatatttttatttttatttttttttttaaagttgttttgtgtaatatggtagttatttattgtatttgattatttatatttaaatttatgtaaattaaaatggaataaaattaaatatttagttttagttatattggttgtatttgaagtgtttattggttatgggtttattggttgttttgttaaatggagtatttgtggaatatgttattaatatagaaagtgttattggatagtgttgtttatagttttagaatttaagagatttttggatttttggaggtttgttgtaaattgtagggttttaggaatttaggagagaaagagtttttatagataaatttatagatgattttaaatatgaaataataatagtaataaagttagtttatttataaggattattttgaagttttgtaatttgaagatggaagttttattttattggtttaggtaattagtttttggaaagtttggtatatggatgatttttttagttagttagtgtttgatgttatttattaagatgtatgagattttgtttttttgtgtgagtattttaatttaggttattatttttttgtaaaatgggtatagttattttaggggaatgtagtgtggggtaatggaatgtttttattatattttgaaattatagttgaatggtatttatagagttatattaaaaattatatgaattggttttggaagtttttgtttttgtttttgttgtttttttgtttgttgttgagatggggttttgttttggtatttaggttagaatgtaaagttgtgattatggtttattttagttttgattttttgggtttaggtagtttttttatttaagttttttatgtagttgggattataggtatgtgttattatattggttaatttttttttggatttttttatagagatagggttttattatgttgtttaagttggttttgaatttttgggtttaagatatttatttattttatttttttaaagtgttaggattataggggtgagttattgtgtttagtttggaaattttgtataggttgaaatttaagttatgttatttattgttgtttgtgatgtatttggattttttatttgttaggtagtaatatttttagtgtaggtgagaagttttgatattttaatataatttttagaaagtttgttttttagattataggagttggtaaattatagttggagggttaaatttagtttgtttgtgtaagtaaagttttattggaatatagttattttatttgtttatgattgtgtgtggttgttttagttttattattgtagagttgtagaattataatagattggtttgtaaaattgaaaatatttatattgtagtttttgataaaaaaagttttgttagtttttagtttagatattgggtgaatgattggaatgtttttttagtaaggaaatatttgtgtaggtttaggtttgttagaggattttagagtagatgtgagatttttttatttttgggttatataatttagtagataatagaaagggtaattatatattatatttttttggatgttaaagatttttttggatgttattttttagtgataattttattttttatttttattaaggaaattttggagttttattttaataggagataatttttattgattttttatttgttagggtttgtgtttattgttttttatagatgagttgtttgaattgtttggttgttgtttaaaggtaatgttgagtgtattttgggttttattttttagttttttttaggttattattttattttttttttgtttgtgttatttgatttgtttttttgttggattgttttattaggatatatatgtttattttttgaaaagaaatagatatttagtgattatgtttattttattagttgttatttttttttggtttttttgtgtgtaagtttttttttatagggttattggagtttgttgtttttatttttagttatttttttttgaatttattttagtttttgttttagttatttgttttataaaagttgttttgtttaggttattgttggttttttggttgtttagattagtggttagtttttagtttttattatgtttgatatgatgataggggttttttttttgttttatttggtatagtttttgtatgatagttgggttttttttgttgttttttgtttttattattgtttgttttttgtaggttattttttgtttttattttttgtatatgggagagtatagagtttagatttgggtttttttttttttttgtatttattttttgggagtttgtagttagttttatgaattgaaatattattgatttgtttataatgtttaaatttatttttttagttttgtttttttttatttaaattttatatttgtgtattagttgtttattagatatttttgtttggatatttgtaagatattttaaatatgatattggtgaaatgagttattttttatttattttaggttgttatattttttttagtttaggtgatggtaaggttatgtttttagttttttaggtttttaatggtggaatattggaattatattttttatttttttatttttttgttttttttttatttttttatatatatatatatttatatttttttgttatatatatattttaagtttagtttgttaggaaattttgtggatttttttttttataaagtattagaatttgttttttgtttattgtttttttaggagttattattagtttttttttggattgtattaatagtttttagtttttttattattatttttgttttattagagtttgttgttaatatagtgagtttttataaatataagttggattatgttatttttttgtttaaaatttatttaagggttttattttttttggagttaatgtttatatagtggttttgggtagtatattttgttttttttgttatttgtttatttatgttttttttttgttttagttgtattagtttgtttttatgttgttaatatagatatatttatgattggataatttataaaagaaagaagtttattggatttttggttttatatggttggggttgttttataattatggtggaaggtgaaaggtatattttatatggtagtagataagaggagagtttgtgtagggaaattttttttttaaaaattattagattttgtgagatttaatattatgagaatggtatgggaaagatttgtttttatgatttaatttttttttattaggttttttttataatatatgggaatttaagatgagatttaggtggagatatagttaaattatattattagttatattgtttattgtttttttttaaatatattaggaatatttttgttttgttgttttggtttttttttttttttttttttttgtgtttgtttttttgatttgtttatgtttgttaagtttgtgtttaaatgtttattttttgtgtgatttatttagattattttgttttgtttgtttgtttgttttttgtttatttttggttgtttggttttattgaatattattttatttttatttttttatagttgtttggtaatttttaataaatattattttttttttttggtaaattttaattttttagtgatggggatgtgtttattttgttgattgttagagtttaagtgtttagattagggtttagttattagtttttagtatatagtaggagtttagtatatgtttgttgaatgagtgaaggggtttgatttagtttagtgtagtttttttttgtagtagtgaaggaatagtttttttttttttttgaaggggggtgatgagttttttggagataagaggtaaggttgtttagttttaatttgtttttttgtaggtggtgggagtgggttatttttttaaagatatatattttagaatggttagtattatggtatttgttgttttggttattgtttgaggagtttttataatgattatggaattaagtgtttgtatttgggtggtttgtagtttgttttattgatatgatggtaagttggggttttagtagaagttgtagggatgatatataattttgttggtattttaggtgatgtatattttgttttgattgttttttttggagttttttgttttaagtagagtagttgagtgtgtggatatttgttgtgtgttgtttttggttgatattttagttgggatatagttgggtttttgggtttagaggtagtatatttattgtattttttagatttttagttgaatagtatttgaagtttttgttagtattgattttttttatgttaagtttggttagtgattgagatttatgaaggtgaagttattttattatttttggtgtattaggatttagttggtttttatatttagtggggttgtgtgaatgtttatggagttgtgagtgatattgtttttagtaaagtttttttagatattatatgttagatattttagtagtatgtgagtttttgttattgttttattggatgagtttgttgaggagatagggtgtatttttgtagaggagtatattgttgtttgtattagttttgttttattaaattttttttttgtttatttttgttggtttatttatgtttttttatattaatttatttttttgtttgtttttagtttttataatttttgaataagttgtttattgatgattttttttttattatatttaggattttgaatatttatatgtttttaagttatagaaatgtagaattggagtttagtgggtaaaggtttaagttttggattagattgatggggtttataaattaatgttgttatatgttaagtgtgttttttttttttttgtattttattttttttatttttaaataggtgataattgtggattttgttttattttttgtttttatatgatttttttagttttagtttttttagtttttaaaaggttaaggttatgaaatttttttttttatttgaagttatagttttttttatgtttttgattattgaatatgtgattttttgttgtttttgttttttttttttattttgtattaggggatattttttaatatttgatgtgagggtttttgaggtttttgttgatatttttttttatttttggttattttttttttattatttttatttatttttattagaatatgggttgtaattaggatatgtaagtttttaagggaaggatggagtgtttttattattggagtgttagtatttagattagttttttttgtaataaagtgggtgtttagtaaataggtgaattagatagggatggataaattaatgaatagagtttttttttagttttgtgagaaggttattttttattttagtttggttttttagtttagtgtatgttttttattgaatagtttggttttttgtttggaaatttgggggttagatttaaaaagtgtttgaggggagagggaagtgattttgtgtttttttttgggttttagtattgtttggttttttaggatttttaggtagggttgtattgaggagggttgggttgtggattttggggattaatattttatttttattgatttttaaaggagagtagtaaaattaggtgaagatttagggaatagtttttttgagggaatgtttattgagttaagttgtggattttgtattttttttaatagtttagggttaaagaagtagattgttttagatttataaaagatgaggaagtagattgttttggtagagtttagattggggttggtaattttgttatttgtgtaagttatgggtttgtgtttttttgggtatttgtttgtatgaatttatgttttgtttttttgattgtagaaggaataggtaggtttttggagagaaagagagagaggaatttgggtggtgttagagaagaaggtttagaaatttgagttgatagatttgtttttatgaaggattttatgtgatttatgggtttttataggatttgttaggatttgtggggaaagttttgtatagaattgtggagggggtattttttgtatttttgtttggaatttagttgttttttggtattttggtggatttttgaggatatttttgggttagtattagtatatggggattaaagtaatggggtatgagtaaatgttaattaaattgaaatagggttttatgataagttggttaggatattagtttttgttttggttattatgtttgatttgtgtgataatttttttttattattttgtttgtgatttggagtttagttgataagtttagatttggtgttagtaggagggtggttttgggttttgtattgtttagagttatgtgtgtgggttgtgggatttaatagatttaggtttaatttttggttttgttgtgtggttttagggaagttttttattttttataagttttggttttatttatttatatttattttataaaatggaaataataagtttatggtgaggatttaaggaaattaaagagataaagggttttgtatagtttgatatttggtagttgttattgttagtgttattatatattatggtatgtaagttggaatttagttatttttatatagagttaatggtttttaatgtttatgttttttatataagtttgtttaaaatttatttttagttgtaaaagttttgtaagagagattattgttattttttttttttttttggagatagagttttattttgttatttaggttggagtgtagtggtataattttagtttattgtaatttttgttttttaggttttagtgatttttgtgttttagttatttagatagttaggattataggtgtgtgttattatgtttggttaatttttgtatttttagttgagatagggttttgttatattggttaggttggttttgaatttttgattttaagtgattagtttattttggttttttaaagtgttgggattataggtatgagttattgtatttagtttttatttttttaaatgaagagattgagttttaaaagggtgaagtttgtttttttagtttatataattggattgagggatggaaggtaagtattttggggggattggtttagtgtattttatttatgttagtattaatggtgaattttaatatttaaaagtatttattattttgttgattatagatatatagatatattaagtattatataggtggtgtgtttttgattagttagttttagggtttttttgggaatttaatggatttaaatagttgtataaggtgtgattgtaaggtaatagatggtatttatagaaattaggtaggaaagataattttattgttttatagatatattttatgttagtatgggggtagaggttttattgagagttgatatttatagaatattttttttgtgtatttttatttaatttttttggtaagtttattgttgtttttatgttttatagatgaggaaatggtgtttggggagtttagtgatttgtttgagttggagttgagtgtagtgatagagttaggttttgaattttggtagttagattttttgtttgtgttgttattttttgtgtggttttggggggtggttgatgaatatagtttattaaaaatgaattgtgatttgatagatgaaagttgaggtttgtgaatatgtgaatgtttttttgtgaattgaaatgtgttttagttgttttttttgtgtgttagggaagagtgattatgaatttttagtttgttgggtaaagggttgatttatgaggatttgtttaattttaattagttggttaataatatggagtttttaatgtttttaggggaggaaatgaataaataggtatttgggatgaagtttattgagtttgtgggattggttgaaaggtgaatttagttggaagaagttttgatatataatgtagatattttttgatttagttttgaattagagtttttagtaaataaagttaggaaattagaatttttgggttaattttatattttataagtaatgttaaaagaaatatttattttgtgggaaggttatttggtttaggtggaataagttagatggaaaagtaaaattagttatttagatgatgggtgttttttattgattttaaatttagtaaaattgttattagaaatttttaattataatatttatgttttatttagtattttaattataaatggtttgtatatatttgagagttttttattttatggaatatttgaaattatgttgtatttaatttaattttttttagaaaattaaatattattagttatttgttttttatttgttttttggttttttggaaaaatataaaattaggatattttggtagaattaatatagtaggttaaaatttttgtaattttttagtgattttttagaaataaaagttatgtggtagtggttaagtttgtgtttagtataaaatgattaaaagtgtaaattggtaaggggttgatatagattagttttgtttttgtttttgagtttttttagtgtgtattttgtttttttattttttttgggtaatttttttgttgtagggaatatggattttttttgagagttagtggttgtgttagagttgattatgtttttaaagagttttttgagtttttttttgttttgggggaatgagaggttttgaaagttttttgtgtttgtgaaaggagtttggtttagaaggtttttattagattttggtaggattatttaggttatatataaaaaaagggaaagaggataggaaaatataggaaaaaaatgattggagaatattataatatttatttgtttttaaattagaataaatgggtagttttttataaaagttaaaatagatagtatttttgttatttggatttgtgtaggatatttatttatttatgttgttagttttattgtaaagattgaataagttatattaatgtaattttaaaaaaatagggttagattgggttttagaaataagtaatttaaagttgtttgggatatgaggggatatgaagagagagaaaagatttttgtttttgtgttaggtattttaattgatttttttagaatattttttgtttgttgtgtttgttaatgatggtttggttaatgtagtttagtgtttgtggaggttgtatttttttaagttagttaggtattaagtattttattagtatttatggtatatttatttgtgggagaatgtaatataaaaatatatttgttgttgtgataatttgatttgtagggaagagtaaggtttatagtgtgtttagtgggttattttgtagagggtaggtattattgggtaagggtattggattttttgtttatttgtttgtggttttttttttttttttttgattgttgttttttagggatggggtttgggttattttattttaagtttgtttttataattgtaaaatgtggaataatttttataatttgtaaggttgttgtgagagtgatattaggtagaaggtgaatggttttttgagagttataaatggtttgtgttttgttaaatagaaggtgataatagttaagtaatgaaatgtgttaattttatttatggaaaatttttagttttattgttgaaaatttattttttttttttaggtaattatttggaggtttaggttagaggttggattaggaggattggatgtatttgtgttgtttatttttgttgttgtataaatgatttagttatagatttttttggatgggttattttgaaagggggaagttttaaagaatgtgtataaatttatatatttatttaggtgtgggatgattgtaagattattttatttatttaatttatttatattttttagtgtaaaaaagtttatttttttttattttattatttaattttgttttttgatagaaatgttagttatgtaaatttttttttattatagaggtagtgagttaagatatgtggattttttttttttgtttgaaatttatggttgagattttatgggtgagagtagaatgtgtatgaattttgtaggtatttttattttttgttttttggagtagttaatattgttttatgtttttaagtgaaaattttaagatttttttttaaaattttttttatgaagagaattatgaaggagataatgggtttatgtatagaagaagtaaattaaaaagaatttttaatttttatgttattatgtttaagtaatgtgaatatatttaggagtagagaaaagattagaaggaaatatatttttttgtttaaaatttatagttgagattttatgtatgagagtagaatgtgtatgagttttatagatatttttatttttgttttttggagttgtaaatattgttttatttttagaggtaatgtgaaggtatattttgtttaattttgttgggaaattttgtttttaaatattattaaaatttttaagaaaaatagataaaaatagattatggtatagttttgggttttttttttattgttatttgtatttttaatttttattatggattataaatgttagagggttgtttgtagtgatagaaggaattttttaaggatttagtgatttagttttgatttatatttggaagaaagttttaagaattgtataaatttgagtaagttgagaagttgtaagttttagggtttttgattattagatgtttattttttttttttttgtattttttgtgttttgtagtatttgattatggtttttaataataaaagtaataattattgtggaaagtttgaaaaatattgaagaatatagtaaaataaaataaatattagttttattttattatttatgtgtggatgataattgttaatattttagtatatttttttttagttttttttttatttgtggatgtatttatattgtttaaatatagtgatgtgggagttggaaattttttttaatttgttttttttgtatttaggtttattatttttttagttttttttataggaaaagttttttaaaaaattttgaagtttttatttgggaagaagtgttaaaatgttttgttaaatgtttattttgtgaagtttgtgatagtggatttgtatgatagaaaaggttatgaaattatattttatatagatttttgaataattttgaaaatttttgtaattaagtttagttttgaatttaatatttattagaagttaaggtgagatgtaagatagtgaattgataatatagtttttagagttgtatagagttagaagagttggaaagtgaggtgagtggggaatggaggatattgtataattgttatagaattttataattttatatagaatgattaataaataattgtgtgttgagttaattagattgttgttgtagggagaagttataaaaagtttataggttatattttgtttgaggaattagggttaaattgggtatgagtttatagaatgtttaatattttttttttatttttataggggatttaggaaagaaaaaaataatttttaagtaaatatttgattgtggtaattgtggtgagagtgttggtattttttttatttattattaatttgtattttagaaagattaggtatttttttaaaaagttagtaaggttagatgtggtggtttatatttgtaattttagtattttaggaggttaaggtgggtggattatgaggttaggaggttgagattattttggttaatatggtgaaattttgtttttattataaatataaaaaattggttgggtgtggtggtaggtatttgtagttttagttatttgggaggttgaggtaggagaatggtttgaatttaggaggtggagtttgtagtgagtggagattgtgttattgtattttaatttgggtgatagagtgagatattgttttaaaaaaaaaaaaaaaaaaaaaaagattagtaagttttttgtaagaattgtaatatttaagtttgaaatagttttgataaaaatatatttatttttatattgagaagtttttaaatatatatatatgtgtgtgtatatatatatatatatatataattttttttttttttgaaatatagttttgttttgttgtttaggttggagtgtagtgttgtaattttagtttattgtaatttttgttttttgggtttaattgatttttgtgttttagttttttgagtagttgggattataggtatgttttagtatgtttagttaatttttttgtatttttagtagaggtaggtttttattatgttggttaggttggttttgaatttttgatttttgtttgttttggttttttaaagtattgtgattataggtgtgagttattgtgtttggtttgatttttttttttaattttagtgaaatattggaaaatatagtaaatataagaagtaattgaatattattttttatattttaattgattgtaattgaaatataagaagtaattgaaatataagaagtaataagaagtaattgattttttatagataattattattgttaatattttggtatttgttttttgttttttttttttttttttttgtttttttttttttttttgtgttttgtgggtattattaattttttattgttgggtatttaggatttttatttgttttattataaatattgttttagtgaatatttttttagggaagtttttgtatagaatttgaattatttttttgggtatgtatttagtaaggggaggattgggttaattagtatatatatttaagatttgttttttatattattaaattggtgtatgtatatgtgagtatttaatatgtattaatgttattttgttaataatagtgtatgttttttattaaatttttattagtatttttttgtttgatattaagataaaaaaatagtattatgttttaattttattttttttataatataatgaaatataattattttttatttttatattgtatatttaaattttttttttattgaattggttgtttatgtatagtttgaggtggtttttttgatatagagtaatattttgttatatattgtatatgtttgaatatatattaggttgtttaaaataaatagttgtaagttttatattttagaaaaataatggtgtttgtgaatgggtgtatagagatagatttgaagtagatattgaagggttgtttggaagttttttgaattgatattttttattttatattaaagagaatatgtatgtagaaaaggatatattttataaatgggtagttagataattttttataaattaaatatttgtgaagttagaattaggtttaagaaatagatttatttagtattttttagtttattttgatttttgatatttaatagtatgtattttattttttatttttttgtttttaatttttttgagataggattttattttattgtttagattggagtgtagtggtgtgattatagtttattgtagttttaattttttaggtttaggtgttttttttgttttagttttttgagtagttgggattattagtgtgtgttattatgtttggttaatttttaaaatgttttttagagatgggggttttgttgtgttgtttaggttggttttgaatttttggttttaagtgatttttttattttagttttttaaggtgtagagattgtaggtatgagttattgtgtttggtttgtttttgaattttatagatttgttttttttttgtgtttggttttttttttttggtttatattatgtttatgagatttatttatattatatgtagttgtgtatgtttattttttttggtgtatagtatttttttgtgtggttatattataatttatgaatttgttttattgttaatggatatttggtggttttatatttttggttataaagagtgattttgtgaatattttgttatatgttttttggtgtttttggtgttgggagtagaataatatttttataaatttttttgtgtttatatttttattttttttttttttttaatattttttgagtaaagtaaagaatagtatagatttggtaatgtatagtgtttttgtttttttttgatgttatttttaggaaggatgagagtaatgaagtttttttaataaggtattgagttttgatttaaattgtagataatgattgttggtttaagattaggttattatttttaagtgaagaattatgttttatgttttgttatttttttttttattagttttttttgatttattttagtaaatggaaggtttttgaattgttttaaaaggaaggagtttattaatttgttggttttataagtaatttttttaggtttattagtttaatgaaaaataatttttggggtaagaaattggatttaggttatgtgtatgtatgagttgagtttgagagatgtattaaatttggattttgttgttgtgtgattttttggtagaattaaatagaaggtattaaaaatttttatagttgttttttattagttttatgtttgattttttttttttttttaaattttttggttgatatgagttttgaagttttgttatatttatttattagtttgtggtaaatgtagtttttattaatattaagatgaaaggttgatagttaagagaaaaaaataaaagtatgtgttatataaaaatgttttatttttttaagaaattgttagagttatgtttatttttttttttttttttttgtatgtatatggaaaaagttaaattgttaaatttttattttttaattttttaagtgtatatatatttatttaaaatttattagtaatttttaaatatatttaaattgataatttaataatttaaggagggttagatatttgttggtgtgtttttaattttatgggtatttttgtaaattatgaattattttgtattttttttatatgtatgggttaaatattaatttttatagtaatttttttgagtatggaatagatggaaaattaatgttgggagagaggaattttgtagtatggtagtttgtgtttatttgttttgtttttaatttgtttgtttatttttgtttttattgtttattgtttttagtattttgttttttattaaagaatattagttttaagttgatgaatagtaatattatgtttttaggtgataatttggtaagtgttaatagaggtataaagaattagaattaggttaggtatagtggtttatgtttgtaattttagtattttaggaggttgaagtgggtggattatttgaggttaggagtttgagattagtttggttaatatggtgaaatttggtttttattagaaattataaaaattagttaggtgtggtggtatgtatttgtaattttagttatttggaaggttgaggtgggagaattgtttaaattttggaggtagagggtgtagtgagttgagattattttattgtattttagtttgggtgataagtatgaaattttatttttaaaaaaaaaaaaaatttagttggttatggtggtgtgtatttgtaattttagttatttggaatgttgaggtgggagaattgtttgaatttgggaggtagagggtgtagtgagtagagattgtgttattgtattttagtttgggagatagagtgagattttgttttaaaaaaaaaaaaaaaaaaaaaaaaaaaggaattagaattaggttggtagaatgttgttataagagatttttttttgttttttttttttttgtttgttgtttttttaattttttaattggagttatgtttttatttttggtattttgttttttggggttttattgttaaggtttatagggatgttttagtgttattttttttggggttttattttgattagaaagatgtttgttgttttggttatttttggaagatagtaagaatagtaatagtagtaaatgtatattgttgtttttagatattttttggaagttttattatatttatttaattatttatttatttgtagaatattttattagtgtttatggtgtgtatataagagatagtagagtattgaattttagtgtttgtttttaaggattttatagtttagtgatggagatatataagtgaatagttaattattaaataaggtaagaaatgttttggtagatattgggtggaaagttgagtaggtttagaagatgggatagaaggggttgaggatggttttttatgtttagagtttttatttaggttgggtagtttggagttggttttgtagatatttgggttttatgtaaggtttgtgagtttggaagtgatatgtgtttttagaagatttttaggaaggggagtatatggaatattgtaatttttaattttgtttttatttttattaatttgtgataagttggtttttgtatttttgatattaagatttaatatatgtgatttttggatttgttaagtatttgttttttaatgttttggatttttatttatggttttatggttttaattttgtttgtaagattagattttatatttttgattgaattatttagaatattagtatatttagtgattttataaaattgatttgtttatgtttaagaggtattttagatgtttttttttgtggttagtttaggtaggtataaaagaagtttaagatttgatattattagtagttagttatagataaggtttaaatttagaataagtagggaatgagatttttaaatgtattagtagtttatttgatttaatggtatgataaattgtatggtatagttgtgtttttatgatttaattagtgaaattaaattaatttgttattttttttttgatgtttaagtgtttatgtggaaaaatgtttttatatttgggttttaggaatatgtatttttaagggggtattttaaaaatatttttttagttttatgaaaattttgatgtttttgtatattatttgaatttttaaaatttttatgtagaaagatagtttatattggataggtaagtattatattagaatttttgttggtttttgtggtttttatagtagggatgtagggatattataatgttaaagatttgtaatagatttgttataatttattagagagtgtattttatttaatagtgatttgttttttttttttttttttttggatatagttttattttgttgtttaggtttattgtaatttttatgtttggttaatttttgtatttttagtaaatatgaggttttattatgttggttaggttggtttagaatttttgattttaagtgatttatttgttttggttttttaaagtgttggaattataggtatgtgttgttgtttttggtttatgaatagtgatttaaaagttttattttttttatgattattttattattgtttttttttgtaatgttaagattgtttttagaatgaaagattttattataaaaaaaaaaattaaaatttttttttagatttttttaatttttatttatttatttatttatttgatatatagttttgttttgttgtttaggttggagtgtagtggtgtgattttggtttattgtaagttttattttttgagtttatgttatttttttgttttagttttttgaatagttgggattatagttataggttattatgtttggttaattgtttgtatttttagtagagatggggttttattgtgttagttaggatggttttgattttttgattttatgatttgtttgttttggttttttaaagtgttgggattataggtgtgagttattgtgtttggtaattatttttatttttatttttatttttttttagataaggtttttatttgttttttaggttagagtgtagtggtatgattttggtttattgtaatttttgttttttaggtttaaggagttttttattttagttttttaagaagttgggattataggtttgtgttattatgtttagttaatttttgtatgttgtgtagagatagggttttattatgttgtttagttgtttttgaatttttgggtttaagtagtttgtttattttagttttttaaagtgttgggattataggtgtgagttattatgtttggtttttagattttttaaatagattttaatatgggaatatataattatattaaaatattagtttttaaagtttgtttgtatattgtaggggtatggataggatgtgttttagtgattattttttttatttagttattaaattagaatttgtgtttttgtatgtattttggtgtttttttagtaatgaattttaagtttatttagatagatttattataaaaggaaaaaaaaattgtataggtttggaaagtaatattttaaaattatttagattttaaagattgataaagataagtaagtaaaagattattatttgaatagagtggttggaagattgaagtattagtatagtaaggaagttattaaattggttaaagaataatttttagaaatattgtggaaaattttaggggttaagtgtaagttagataaagttaaaaagagagatattggggttatgagatttatgatgtgtttagtggttgtgatgtgtaaaaaatagagatggtatatggttaggtatggtagtttatgtttgtaattttagtattttgggaggttgaggtgggtggattatttgaggttaggagtttaagattagtttgattaatatggtaaaattttgtttttattaaaagtataaaaaattagttaggtgtgttggtgggtgtttgtaattttagttatttgggaggttgaggtaggagaattgtttgaatttaggagatggaggttgtagtgagttgagatagtattattgtattttagtttgggtaataagagtaaaattttgttttaaaaaaaaaaaaagaaaagaaaatagagatggtttattagatagaggtagtgttgaatttaataaggatttagagtgaaagggtagagataattgtagttggggaaaaggtaaattagagagaggtagttatagagtagaggtttgttgttgatggagatgagtattttttggtagtgtttggaggggtgtgataagtagaggtgagatagaagagtattgtttaatgtggggtaaagaaaggtaggtgtatagagatagataatttttggtttgagtttgagtaatttatgaggtttttggtaaggaagattgtgatttgaatattatagaaggaggttagtattgtaaaagattagtgtttggatggaagatatttagtttgtgaggatagttgttatttgataggaaattttaagtttgttgtgtagatttgaagataggttgaaaatataaaaaaaaaaaaaaaaaaaaaaaaaaaggtgtttattttttttttttttggattatttttttttaggattttagagatagtaatgtatagaaagggaaatagaaatgaattttttttaggtaagagagttttgtaaggttgagttatttgggagttaaggagaagttgtttttttgtgataaagtaggggttgaagttgtagtggttgttaatattttgttgaatgagttttgaggtgtatttattttataggaggggtggttttgttttttagttggtttatattaagatttttatttttgtttataggtagtagagtagataagaggaatttagtagaattgatagaattgttaggtatagtaatatagttttgattatgttttttgtttgttgtttttattaattttttttgggaatttttgtagaattggtttagataatgtgattaggatggaagagttttttgaatgatttggtagtagtgtagtgtgaaatttattattattttttttaaagtttttttgttaaaaaagtatatttttatttgtgttaataagatgtgaattaaagaataaagaaaaatgtagaaaaaattatatgtgtttttaatttaaattaaaggtgtaatattttagagtattagagtagttattgagattgtaaagtttagttgaatttatttttgaggggttgggttgagattgtagtttttttgaaaatttgaattagagattttttaaattaatttttgtttaaattttttttataaaggtaagtttggtttatttttttatagttaaaatttgaagaagaggttttttttttttatggtttttatttaatgtttatattattgtttattttgtgttaattttgtagtttttgtgtttttttttaggtagttttttatttagaaaaattagtaatgtgggttttgagggtagtagttattttgtttttattttttttagaaggttagggtttatgttgggatatatggagtttttgatatggatgagtttgtatgaattgaatgtgaagaattaatttgggttggtttgtattgtttgtgttgatttagtttgttttaaattttattatttaatttttgatataagaggtggaaatatttttttagaattttgattatatttgtttttgtttttagtaaggagttttttaattatgtgggaagaggaatttttaaaattttatttttggatatgttttttttatttttattaataaatgtatgtgttatattaggttatataattgttaggtttagaattataggagattgatttgatttttgatttattaattttgtgattttggagaagttaatttttttaagtttatttttgttatttgtaggatgatattgttgtttgttttatagttattttaagattttaaagtatttatattaaatattgtggagatgatagttattttattttttgaatattttttttaggtgtgttttatagttttattaatgggtgttgttgttatattttgagataaggtaggttagaggataatatgatttttttgtaaaagattagttagtaaatgtttttagattttaataggtgatttagtttttattattatttaattttgttgttgtggttttaaaatagttgtagataatatgaaaatgaatgagtttggttgtgttttaataaaatattatttatggattttgaaatttaaattttttattatttttgtttgttgtgaaatattattttttttttggttattttttatttattaaaaagtttgagatatatttgagtttataggttgtataaaagtagttagaggatataggttgttagtaattattttaaaataatttgtttgattttttttagtaaatattgtttatggagaaataaaatgtattttttgggaaaattttaagtgttttaagttattgtagaaaattaagtagaagggattgatgtttttaatagatatttgaagaattaagtatatttgtttagtaaatgttgatttggggtttgattagagatatgttgaagaagtgggtaaaagagatgattagttttaattatagattattaatttggagttttttttttggttgtaaaatagtagttatttttttttaagttgtttattttgatgtttggtgaaggtgtttattggtttgttgttttagaggttatggagtttttttttgtattatttttttttttaggatatttatgagaagttggttgaagttgataggagatgttttattttatataaggggaagtagtagtttaaagaaattttgtgatttgtttaatattagatatttttagtagtataggttgggtatttttgatttgaaaatttggaattttaaatgtttttaaatttgaaattttgggagtattaatgtgatgttataagtagaaaattttatatttgattttatgtgaggggttgttgttaaaattttgttttatatataaaattattagaaatattgtatgttgtgattttaaggttatggatatgaggtgtatgtgaagtataaatgaattttgtgtttagatttgggttttatttttaagatattttattatgtatatgtaaatattttaaaatttgataaaattttaaatttgaaagatttttggttttaagtattttgaataagggatatttaatttggatatttaaggtttggaaatttaatgtttggtttagggtttaattattttgttattttgttttgtattattatatagattattaggttagtgatagtatttagtttttataaatgttatagtttataaagtttttttttatatgttattatgtttaatttttataatattttatgaagtaagaggggtaagttttattatttgtttttggtagaggaggtagttgataatttgatatattttaatgtattttgggttatatattgattaagtgttaggagtaagtttgggagttaggttttttaattttttttattatattgtgttgttttattatattatatggtagttgatgttattaatatttaaatattaaaaaataaattgaaaaagaaataatattttgttatggttttagtttttggtagtgatttttaagtggaggtttgtgttatgagaatttttgtttttaaaatattgtatgtattttttgtaaaaggttgaatgaaatgattttagttttggtaagtggtttatgtatgtttattatttatttatttaggttttttttgttttagtttttttggttaaatgaagtattgttgtatttttattgtatattttattattaaaagaaattgaaaagatgtttgttagttttaatattgtatggatggaaatatatttggtatatttaggaatagttataatttttaatagtgtattttaagaagtagtttggttttgtttttgattaaaaaaagagaaaatttttttaaatttgttataatttgataattatttttagttgggaagggagaatgtttttgtgttgtatgattttgattttattgatttatttagtatttttttttagttagtgggaagggattatatttttgggtagtatgaagggttttttatttgttggtaaataatttaagtaaagttgtttttaagtgtaagtttttttttttttttttgtaaattatatgtttttttaatttttggatatatgttttttttaataaattatgtgtggttttaattgttggagttattgttaagttaagtataagttaaatatttaggttgttttttgtatttaagtgtttattatagtttttttgaagatagtgttttttttgtttgtttgttttgtttttttgtaaaatagttatttagaatttggaaattttatagaaatggggaggtgtggggagaaatagggtgataagaagataatttagttatagtatgagaggtgttatttatattgtaagatattaaatgtgtttaaggtttgagtttgataaaagtaataatagtgataatagaagtagaatgagaaatttgaagaagtttttgaattatgttttatttatgattttggtttaaagtttatagttaagtttgtttgattaaagtttgtagtattttttttgatggtttttagaggaagaggtagaataattttaataatgaaaatagtttttagttgggtgtggtggtttatattatgtttgtaattttatattttgggaggttgaggtgggtggattatttgaggttaggagtttaagattagtttggttaatattgtgaaattttgtttttattaaaaatataaaaattagttgggtgtagtgtttggtttttttttttttatgttatttaggaggttgaggtaggagaatggtttgaatttgggaggtagaggttgtagtgagttaagattgtgtttttgatttttagtttgggtaataagagtgaaagtttattttaaaaaaaaaaaaatagtttttatatgtatagatagaatagtggtaagtaaatgaatgtttttaaaaattttttatagaagttatattttaggggttaatagtaatttataatataaaggaaagttatgttaagttgggtatttatttgaagggtgattttaagttagttgtttaatttttgttaaattttaggatgtttagttgaataattggttgatgatattgtattttggataggtttgtgaagatttagtgggattaatgtatgtggagtatatagtattggtttggtgtttagtaagtgtttaataaatgtgaggtgtagagtatagtttagtgttgttaatgtattttttatttatgtttttttagagtgggttggtaaaagttgagttaataagtttttagggagggattttagggtatttttgatattttggggaggtgtttgtatatgtataggagataattaaaatgatataattttatataggttaatttattaaaatgatataattttatataggttaattttatataaaatgatataattttatataggttaatttattaaaattttttaaagttttatattagtggggggtgttattaatatgtgtatatttagttttttgtattttagttatgttttattgttttaagggatggaataaatagtttaaagtaaggttttaatagataaatttgtgggataattttttaatttgtatgtatttaatttgaatttttttagataattatagtaaaggttatatatagaattaaaaataaaagataaataaattagttttttttgtattttaaatgattgagaaatataagttaaaaatttatataaatatttttatgttaattggtgtatttttttgatatttttttttttgtttagaaattttgtatagaaataattatatattttttttttttttatttttttttgtttaaaaatttgaatttttaaataatttagagatatggtagtttggtggttaagtgagtgaatttttggggttgtggtgtgaggaaggagagtagttagtgttatgtttgtggttatgaaggtgtgttttgtgagaggtgaaattttgtggtttttttttttttttttataggtagtatttgagttattatttgagattttgtaaaggtatagatttttgtggttaatttattagaagtaggttgtttagatataattgtgaagaattaaaaggtggtatttttatttgggttttttaaatgtatattttatagttgaggttagtgggttatagttaaagggggtttttgttgtagaaatttgatttgggtagtatttggtttttgtttagaggttgattgagtgtaggtgagttttgttgtttgttttttatgggggttatgtggtttttagttttttttggtataataatggtattattgtgatatttaaatgtattttttaggagtgtttgatttttgtaagggtataagtatggtttttaaaatgttattaaaaatataatattattatatgtttaggtttttttattttgtgattttttaaaaataaaaatatgtaatataaatatattagatgtagtttattaagtttgtgtttatttttgtagtttggaaaaatgttagaaaggttaggaaatagaattttgttggtgatgggaggagggtgtggatttgggaattagtatttgaaagtattgttaaaggaagaagttgttgtatatagaggtttatttttttgtgtttttaaaggaaaattaagttgtaagttttttggttatataggggttgggttagatttttagagtgataggattatttttattggaggatgtagttaggtggtagtaatttggatattttggttttttgaataggtttgttattgtttttgtttaattgttggttgtggattttgttatggaattttaattgtttaggtttgtatgtgtaaagtaagaaagagagattttttattttttgtttgttaaagattaaaattgaatttttaaagaaattttgaatatttaaatgtttatgagattgtgatttatagagagagatagttataaatgtgttattaagtaaaaggtaaaatttttgattttttagggaatttattgtattgtttttgatgttattaattaatttattttgtgtaagtagtgattggtaattaatagtagattaatagaagaagttttatgatgttgttttagaatttttaatttaagaaagagttttggtaagagtttgaaaaataaggtagatttttttttttttaaaggtgaatttgttggggtttttaagggtattgttttgtttatatttttttgtttttaagtgtatgttggatttggtaagtttttttgtagggagttttgaaagatggttagtatttttgggtttgtgtttgtatttaagtgtttgtttagggtagtgtttaattaggttatagtaatttttgttgattttgttattagtgtttagaagtatttttttgggggtagagatggggttgtagattttttatttgtgagggtttaggggtataggaaaatgtatggaaattttatgggttatagggtatatttgttgaagttttagataagttgatagtgttatttgtttattattgttattatttttttaaaaaaaaaatataggaggtagtttgttttgtatgttattaaagttttttgttgtagtgaggggaatagttattttaggttttatatttttgtttatttgaatttttattttgttttttttgtttatttttttttattttagggattttttttgaagttgaatggagttttgtaaattgagtagttggggagtgaggtgagaattttgttttggtttgagttttaatttgttgttttttggagtaaatggtttttagtggaagttattgggatattggttagtttagattatgttttattttttggtaaaaagaatagtagaaatatgaaaataattaagttattttatggttttgatggagggtattttttttttttttttttttttttttttggagattgagttttatttttgttgtttaggttggagtgtaatggtgtgattttggtttattgtaatttttgttttttgggtttaagtgatttttttgttttagatttttaagtagttgggattataggtatgtgttattatatttggttgattttgtttttttagtagagatggggtttttttatgttggttaggttggttttgaatttttgattttgggttatttgtttattttggttttttaaagtgttgggattataggtgtgatttattatgtttggtttgatggagagtattttttattttttttttttttattttgggattttttggttggtgaaagtaggaagagagagtaattttataatttttgagggagagttgttatttgaatttttttaaggttttaaattttgttgtagtttttttatgttgtaggtttggtagtgtagtttaaaggttgtaaataaagttgagtgtttttttttgatttatttgggtttttttttttgttatttgttattgttaatgggagatgtatgtgtagttgtataagggtaaagtttgattttgagggtattggaaatgtttttagagtgggtattgtttgtttatgttttttggaagttaagttttagatattttagggagtagtttttggttttggtagaattgtaatttagatggaaagaggaaatattttgttttttaaaattataggaattttattttttttttttagtgtaattttgtaatgtttttgaatatatttagtttttttttttttttatttttgatttttttttggttagttttggggagaattttgaaatagggagtgaggatttggattttgttggtttttatttaaagagtattaatatgtaaataattaaagaaataaaagttgataagatgtaataaatgaataataggaaaaaaatgaaataatgttttttgtaaatatagtgaagtaattttttgggaggaaaggagagatgattatgttttgtgttttgtttaggataggagggtggggttttaagtttttggagatatattaaaaatgtttggaatatataaagtttttggttgagttttggagtgtggtggagagggtgtgtagtgttgagtggggtttgtgtgtatttttgtgtgtggtagggggaggattgtatttgtgtgggttttttatgtgggtttagtgtttttttatagatttgttatttgggtttttgttggtgttttttaggagtggatttatgttgttaaaaatttaatgggagagtgttttagttttgaaattttttgtgtatagtaatgttattttttttttttttttttttttttttttattggtggtagtagtggatgttggggtatatatttaggtattattttaaaagtttatttaggaatagagtttttgttttgttaataggggatagggaggtgtggatttagtaaagtatattgggaagtttttttgtattatttatttatttgggatatgatggttagtttttgagttgggtttaatattttgttttattgttattattgggttgttgtgaggattatatgagatgatgtaaataatgatgggaaagggttatttttttttttaaggatggggaagatgtttgtttgtgaggggtttagattagttaataatatatttatggagttttagttttgtattttaatttatttgaatgtgattttattatattatttaatatagaagttataaggttttataaatttagattttaaatatggaaatagtatttttttgttagaattttatttggttagaaatttgagtattttttggtttttttttttatttttttttaatattttgttgttttttttttgtttgttttattttttttttattttggttggttgtaatttgagtgttatttttttgggaaagtttgatattttgattttagttttgtaatttaatgatggagagtttttttagtaaattaaatttagagttttagaatgtttattttatatttagattttgaatataaaaggtattttatatttgtaattgtttatttaatgagtaattgtagagtgtaggttggttaagggattgagttatatgtattattattgtaagaagtattttgaaatattagaaataggatgtaagttttgattagggagattgtgagtataattattttttttttaaatttttttgtgatattgtgggaggaaaaaggattttgaaatttgaaaggaaagagtttgtttttaattttaaaagttaggaggaaagggttttgaaatttgtttagaatttttaatttattattagtttgtttttttttttagttttaaggtattttttgttttttgaaaagatgttaagaaatttagttataatagagagtttagttttgaatatgttttatttggtttattgaggtttaggttttagtttttgtgtggggtgaattgagttgagtggttagttggttggagagaggtgaatgaggagttgttgtgtatttgtaaattttggtaaagaaaaaagtttatttttttttttattttataatatgtatttttgtataattttgttagtggtaatatgtggagtggagtttgtttttaagttaatatagagtatttggtttatagtaatttttgttaagtttgttttgtaattgaagttgttgttgattttgtttggggattatttgtaaaattgtttatttagtataaattgaaataataaatttttttttttttaggttgattgtgatagggtgatattagtttgatttaatgattagttgtttgatttttttgttggagagagaggtttgaatagggagagtttatttggaagtatttagaaagaatattaatgagtttgttaaatttagtatggttttaattatttttaatttttttaatgggagtagtattgtttgggagagggagagggagagggaggtagagagatattgagaatgtttttagagggtttgtgtagttagagagagtttattaagagaagttggtgtaaagtagttagttagagtttggggattgtgttgtaagtattgtttgtttttttatattttgtattttttaggttttgggataagagaggagtagtgggtattaaaatgggttttaagggaaaattaatgttaagtgggaaaagggggtgaatatgtgtattgtgagtttttaattagttaattttgttaggtgataggaggtgtttttagttagtgatgtttggtagagttttgtttttattttgaaggaattatttgaaattttttttttaagttatggatagaaaaaaataaaataaaataaaataaaaaaatttgaaatttgtttttttggttattatgagaaattggatagatgtttgtttgtaagtgtttataagtgtgtgtttgagttttgttttatgtagtaatgtgattattttttttagatttttattgtaaatgttttaagtattgtttgtaaggattttatttttttttttttttgagtttttagtattaagaatatttgatttgatgttatttgtttttggatgagtttggaaattttgggatagtttttaaaatgtgatgttttgggtagttttttgggggtagggatttgttaatttttatttgagtatggatatgaaaagagaaggaggtataaagtgggattatgatgatagtatttaaagttatttttttttgaaagattttagtgaattgtatgttttggtttgatttttgagtttgtagttgttaaatatagagaagtgggaatagttgttttgtgtttggttgttaaagtttattggtagatgtttttggagtagtgggttgtttgtttatatttttgtagtagatttttgtttgttgttatggtggatagtgtgtttttgttaataatttggtttggtgtagtttgtttgtattgatttttaaattttattgaataatttggtttaattgaataagattagatagtttttgttttttggtttgttgaagtggttgttaaatttataagagtaggtaggaatattgtttggaaagtgttttttttattgtatatagagtgtttttaagttttgtagttgtttgtattgtggagtgtgtatattgttaggtttttatatgaatgtttgttaaaagtaatttggtataggaggtaaattttatgaagtatttgtttgttggagttttttttttggagtggggaggtgtggttgggtaaaattagggtagtattgattattgtaaaagtaagttttttgatggaagtttttatgtaaaaaaaatttttgtttgtatttaattttattaagggaatagtaattttaatttaattttttttatattaaaaatgtgtattttggttattttttgttataattttaatatttatttttgttgggtgaatttttattaagaaaattattgagttaaaaggtatttttatttttatttattttttttattttgttgttttgattatttttttgagtttatttttttaagaggttgggggaatggtgggaagagtttttggttagattataatttatttattatttagttatttgtgaggttggatttaaatgtttattataaatatgtagtttttaagatagggtttattatagggatgttgttttaagagaagaaaagttaatttattttaggataattaagttaaggaaattttgttttaaatttggaataggttagttgagtttggttatttattttttttagagaatgttaattatgtgttagagtttttttgaggaagggttttttggtttttaaatgaaggtttttttttatagaatttgtattttagtgttagaagtttattttagatttaagtttgaaataaaggttttatatagagtataaattagtggaaaatatgatttgggttatttgtaggttatgggaatttttataaaattgatataagttttagtgtttttgatatttttttgtttttatgtaattgtaaaatttttattttatagattgtgaattttttgttaatgaagtataagggtgatttattgtttaaaaatattagttagaggggaaaataaaaatgtattttgttttttgtagtttgttttaaaattgtaaggagtatggtatgaattgtttttatagagattaatgtgaatatgtgagattataggattttttttgtttttgtttttatttgatagattaaatatataatttattttttaattataaagtttgggatgaggatttgtataaaatattattaaaataatattttatagttattttgtagtagttagtaaattttttgtaaagattaaaatatattttattgttttttttgttttgtaagttatttgttaaggtaaggaatatattgtttagtttttaagttttatatataggtagaaagattaaatttgttgttggttttaggtagtttaagttttgagttaatataaatagtatttgttatttttggtttgtatttttatgtaagtttgtgtttatagttttatttttttttgaatttgaataaagttatgaaattgttaaagtattatttttatgtttattgggggagtttttagttaattatatttgttttatggattattttgaagataaatttgtatatgagaataagatgtgtttaagatttatttatttaaaatgtataataatattattatttatatttaaatatagtttttttttaagataggaataggaaatggtttttatattagatgtttaagtggtatttggatagtagttttttttttattagtatttatttgttagagtatagtttgttgattaaatgtggaatttgtttaggagtatgtagtttagagtttatgtatgatttaaagagatgaattggtttatttgttgtgggtttatataggtagtgtgatttaattttatgtatgggttttttgatttgttattatagaaaggttatttaattatatttgtagagaattatagtggagaaatggaaagtttttattgattgaagggaattgaagtattaggaaattggaatatttgttgtatatggaatttttttaagttgttttttatatgtttgaagaaatgtatggatttattagagtatggatatatattaatattttttatattttttttttttatttttagagttattttatatttggatttttagttttattttgtgttttttttaggttttagttttgttgtatggatagaagtaggaagtattttatgagaggttttgtaggtttttatgattggtatttttatttttttttattaatgagttttttgttttatttttggttttgttaaattttttgttgggttataaatttgatttaaaataataaaatagtataaatttttggatagttttttaataggttattttttaggagtaaaggttttatattttttggagtaattagagttttagtgggtagttggaaggattttgtgttattttggaggttttgtgtttttaggtaggtaaagggaagttggatatgtatagttttagattggtaaaggttttagttttatgtgggatttgtaagatgttggttagtttatgagtagaaattttatgggtagatttatttagaagttggtgatgttaatttgttaatttttatattttagtttaataggtttattttttgtttttttttatttttttttgtgtatttgtgtattttggatttttatttataaataattttgtttgtaaagattttattttagttttgtagtttttaaagttgttgtgaatgagaaagatattttttttttgggagagggatattgagaatgagatttaattgattatggttttttaattgttttttaaagtagtttatagagttttttattttttttttttttttagaggatgaaagttttggatagatttattatagagagagaagaaatgtaattattatgtagttatagaatgtttaggggtttagtaaagttagtgaggaatttttaatattgagtgatgagagggttttattgattaagaaagagatttatgggtttttgttatatgtggtggagttttttgtgttgtattgtgggatggtgtttgttatggattttaggaatggttatatggagttttattattgtaagtgtttatgttagttggtatttgtttaggagttatggggagggttgtgtgtgtgtgtgtgtgtgtgtgtgtgtgtgtgtgtgtgtgtgtgttttatgaagttttggtttgtataatttattaaaaggtgtaattttttttttatttttttttttattttttttattttttttttattttttttagagagagatgtttttttatgtttttaagtaatattagtttttagtggggtggtttttaggagagtggtttatttgtgattaatttatatgagatttttgttgagaagtagaattagagttattttatttaaatagatgttgtaggagaaaaatttgttgttatgaagttatgaaagtaggttgtattaagagaagtgtttaatagttgtaatttttatttttaatgattttttaatgtaatgattttgtttatttttatttttgatggtttgtaaaaataaattttttttaataaatttgtgttaaattttttaaaatggaagatttttttttgtgttgtatttttttttttaattagtgtgttagatatattagaagttttttttttagtattaattatgtttaagaaattaattaggattttgaatttatgtatgggatggttttttttaatggtagaatataaagaaaaatgtataagggttgagtttatttttgatttgtttttagttaaaaaaatataatttggttgtggagtaatgaagtttatattgaggtgttaaagtttgtagtttttgattatagatttattattttgttaggatttagatttgttatttaatttttttggttttaattttagatgatttattgagttttagtgagggggattggtttgtgtttttttttttttatattatttagaaattttagtgttttaaggtaaaaggttattagttagatgattgattagtgaggatagttgattagtgtatgtttttttgtttaagaaagtgtttaggataaaagttaattttatttttttattagttggtttgtagtaaaggggaatgtttattttttagattaaagggttttgtataattttaagttttagtaattgttattttgtattattttttttttaattagattatattgttggaaaagatggaagttatattattttttttaagtggagagagtattttttaaaaagtggttagaagtatggagggtagttttttggatttttttaagtttttgaaaaaggttataatttttttgttttaaaagtgtttgtttattttatttttgtagatatagaaataaggaggaaggttattgggtttgtttttttttttatttagggtttatttagttttattttatttatttttttttttagtaatgaaggtttaaaatagttttggtaggttttttttttgagtatatttttaagttttttgtattgtatttttatttgtgagttttttttaaatattatttatgtagaaaatgtgagggatttttatatgttttttatttgtatttatagattttagtagtagatttattttttaagaaaaatttaggttagatttttagttaaagttttttgtattgtttttgtttttatgtgtgaatataaattttttttattttatatttatgttttgttgtttttttaagatgtttattaattagtgaggtatttaattagttaggatagttgaagagtattttttttttggttgatagtagtgagtagataattgttaattttttttttgtgttatttaatttgtagtttgtttttggtttgtttgttttaatggttttttttattgaatttttttgttttttgaggggttgggagttttttatatttgggatttttgtttttttttagtggtgtaagtgggatttattttttggatttttaatgttttattaattaatgatgggtatgggagagtttttagggggatttgaatttatttattattattttgttttgaggttatagtatttatagtggattatttgttatatttttttataatattgtttaaattagtgttaaaattatgtgataatttataaattgtataagttttttgtaattaaatggtaaatataattttgatttattattttaatgtattttttaaattggttataaattatattattatatagataatatggatgggaagttttaaagattgtatagattggtttaatatttgggaatttgggtttaaggtttagttttgttatttgttagttgtgtgattttgataagtgtgttgatttttttaggaattttttttttattgtgggatagggtgataatatgattgtttgttttatggtgtttttgtggaaattgagataatgtaaataaagtattaattaaaatttttggtatatgttaagtgttttaaatgtattaaggtagtttttttttgtttttttttttttttttttttttttttttttttttttttttttatattattattttttttttttttattattattaatatgtgataagttgattttttaagttatgtttgtgagggttgtatttgtatttgatttagtgtagattgtttttttttttttttttttttttttgttagatttggttatttgtttgtttgagattagttttttttataatatagattaagaattgagtaaattgtaaatttgtaattgtggtgttgttagagttgtgtattgtggttttttgaatataatttttttttagttaattttagtagattgattataatttttttttgttttgtaagtgaagaaattgtaaagattttaaatgagtttgagaagtgttaatattttaaatttttagtagaaagtgttttatgtaataaatgtaaattttaatatatgtaggaatataaaagatatagtattatttatttatattgaatatttaaagatattttaaattaagttttagtattatatgggatatgattttattttttttttagaattttgttggattatttaattttttgttagtattataagtattttttgagatattttataataaaatttatttgtttatatggatttaattatttaggtaaagttaatgattgatgtgaattgaaggtgataaattttttatgaattttttagtgtatgaagaaatgttttttttttaaaatgagatatatagttttggttatatttgtttattttgtgggtatagtttgttttagttgtgggttttgttaataatataagtgtattgtagatttttagtagtttaagtttagaaatatttttttaggttagtttttttgtttttgagttatttgttagttttgttgagttggttaaaagaaaagatttttttaatttagtgggttggttatgtgaatatttatagtaatttttttatttttttgtggttggaaattgtagattttttaagatgtttaatttgtgtttttatatatatgaattttgtatttttaaagtgtgggtaggttttttgtaagattggaaaagggaaaattatttttgttttttttttttttttagaaggatatttgtaaaatttttattgtataagattttattatatttgggtatgtaatgttgtatttttagaaattgtagttaggtaaaaattaaagtattttaggttttgtggtttaaaaaaaaaagaaaaaagaaaatttagggatagtgggtattttaaatatttatagtatatgtttagaataaaattttttggggggatatgggggtatttttttatgaagggttgtagtggatgggttgtatattaaggtgtaaaagtagatgttttagatgtatgatttagatatggtgtggtgttgataggtttttagttataggattattggtgttttataatttgggggagtgtggtaggggttagattggaggatttgattttgtattagagttagggtaagaagttttattttttgtttaaagattttttagtaatttttttttgtttatgttttgtttgtagttaggtatttttaattgttatttttttttgtttttattgattgttatgtatttattttttataaatttttaaaggtaggtgatataatagttaaagtatttttgtattttggttgatatttaatttttatttgttttttttttatagaaaatatgtgttgtattgttttttgttttattgttaagagtttagtttttaaattttttttgtagggatttttgtgtaaagttttttggatttattagttatgttatattatagggtttttgttggttttggtaaagggagtagaaagatgtttgttttttaaaaaattttaggttttttttatagttttatagttgtgtgaaggttgttttttttttgtttttaattgtttttaagtagtagttttttatggaaaatatgatttatttttttatgtaaatgttttgattgaaaatatattattggtattttttttatgttttttagtttagatgatagaattattggttgttaattagtaaaatttgaggaattagtttaaagaaaaaattttgaatttttaattggtttgtatttattttttgtggaaggttgttgtgttaagtttatttgtatttttgtgtgttaaaaaattgtatagattttttttttatttgtttgtttttatattaggtgattttttatatttttttagaaatatattttttgagtgaatggaagagaggatgtatattttatatatttaataggtatatttgtttatattttttttttttattatttaagtgttattttgagattgtgagagataaaaatgtttaagaggtataaatgaatagttttgttttgattaaattgtaaaggtagtgatagttttttgagtttttagttttttttttatttagattgttttttatatttttggagaatagttgatgagttaattagaaatgttttgtttttttttgttttttgaaaattagattgtttaattagaaagattgatgttgggttatattttgggggttttgttaggttttttgttttttaggttgttagttttgaattgtagtaagagttggagtgaggagatttaaataagtttataaatttttgtaaaattattatttgtgagtttgagaatagttttttgtttatttttgttttttttttagaaatttaatagaatgatttggtttttttttagtaatttagaggtaatgttttaagattagaaatagtgagttatttatatagttttttttttttttttttttttttggagatagagttttgtttttgtttaggttgtgtagtggtgtaattttggtttattgtaagttttgttttttgggtttatgttatttttttgttttagttttttgagtagttgggattataggtatttgttattatatttggttaattttttttttttttgtattttttagtagagatggggttttattatgttagttaggatttatagatttttaaagagttgtattgtaagataatttggagtaaagtaatatagatttagggataatttttagtgttttagatttgaattgttgttagtgaattttgattatttttgtgtttgatgtgattgtgagtttgtgtatttttgttttaggagatagtgaatgaaattgggaattaatagtgagaaaagtttttgtagtatttagaaaaatttgttaataattttatttattaattttgaggataaatttattaaaggagattgggagaagtttgaagattatttaggttaggaagagaaagaaaagattaagagagattgtatttttttagagaaaattatttagttttttagtgtattggtttagttttttttttttttgttgtttggtattgtttttttttataatgatttagtttttattggttattgttttggtgttggttttgtttttgttgttttgtttgtatagttgttttttttggattagttatttgttttttttttgtttttaaattttgtttatgtttaaaggtttatttaataatttatttttttggaaagtttttaagagttattttataaggatatttttttattgtggatatttgagtagttatgttatttttatttttaaatatattatagttatttttttgtgttgtttttatttggtggtttgattttttttggaataatgtgattagtttgaggtagtatttattttttgtgggtattaaaatttttagggtaggattggggatttatgtgtgttattatagggtagagaagttgggagttgtttagatgtttattatagttattatggaggtggaattttaggtgatttatgtttatagtttgtttattagagtggttttttgattatttgaagagatattgttgtttttgttttttttttataatttagttattgtatataatttttgatttaaatttagttatttaattttttttgagagtaggtaatgtataaagtatttatggtatatttgtatatttgtaaaatttgtatttttttattttttatttttgaggtggagttttgttttgttatttaggttggagtgtagtggtgtgattttggtttattgtaatttttgttttttaggtttaatttatttttttgtttttattttttaagtagttgggattatagatatgtgttattttgtttggttaatttttatatttttagtagatatggggttttgttatgttggttatgttggttttgaatttttgattttaggtgatttgtttgtttaagttttttaaagtgttaggattataggtttgagttattttattggtataaggtagggattttgattttttggaataagttggtattttatttatagatttggatggggattgtaattttaagtattgtaagattaatataggagagttgttttttttttatgatatttatttggtattgaataagtaggtattttttttgtggttaaggggagtatgatgtttgtttgtttttttttaaattttagtgatgtattttgtttttaatagtttttaggtaatttatattttggtaatatttttttaatttagtatttaagtatgtgtttgatttatgttgatgggaggttttatttgtaatttagtttaggattatgaatttagttgtttaaagattttatgtaattatttattttttttaatttggtatttatttaaatggtatttttttagtagttgtttgtgatttttttttttttgttttttttttttttgttttttttttttttttttttttagagtaaagtatgagaaatagtaatttttgttattttatagttatttgttaatagtttttttttttgtttttttaatagaggtaatattatttttggtttttttttttttttttgtataattaaagaatgttatttttgatgttttttgaagttgtaattttttattttgttttagtttttttgattttatatttgtaaatttgtgttgtatttttatagtttttagggaaagggtttgatttttttttgtgtgttgtttatagtttgggttaatttagagtaattgatttggtattttattgtttttttttttttgttttttgatatagtttggatttttgttgtatgttttgaaaaggatttaatttttttaattttttaagttattaaatttgggtttattttataatggattgtttttattattttaatgtttttattttttttgaggggggttaggttttttattaattttagttttttaatgagttttttttttttagattaaaataaagtaagattttatttgatttttttagttatttatttttgtgtttattttgttagttatgtattaattgagtatttgtttattgagtgttatttaagtgttaaatagtgttgaataaaatgagtaagtgtttgtttttgttgagttttaggttattgaaaagttaatataagggagttgttaggggagagagagtgaggagttttttgggagtaggtgagggatttatttagttttggtagtttagaaggttttttggaggaggtgatatttgaaagaggtgaggaaagagtaatttaggtaaaaaggagtatttgttaaggtttggaagttaaaggaagaattgatatttgtaggatttgagaagaatttttgtggttggagggtgaattttaggagggaagtggtaaagatagggtttaagaggtttaggttagtaggtttttgtgaggagttgtttgttttttttttgtaagagtttggggtgattattaagatttgttttatggttttttgtatatttaaatagatttttgggtttttaattatttatttagaatttttttattgtagaattgaatttatttttgtttttaatttgatagtgtgtgattttattgtaggttatagggttttttttttaggtgtttttggttgggttgttgttttattggtttttaaggatgtgttgttgtatttttttgtgtagtaggttatatatatatttttttgagatggagttttgtttttgttgtttaggttggagtgtaatggtgtgattttggtttattgtaatttttgttttttgggtttaagtgatttttttgttttagttttttgagtagttgggattataggtatgtgttattatgttatgttaattttgtatttttagtagagatggagttttattatgttgtttaggttagttttgaatttttaattttaagtgatttgtttgttttggttttttaaagtgttgggattataggtgtgagttattatgtttagttagtaggttatattttttttttaagataatataatttatttttatttgtttttaattgttgagttgttttgtaataggtaattttaattattataatattttgattataaagtataaataaaaaatataggaaataattgtggttttgtttttaaagaattaatagtgttttgtattaaggtatattttaatttttatttatagtgtttaaaatgaaaaaaaaaagtattgagttttattttattggaaaatttttaaatgtttttatattagttaagttagagaaattgtgtagtagggttaggttgaggttggagatagggtttagaaataattaagtgaaatttagttgggaaatttagtagttaatattattaggggagtatgagaataaagattggtattagtggatgagtttgtaatttagttaggattgaaagagttttaggggagaggatgggattttggaggagatttgtgttatgttttttagggagttgtaggtttaattagtggatattgtgaggattaaagggagtttattttaggaagtggggtgtttatgttgtttattggggggatttagatttgtattttgattgtgtttttgttttgtgagtggagtaaaaggaggtgtttgttttttaggtaatttagataagagtagagaagtgtatgtgggggatgttgagaagtaaatgttagttttttttttggtttgtttttgtggaataagtttgtttttaaatggggtaagattttatattttttttttttttttttatttttgtgttttttttttgtaagaaatttattttttttttttttaggggtgaagggaaattaatatataatggtagtttttttgtgattttgttttttgttagagaatttgtgatttattttaatttggtgtttgtgattttagtttggtttagtgaatttgattaagtgggttgattttttgattaaatgtgtagtttattttttatatataggtttgtgagatgtatttttatgtagtttttattttttatgatgaatgatgttttaaatgtagtatgtgtttattatattgttatagattgatgatgtgggagatagtgaataattggagatatttgagtgtttttgggggatttagtttttttgataatattgttgatgtgatttgttttgagttttattttattaagtatatgatgtatgatatttatttttattaaaaaattttgtgtagtgttttgagagtttgttgtgagttagatattattttaggttttgaggggttagtgtttgttaaaataaattaggtttttgtttttaaagttgatatattagttagaagagatatataataaatatttaggtagagttttaataagaagatataggttgagtattttttatttgaaatgtttaggattagaagtgttttagattttagattttgaatatttgtatatatagaatgagatattttggagatgaaatttaagtttatataaataatttatttatgttttatatatattttttttatatagttttaaggtgattttatgtagtattttaaaataattttatgtatgaaataattttagttgtattttgattatgatttattatatgaggttggttaggtgtggaattttttatttgtggtattattttagtttttagagttttggattttggagtattttagatttttagattagggatatttaatttatagttggtggtgttttgagggtaataaattaggtgatgtgttagagagagatttgggtaggaatgttgtgttttaggttaggtgggtggggtagggaaagttttgtttaggaggtgtttttgtagttagaataattgaataaaaaaagagaagttgttttgggagatttgagggagagtattttattgaaaggtttgttgtgaaaaagtattaggagtggagagtatgttaatgtggttattggttaggggttgggatagtagggggagatgagattgagggattttgtgggttaataaaaagttagtggaagaagtgttgtgatttgatttttattttagggttgttattttggttggtgtgtagtgatgtttgtgaaggtatggaatgtggaattagggaggtgatttagtaggttgttgttgtagtggtttaggtgggaaatgatttttgttgaaatgatagttagtagaaagtaagttttttgtttgtattataatgttatgttatgggttttgtttttgaagttattaaatttttataaaataattttatgagtggttgttatgatttttttttttgatatatgaggaaattgagatttggtaaagttaagtaagttgtttatttttatgtggtttggaagtggttgaattgaggtttgaatttggtttattggttttagaatttagattttttatttatgttttataatggatgagattttaaaatgatagtttagatttgtgtaagagtgtggttaggttgttagtggtttgggattagtttagttggggagtgtttggaaattatgttttggaatttaggtggtggtattgttagttttgggtaggggtttggagtataagggtgtagaattagggaaggtaggttaaatgttattttggtgtttaggttttgtttttatgtattttagtgttagagaggtaggaattggtttttgttatttttgttttttttgtgttttaggtgttgggttgtaggggagaatgagatatttttttttattttgttaattgatattttgtaaagaatttaatattattttatttagaagttaaaaatggggaagtttgtggttttttttgtatttttatgttttggaggatgtaagagttggtatatagtagtaattattattataggttatatgtgtgatattttttatgtgttaagtattgggttgaggattttattatgtgattttttttagtttttatataaatttatttagtatttgaattataattatggagattatatagtttgtttatggtgttggtttgagtttggattttagattttggttttgtaattgagaaatggaggtttatgtgtattttttttttagttgttttataaaatgttgttttttttatggtgtttttgttgtttttatatttgttttgttaatggtgtagtggtttttggaagatgggttgtttttttggattaaagattttaatttattatgtgaaattttagtttttaagaatagtttgtataataattggagtttttatatgttaatagataatataagttagtatttggttttatttaggtatttttggggattagttttattagttatatagagtttattgtaagatttttaattgtttttatatgtggttttatatagggttgtaaattattttgttttatttaggggaggaggtggtgggaagatagtattttttttgtttataaatatatttaatgtttatatgtggtagggggagagaaagagaaaaaaagtgagagagagagatagagagaaaatagtttttttttataaaggtattttggtatttaatagttttgttaatatggatagtttatgttttttgattttggtgttttagataaattaaaagaattttaagtatgatgaagaggttggaggaatgatttatgagaaaagattaaaaggattgagtatagatagtagggtttgtgtaggttaaagatagatatggaaatttttaattaataatttaaagaaatatatgttaaggaaggttaagattgatatagagagttttgagtagaaaatttgtgaaaatagtaagaagaagattattgggatttttttttgtttttgggatttgtaagtaggattgatatttgttttaaagataaatatgagatatttgtttggatttgtataaagtaatgttttaggggatttgatttgatttgagatatatttggtttgtgagataaagatatatgttgtggtaatgtttttttgttatattaggaaaataagaaaaggtaatattgagatttttaagagtgattataatattttgagatatagttagttagaatagtttaaagattatgaaaaattgttataaggtttttagagaagttagagggatgaatttttagatttttttattggttttttaatattaattgagttttatatatagtagaataaaagatatgattttagtgttttagattttataatttggggagagaaaataagaaataatatatgaaataattaagttgtatattaataagtgtaaaatagtaagataaaaggtaggatttagatttggtgatggtgattttagattttaagggggtttttataatagagttttgattttatggtaaatttaaatatattatgaaatttttttaattaatatttttttttttttttttaaatattaaatttatggattttgagaaatttatataatatatatgttgatgttgtgttttttttttgtttgatttgttttagtttttattaagtttaatgtttgatttttattaatttatgaggagttgtgaattgtaatttgaaatgtttttttgaattttagagtttttttgtagggaaaattttatgtgagtttattttgatttttgttaatattttagttaagtatatagtttattgtttaatgattttttaaggttttttagtgatgttggtatgtgttgttatattttgagggtggtgtgtagttagtttttgttagtgttgattttattttgttttatatttgatttattaaatttgagagtttatagtatgtttaatttagtatatagtttttgtttttaaaatttaataaatttagaagtaataaattttttgggtttttgtgggtttgttttttgagttagggtagttaaaagttgtatttggtatgttttgtttattatagtggttatggaaagtgtttttttttttttttttgtgtttttttatgggtttatagtaatagggaattgattttaggatatgaattgtttagtttttggttgttaatgttagatgttttttatatatgagttttttttatgtatagttatttgaagttaatattttgtattggtgattatgtatttttatgtttgggagtgtagatattagattgttggattgtgtgtgaaatagtttatttgagatgttatttttggggattatttattttattgttaggataaaagatttttgagatttattttagagtttttttttggaaatgtatgttaataggatttttttttttttttttttttttttgagatagagttttgttttgttgtttaggttggagtgtagtggtataattttggtttattgtaatttttattttttaagtttaattaatttttttgttttagttttttaagtagatgggattatgggtatgtgatattatgttggttaatttttgtatttatagtagatatggtgttttattatattgtttaggttagttttgaatttttgattttaggtgatttgtttgtttgggttttttaaagtgttaggattataggtaggagttattatgtttagttaggatgtttttaatttttttttttttttggtaatggtgtagttttgtttttttgatgttatatttttgttattaatttttagattttttgaagtgttttttttataatgagttattaggtgagtaagattttaaggtatagtttttttttttttttttgttgttttttatttagagtattaagattttaattagaaattttattatgtagagtttgataggaaagttgtgattggttttatttttgaaaagagttaggatttagtggggtgatgatgtagtgttagtttttttgttttgtgaattttttgattttagtgtttggagggaatttggtgtaattaggagtgaggtttggagtttgattggttgagaagttttataggttgtattgtttgggttttggaagtaaatgaatttggaggtattggtaatattaatgtttgagtgtgttttgttgtttatttgtttttatttagttaatgatatttgagattaaggtaaaatattgatttattttagagttttttgttttatttgaatgttaatttagttttgttaagagttaaagtagaaatagagttgttttaaggagttataagtttgttttttttttatttaagtaagttgatgatatgagagaatgtttttgtataagttttatttttattaaataaattttattttttaaagttaatttttaaaaaaaagtattttttttaggaattaatattgaaggttttttggtgttttgaaattgtaggagagggttttggtgtagaggattatggtgttagtaataatggaatatggtgatgtgtaaagatttgaagtaaatgattattgatagggtggtaggtgaagattatttgtgtttttttttttgagtttattttatgtttaaatattttttagggttttttttttagttttagtttaatgttttttaagatgatgttttgttaaatgttttataaaattaatttgtttatgttggtttatttttgattagtggtgttagatttggttgaataattggggttaattttttgaggattttagaattgaatgataattgtgaggttgtaagtttgtaatttattgagaggttataaagagatgttattagaatttttttttagagtaatattttaaaattgggatgttaagttaggtagaagtaaagttttttttttgaaatggatttgaaaaagttaaattttttttttttatatgtgatgattatttgattattttaatattagtttgttgtttttttaggaaagatttagtaagaaagaaattttgaagttttttttataatttaatattttttattatatttgatgataattattatgtataagttaatatatgtttattttaataaattatgaagttggttgggtgtggtggtttatgtttgtaattttagtattttgggaggttaaggtgggtggattaggaggttaggagattgagattattttggttaatatggtgaaattttatttttattaaaaatataaaaaattagttgggtgtagtggtgggtgtttgtagttttagttatttgggaggttgaggtaggagaatggtgtgaatttaggaggtggagtttgtagtgagttgagattgaattattgtattttagtttgggtgatagagtgagtttttattttaaaaataaataaataaatgaataaataaataaataaataaataatgaagttttgaagattttggaatggaaagttatagtggtttatttttttttttttaattttagttttaggggtatttgttattgtttttgttttagtttttttggtaaataattattataattttagaatgtgtttatatttttatattttgatatgttaattttagatattttttatgtaatatattgattttgaaatgagaaagttaatttttaatttttaatattttgttttttttttttaatattgatattatattattatttgtatattgggtgtttttataattttaaagagtgttgtaagttttttttttttttttttattagttttttatagtaaaatgagtaagatgttaggttttttgtgttatttatattttattttttggagttagtttttttattatagtgttagggttgttaatatgtttgtggggttttattattataattatatttgttatgtttttgtttatagattgatttttaaagttgaagatttagaaagtatttatagtattatggttgtggaaattttttgtgttgaattagtagaatgttaagattatatttaattttttgtgttagtttagtttttaaatttttaaattatttaatggtgatgtgtttagtattatgaataagtgttttatttatatttattttttaattgtttttttatttattatgttgttttttggtagttgatttagttttttttttattatttgtttttataatagttttatatttttttattttttaattttttaattatattttttgtatttaagggaaagttttttttttttttggttaatttatttttttgagaagtttgaatgaggaatttttagatatttttttgtgattttttggattggaattattgttttttaggttttatgattttaattttgttatttttaatttatttttttattttattggaatatattaagtaattttttaataatagtggaggtagaatttttgagtttttgtgtttgtgaaattttttttattttgtttttgtttttttttgatggtgtagttagaattttaatttaaaaggtttttttataagattttttaaggtattattatattttttattattatttaaagttgtagatgagaagtttgatgtttttttgatttgtatttttttgtagatggtttattttttttttttttggaaatttttgggatttttttatttttagtggtttgaaagtatgtatttagatgtgttttaatttaatttttatttttattaattttgtttatttttttatggattatttgaatttgaagatttatttgttaattttatggatgatttttattttatttttaataattttatttgttgtgtttttttttttttttttttttaaaattttatatagttgattgttagattttttaggttatttttgtgtgtttttttttttttttttgatattttgtatgtttttgtttttggttttgtgttttgggaaatttttttgattttattttttattgttttatattatttttaattttttgtagttataattttaatttttaagaattttaagaaattttttattgaaatttttttttaatattttgtttttgttttttgtatgtaatgttttttaaaattttttaaaagttttttttaaggttagttttttttgttgatattggttatttttatttttgtttttttttttttttataaaatttagtgatttttgggtgttattttttaaaattgtggagaaggatagttggtttaatgttgttttgtttggtatatggaaatttggatggatggatggaatattttgattatgtgtattagttggtaggattttttttagggaaatagggtggagtttttttatatgttagaatgaagagggtttgattttggggagttataagaattggtatggtttgggtattaataagggtgttatattaatttgttgggattaatattagaagttagagttggtgtgatttttgtggtgagtgtatttgtgtgatagatttgggtggaaatagggttttaaaatttatgttgaagtttttatttttttaggaaagtttattttgttttttgaaaaagagttataaaatttttatttggagaaatgttagttatttgtgtttatgtgttgtgggtaggagataggttatttgattgttatgggtgtgtttggtaaaagatttgtttagtttagggttttttttttttttgttttttagatggagttttggtttgttgtttaggttggagtgtagtggtgtgattttggtttaatgtaagttttgttttttgggtttaagtagttttttgttttagtttttttagtggttgagattataggtgtttgttattttatttagttaatttttttgtatttttggtagagatggggttttattattttggttaggttggttttgtatttttgattttgtgatttttttgttttggttttttaaagtgttgggattataggtgtgagttattgtgtttaatttagtttatggttttttaggtgaattagttgttatttgtttttttgtttttttgaagaatattttaggttgttgtttttttatgtattatgtttatttataattttagttttatttattatgtattttgtagaaatgggttgaaattttttattttaattttatgtatttttttgattgtgttaagagttttatttatagatttagattgttttagtttaaattttaattttgttatttttaataatgtgattatgggtaaattatttagtttttttgagtttttatttttttatatatatagtggggttgggagtagttttgatattatgggtttgttttgaggattaaattatttaatataaataaagtttttagaagtgtttagtatagagtaagggtttggtaaattttattttttggtattgttattttattattattataaaatttatttttagttttttattttatagaagtttttggagggataggtgagaaatatgtttgtttagtttgttattttgaattggaaatgatggattaaatatgttgtatttttgttagattgtaatagtgttagttaaatttaagatttaggtttatttttgttattttttggtagtgtgattttgagtaagtttttagatattggattggtttttttatttttaaaatgggagtggaaatggtagttgtatagggtgataataggaattaagggagataatttgttaagatttatggatttttatttttattattatttttttgatgttttggtttttattttaaaaaaaaaatattgatatattaaggatggtttatgggttgtttgattgatagtttttttttttgtatatttaagattttttttgatgttgttgaatttttttttataatttttttatttttagtttttaagatgtattttattttttttatgattttataaatttgagaagtttgaaaataaatgaatttaattttaaatttttatttaaaaattaggtatgtattatattttatagaattatttataaagattaaagaggtagttttttaaagatagtgatttaaaagttaaaaagttttttgaaaattttattttttgttattggaagagttagttttttattttttgagaaaaatgttattttttatttttttttaattaaatggattaaaaatagtaataattatatttaattggtagtatttaatagaaatatatgataggttgatagaaatttaaattaaataattgaattttggttaatattataatagataattaaagtgggtgatgttgttaaattgtgttttaaattgagtgtttttttattatagattggttatttaggtaagtttttttttaaatatttttttatatatgtatattttttttgattttatttttttattgtatattaagtttatttgaagatatttgattggtattttgttttaaatttgttttttttttttttttttttttttttttttttttttgagttagggttttgttttgttgtttaggttggagtgtggtggtttgattatggtttattgtaatttttgttttttgttttttgggtttaagtaatttttttgttttagttttttgagtagttgggattataggtatgtgttattatatttggttaataattttgtattttttttatagagatagagttttgttatgttgtttaggttggtttttaatttttgagtttaagtaatttgttgttttggttttttaaagtgttgggattataggtgatagttattgtattaggttttatatttgttttttaatatggtttattttaatgtttattgtattgtttaaaaattatgaatttggagaaataaaaatatgttgtaaaatttaggttgttttaaaattggaaaagttatttttagtttgttttaaatattattggagtttaaatattttaagttggtattgtattgaaataggttatttttttatagaaattggttttgtttaagaaatgggtatagtgaattatggggatgtatgtgtgttgtttaaaggtattatagtttgtaaatagttttgtaagttagattttattgagaagagggaagtgggtagatttatgagttttaaatatatgttgtttattttatatgaagtatatgttagtgtgttttttttttaaattatgtatttttgaaaaatgtgtaatgggttgtggtgttagagaaaaatatttttattttagtttggatagaagagtatgaggtagtttgtttattgtaagtttgggattagttttgaggtttgtttattgttgggtttttttggttgaagttaaaaaggtttgttattagaaggagtgtttgtaattaagagttatgttagaagtgggaagataggttgttatttagagaataagattgtgtggttgaaagttggtgaaaaattgaaagttaaaaaaatttaaattgaaagagttggaatagttttagagttgaggaggttatattgagtgtgggagtgtaaagtgtagatggtttaggggttggttgtggattgatgtttgttattgggtttttttttggggtttttatttttttgggttggagatagttttgtaatttagaaataggaaggttatagttttttagttttttaggttgatttttttttaataagtgggttttggaatttagattaaagtttagagtagaagaatgttgttatggtagttatagaattgttggtttatgttaagtgaggtgtatatttttttgaaaattttaaatattgtgtagataaaatataagattatgatataagatagtgtggttatgtgattttttgtaggatatattatatggttgattttggttttttttatttattgtttattaggaaatttagattgttgtttttaggaaatttagattattagttgtttagttattttaattttattggattgtggtttgtatatttttttttaattttttttaggttttgattatttaaattgttttttgattagatttttttttagttagtattttttattttgtgaatttttgtatgttggttgaaatttttaatgaaatgaggtaaagtattaaaattatattattttagattatttgttgaggtatgttataattttatttagtatgagaaatagttatataggtgagtgttgttaaagtaatgtgtgtagatagatttgtgtgatagaataagtggatgttgagaagttttgtgttgaatgaatttgattatagtagttttttttttttttaaatgttagaattttttagagaaatataggtattatttttttttttggtatgatttggaaaagttagtatttttagttttttagaaaggttttagagggaattgttttattatttaggttttaaattttttttatttgtagtatatgtgtgttttaaatattttttttttttatttttttaaaaaaattttttttaagttgaattaggtttaaggatatttgtgtgttgttgtttttttaagttttaatgtgtagtgattttgtaagtaagttttaatattttagtatttatatttgtattttttttgtgaaaatatgtgattttattaattgagttttgtatgattattttttgtgtttttgagttattttagatatgtagtttttttattttggtgtttagttttattgaattttattgtatagagtttgtatgtaaatgttgtttatagttatatttttaaaaataagaggtttgttttttgaggatagttttgtattatgggtagagtataattttgaatattgtttttttttgtttttaaatggttggggatagtgagttaggagtgagaattttttttgttttatgttgtgtgtatggtaggggaagaatgttgtagggtagaaaatgaagaaagatataaaaggattttagtttaaggaggttagatttattagaggtttagtgttgtttttaaagatgtttgggataggtggtagtttaagataattatagtagtggtgtttgttggagttgagataagggattgttgtggaagtttgttatttgttgtttgtttgttttgatgtaattttgttagtaagatttgggggagtagatgattgtttttttttgtggtttgttgttgttgtttagttttttaaggttttattatagtgttttttgaggattaattttttttaaggtttatatgagatggttttgtttaagggtttagatagggattttggtgttatttgtataaggtattatggtaggtttttttttttttttatttttttaagttgttggtatttataaatatttgttagtgtgaggattgtaagtatgtagtattttttgttgatttttgttgtgtttttgttattgtgtgagtaatattgttagtattaaattgttagtttttatttttttattttattttttgttaattgtgttttttttttgaaagaaaatttgttgtagtttggttgtagaagggattgttgagtttttttgatttattgtttttatgaaatatttatttgtataatttgtatttatttggaatattttattttaaaaatatattttttgagtgagtaaattaaattgttagattttattagatttgttattttaaatattattatttaggaaaagaaaagtggtagattttatttttgattttttttatatatatagtagtattaatggtaataattaaagtaaaaattattttttgagttttagaaataaattttgttttgatattttgaatttttagttgaataaagtattttattgttatttaaaattttttaagtggtatttgaaggtaagtaagttgggaattttgagattagtatttgaatttggttttatgatattgtatttggttttttatatttggttggggatagagatgattttgagaattattaatagtatatggatgttttttattttttggttagtggtttagggtaattttttgttgttagtaattaaaaggtaatttatatttaattgattgtatttgtttagtttttttggtgttggtttggttttgtaggaagaggagtatttagaattaaaatgagtattataattggtatatagttttataataagtgttgtttatattttttgtaggttagattttttataaatttgaaataatttttaaaataatagtagaaataagttaagtttttgtagttagtttagttagggaaaaagatatagttatataggttatttgatattttatagataagtatgtgtttggtttttaaatttttgtaaaggattgttttgtggtgtgtttatattgattgatagttattaaaaggaaaattattttttgagatggtttattttaagggtaatttttttttatttatgagtgagtaaataatggaaggtaagataagatagtggggagaggtagttgtggtgggagagttgaataaagtagaatgatgatttggtgggtattaggggttttgtttttgaaggtgattttttaaattgtagtaatagaattaattttgtgaattttggtgtgattatgtagtattttggttttgtgttagatttttgaattagaatttttgagaattggattttaggttttgtgtttttaataagtttttaaataatgaagtgtgagaattattgtttttaaaggttagatgttaattttaatttttttaagtttttagttggtaagtatttatattttttgttttaaaaagattttgtatatttgtatagttagttgtggtatattagattattttttgaattatattttatttttggtaattatttaaaaataaaattgaatatttatgatgatattaatttagtattttttttaataagtaaagatggaatattagttattttatgttatggagaatttttatttattttttaagtgttgtgtttaaattgaattaataataagaagtaaggataatttgtataattatgtttttgtatttttgaatttttttttaggaaatagaaatatatatatttttgtatgtattttaatgtgtatgtattttggtgtgtattgttaataaaaatatagattttattaaatatgaaattgtttttatttgttagaaaaattattaagtttgtgaattagttttttattattattttttggttaagatattgtatgttttttaaaggaaggttttattgttgagattagtagatttaggatgtagaaatgttggttgagtgtaattttttttttggaaatgtgaaaatagagttattaattattggtgaaaaaagtgttggtttggtttgtttaattgttttattaaagtggaagatgttaatttaagggatgagtaatatatattttagatatatgtatttgaaataaatgttgataatggatttgttaattgattttattgatatgaatgttaatattttgttagtatttgtgataattataagaaaatagtagaggtgtagaatataataaaaagtttgaagtagtataagttttgtaattaatatttagatttatttttttggatattttgattgtaaggtttaaaagatatttttgtgtgttttagtaaaaatattttgtatttaataattttttattttgtttaggttttaggaaaatttgattattagaaagttaggtgttttttttgatttagtatttggtatagaggggattattatagttggttttttttatttagttttattagttgattattttttagaatatatttgatttgtatatgtttttaataaagaaaagataggtgttggtgatttggttttttggaggaaaattagatgtgattttggaattagaaaggataggattttagttttagttttttgttggttgatttgtgtaagttatttaattttttagttttttttttgatattaagtatttgttttagatgattgtatgagggttgagtatttggatttagatattgatattttatatgtattttgttatgagagtttatattggtatgaagttttttttttttttaagtgattgaagtttgaatatttgaggtatagaatagtttagttttttgttttaataatattatttttggttaatttgtggttatatttatagattttatggtttttttttaataaaaattataaaaaatttgattttatgtgattaggaggtgagggttttataattggaaagattgtgtgaaagttaggatttttttaataaaatatatatatataaaatataaattatatataatatatgatatatattaatatatataagtatgttatttgattttttggtttggtttatttttattaaatagtattttttattttaatatttttttagggtttttaatttatttgtttttatgttatagatattgggagataatttgtttgtatgttttttgatttaaagttataggtgtggaagtttgggaggtaatggtttttaagttaaggggagaggggattggttgttatttttgttgttagttttagaaattttttatttgttgtggttatttggtattttttaattttaagatttggggtttatttattattaatgttgaatttaagataattagagttgttgtgttgagggatagagaagtatatattagtttttgttattgttttttggttttattttgatttaaaataatagtagttggtatttaatgggtgtttattgtttaggtgggtgtatttttgatggagggggaggaggtggggatatgaggattttgtatttttaagaagagtagatatataaattggaagttgttattttttagtttggtgtatttatttagatttttaagggatattagatggaaggaaaagtaggtaaagattaatgtggaagagagggtaggggtttgggaattttatatggagataatgttgttagttatatatttaagtaggttgtaattaataattgttgattaaaataatatatattggtattttgtttttgttatttgttattttgggggtaggggtagtaggtattgtttatttttattgtattaaatttttgtttatttgttttttagattagtatttattaatatgtggttttaggatatgtagtatttgtatttttagggaatttgttagaaatggtattttttgtgtattttttttgttttattgaattagaaatttttgggttgggatttagtaatttgtgttaataagttttttaggtaaagttgatgtagtgaaagtttgagattattgtgttaaggagtattatgtagaataatttgggtttgttattaagaggggaatattgaggtaggtggggaggtgtgatttaagttgaagagggaaagagagttgtttgtttggttttttttgattttttgttattggtaaattaaaatttaaagtagttgatggtataggaatttagatgtaggagttagtgaatataatatttttttttggtggtggtttgtttaagttatttttttattaagttgtaattttttgagtttgttattttatattttatgaatatgtgtttatttagtatttaggtttgtaggtggtaatttaagaataataatagaaattttatgggagaaaatgataattgttgatttttaaatattggatttatggaaatttatgaatgtagaaaaaaagttaagttttataagattaaattagaatagtatatttggagttatgtttatgtattaattttaagttaagtaagaggtagtagttatttagagtatatgtttaattttagttttttttttatattttttgaaatattgttttgtttttttaatttaaagaaatgaaaagaattaagtattttatttttttttataagatattaaggagagggggtaataaatagtattttgttgatgtattttaataaatattggtttattgtattttataatggaaagtaaatatatgtaattatttgtaaatttttttagtgtttgtatttataaatttttgtttaaatttttttagttgggagtttagttagtttttttgttgtggaattagggttttgtttttttgtttaattttggtataagttggaataatttagaaatgtattagagagattgttgtttttaaaaggtataaggaaataatttttatttttggttttagagaaattagtttaattagagtttgggtagattttttgattaaataaagaattaattgtgtataaattgtattttaataatttgtaaggtgtttattttagaaatgttttgtatatggaaagttgatattttttaattagggtagtggggttgttaaagttaaaatgttgttagtatttttttattattttatataattattattttttgtaaattaaatttaaagttgtatttataagtagtttttagttttgagatttatggtattgggttgttaaatatagatggagataattttttttataagtgtgagggtttagggtgtgtgtgtgtgtgtttgtgagtttgtgtggatgatttgatttatttggaatatatttttgggagttttgggttgttaagttttattttagtaaattttatattgggaattaaatagggggtagaaagttattgtatttaatgttgttgtgattttttttgtttttagttaaattatttagaaattaaagttaggtttttgtgttattgtggaatgttgtttagaatggattttttaagagggatttagtagatttttgttgattgttaagagatgtttttgttaaattgttatttttgtggtatttttagaaaagtgattgtatttttttataggaaatttgggaatattttattttgtgttagttttttatttgttttgtttgaggtatttttgttttttaatgtagggaagggatttagttgatataataagtaggtatttttaagttttaatgtttagggtaagaattttttaaattttagtatttattttaagaagagagtgtatattatagttggttttggttatgttattttggtttgaatttgatagttttatatttttagtgtagtagaataattaagggtgttggtaaggatggtttgggatggttaagagtaaatagaaattatagtttttgggttttatagaaattttgagattttttatgtgatttaaaaattggttgaggaaaaatattgaaaattgttttttttatatgttttttttggtttttttgttttgtttatatagaaatgtagatataggatatatttattgataagatttttttttttaatagaagttggaatgaaagaatatagtgtgggagttagaggttttggttttttttgttggtgtgttttgttttgttttttttttttttggttgagttttgttatttgtaggtgagggaagtttttattagttttgtttgttttttatagttttggttgtttttaaggttgtaggaggtttatatggagagtggttgaaggagttttgttgaattgtgaaagggttatttaaatggtgtttttttttttatagttttgggttttatgatgttgagtttgaaagagtttgaaagagtttgttttttttttaaaatagtgatttgttgggttttgatttatagttattttatgtatgttaggagtttttaaatagtggtgatagtttgttattttatgtttattgtgttaaatgagtaagttaagttggtgagaatttaaatttggaaattagaaggttattgggttttttggttgtagtggaagtggtgtagtgttaaggtgttaagatgattatgttattttggtttgaatttgatagttttatatttttagtgaagtagaataattaagggtgttggtaaggatggtttgggatgtttaagagtgaaaagaaattatggttttttgggttttatagaaattttgagattttttatgtgaattaaaaattaatttaagaaaaatattgaaaattgggggttaggggtttttagttgttgtgtgttagatttggtgtgattagaaggtttattttgagttatggtattgttattttttagttttttattttttttaaattttgtatttattatttgaaaattgaggataagtatattgtttttttagatttgttgtggagaatttagtgagaaaggaaataaaaattgtttagtttatagttaggattttgaatttaatgttgttatttgtggaaattatttgggatttaatatgtatattaagaaaataaaaaataatggaaaggtgaaaaagtttttgagtgtattttattaagatgattaagttttaaaggggatgagaatatttgtaaatttgaagttggtattttgagtttttattaaaaagaaaaaaatttttgtatgaaaggtaaatttattttatttttttttgttaagtgtttgagagggttttttgatagttttggtttattaagtatattttgataattttatttgtagtgttagataatgaattttattgttagagtggatatttaattaattatggtgttgtttttttatggagatagtggtagttatttaagggttagtatttttttgattatggaatttgtagtgatatgtagggtgggaaagttttgagttgggtttttttttaaaatggtatttaaatgtatattagatttatatttattattttaatttaaattttattgtaaatgaatatgtatggtttttgagattatatattttgttagaaggaggtttatgtgttggtagtttttgtttgaaatattatttgttttatttttttagtaaaagtaggtatttaataagttaaaattatttttattaatgagttttggttttttttaaagttggagtttttaatgtttttttttttgtatttattttattgggttagaattgtatttattagatgggaaagtttttttattaggaatgtttagttattggttattttttttaaaattgagttatggtaatgagtgtttaagtgatttgttatttttaaaattgtttttaaaaggtgtttggtttttggtattgtaatatgtaaaatatgtaaaattatttgttagataggtgatagttttgtaaataaaggattagaggtatataagggtgtatttaggtggtgtgaatgaaaatgttgtttaaagaggtatttaggaatttagagttttggtttttttgttggtattattttttttttttttttttattattatttttttttttttttttttttttttgtttttttgattaatttattgagtgaaattttaatattgtatattttttgatatagtaatttttgaaagttaatattaaaagttagaattagtttaaagaattgggatttttataaaatagggaattttgttataggttgagtgtttatttataatttaaagtgtgtattagtatgttgtagttttggttttgtttttggaggaaagatattgtttagtttataagtgatatttgtgtatggttgaatattggtaaagggaggatgtagataattttgtagatttttgagaattgttgtaagtagttgagagggaaggaatttgaaaaggatatttttggttttatgagattataataagaggttttttatgagattttttattaaattatggtgtgttaaaagtgatggagttttagttgtttgtgtttatggattttattagtgttttgatatattttgtgttaatatttttgaaaatatatagtaagatgatttttgtaattgaggtaaatttaatttgatttggagaatgttttggttatttttggtaattaatgttgtgtttttgtgtattagaggtggtttgtttggtaatttttaagttgtttatataataaaaataaatggatagattttatgaatgggttgaaaatagatttttatgtatttagaaaggggatggaaagttttaatttttttttttttttttttttttttgtagatttaaaatttggatttgattttttgggtattaatgaagttttttagtttatttagtttatttatttagttttaaagggttaaaatttttgaggataagtgttgtttatgggttgagtattttgttttttttttttgttttttgggtgaattttatttagtatttatattttattatataaattaaattatatgagtttgtgtgttgttgtttaaaatgtagaggtttttaatttagtatttaaatagggagttgtatttgaaggtgggttttataaaattgtttttttttatgtttgaatttgaattttttatatatgtgatatgtttgggatttggtggtttttgttaagataggttttgtagaaatgtgtgttttatgaaaagggtttgttggtgtttttattttgttgtttggaaagggtttttgtttggttttggtgttgtttaggttgttttgtgagttgatgatgttttttttgtttatttgaggtatttttttttttaggatttttgagggaaaatttaagataatttataataatttttattttggttttatttttaatatagttgtgggtagtatgatagttgttaatatttgttattaattttaaattatataatgtgttatgaaaataaaaatttttatgttaatttttttttatttttagaggggataagaaattatggagagtataaaattgattttgtatatttgtgattattttaaaataattttatttttaaaagaaattttgttttttttttttaagtaattaattgttttattgtgtttttgttgtgtgtaagtttggttttttgggagataaaaatttttagttgtagggaaataggtgtaggattttagtgttatagggtatttaatagtagtttgggggtttgatagagttaatgtaatatttatgttatttgaattattaggagtttggtagaaaagaagagatgaattatattggtttttatttagagattgaaaatttgtggtaatttgaagtttttgaaaatgtaggaaaatgggttgggtatggtgggtatatttgtaattttagtattttgggaggttgaggtgggtaggttatttaaggttaggagttttagattagtttggttaatatggtgaaattttgtttttattaaaaatataaaaattagttgggtatggtggtagggtgtttgtagttttagttatttaggaggttgaggtaggagaattgtttgaatttgggatatggaagttgtagtgagttgagattatattattgtattttaatttgggagatagagtgagattttgttttaaaaaaaaaaaaaaaaaaaaaaagtaggaaaattatttggggttaatataagaaaaaggtttatatttttgttttttatttttttttttttttttttttttttttatttttttattattgtaaatgttttgttatttttaaaattatgttttttttggttggtgtggtggtttaagtttgtaagtttaatattttgggaggttgaggtaggtatattgtttgaggttaggagtttgagattagtttggttaatatggtgaaattttttttttattaaaaatataaaaattagttgagtgtggtagtgtatgtttgtagttttaattatttaggaggttgaggtaggagaattgtttgaatttgggaggtggaggttgtagtgagttgagattatattattgtattttagtttgggtgatagggtaagattttattttataaaataaataaataaataaataaaaaattttttttgatttgtatatatatatatatttatattattagatttttggaagagttaatataggtatatattggtaaggagttagttgattttagggtttttggaattttatagtatagtgtggatgtgttatttagtagtgattgaaggatatattttttttttttaagtttttttattttaataattaatttaattttttatatatatttgttattgagaaagtatttttgtattttttttttttttttttaagttaaattgtatttagttttataaaagatatgttttataagtaattattgtattttaggtaggatatgggtagatagttgttaatagtatataataatttttaaattttttttttttatggattattaataattagaaagttaagataaaatttaataagtttttatttgatgttttgaatagggtaagtttagagtgagggttgatattttgtatttagtatgttgtttaataattttttataagttgattttgatttttaggaagtggaatgaaaatggtagaatttatttgaagatttataatttagaaatggaattattgtttttttgaggggtgttattttattgttattattggaaagtttagattgtgtgatatattggtaattaatgattggggattatgttttaatagatgtttggttttaagggagttaagtttatgttgaaaggtggaaagggagaagaggatataaaattaaatttgttttttttttttataaggtttttgtgttaaggtggatatgtgtattaaagttagggagttttttttttttttgggagttaagaggaagttttttagaattagaagggaaagggaaaggtgttttttttatattagtttagttttagagatattttattagggatatatattttgttttttaaaaataataatgaagtgttttgtgtgttaataatatagtttaaagtaaaataaaattttgtatttttataaaatttgataaaaaatagtattttaaattgtatagttattagaagtatatagttattaaaaatgtagatattttatttggtatttttagtatttttagttttttgggtttggttttttttggtaattttattttttgtagggttatttttttttttgttagtattagtttttttttttttttttttgggtatttttttaggggtttttttaggtttgttttggttttggaggagtaggtttagtagataattttgtggattttttttgtggtttattttttattttggttttattttttttagtattttttttagttttttttttgggtatgttggtaataatagtgatgggatgtaggtgttgggtataggatgtggtggtgtgtgggttttggttggtttgggggttgtttttgtttttttttttttatattgttttgtatttttgtattttttatttattagagatgtagatattatatgagtatttttggtattttttgggttttatttatttttgagatagagttttgttttgttgtttaggttggagtgtagtggtgtgattttggtttattgtagtttttattttttaggtttaagtagtttttttgttttagttttttgagtgagtagttgggattataggtttttgttattatgtttggttaatttttgtatttttagtagagatagggttttattatgttggttaggttggttttgaatttttgattttaagtgatttgtttattttggttttttaaagtgatgggattatagatgtgagttattatatttggttttatttatttatttatttttaattgaatgtttttttttttttgggtaggttgggatgtatgattttatgtgggtatagttttttggtgtttagatatgtatttttatagtggggatggtagtggtattttttttatagggagaatatgtttttagtttatagatttttttgatatttagtaaatgttaggtatttttatagttattagttgaaagaatgttggttgggattagaagtatattatatttaatttaaaaaattttaatgttaattgttatgggaaataatgggtatatatatttatgaagtataagtgatgttttgatataggtatgtaatatgtaataattatattagagtaattgaggtatttattttaagtatttattatttttttgtgttaggaatattttaattttattttttttgttatttaaaatatataataagttattgtttattgtagttattttgttttgttattaaatattagattttatttattttatttagttgtgtttttgtttttataattatagaattatattttgtggttatataattaaataaagttaagtaggttattgaatagttgagtttaaattttgttttttattaattgaagatatttggttggttttttgtttataataatagtggatatagttttttggggtttagatatgtatagtgaggtataatgtatttggagaaaaagtgttggtttttagaaagagtttatgatattattatagatggtagatgaaatttttgttatgtagtgaatagtggggtaaaattttttttgttattgtttgtgggagtttttagtatttggtatatttttttgttttttataagttttgtgtttgtttttattggttttattttttattatttttttttttgggtttttattttttggatgtttagggttttatattttggagttaagtattagggtggttattttttggattttgttttaatattttttatattgggtgtattgtttataatgggttatttagtgtttttttagtttatttgtaatgtttatgattatgttatagattgtgtaaatttaagttattttatttggtttttgtgtttttttttttggattaaagagagtgagttgaggaaagaatagagttaggtgagttagttggtagaaaaggtgtttagttttagggaagtttaagtgttttagaattttattttttgttgttgtgttttatgtatttgatattggttatttgaaatattttttattttttttaggtttgtttttttgtttttggtttatagaaaatgatatagttttttgaagtattatttttattttatttttggtgttttgtttatgtttgggttgtggtaatggtttttagattttttgttttttagtttgttttttatattgttgttttgttaatttttttgaaatgtttttaagattatttttttgtttagattatagttatttattgataatattgtttagattttttgatttgattttttgagttattttgtaatttggtatttatgagaatatttttatattgttgaatttgttttatttgagtagattttatgttgtagtttgttggtatttatatttgattttagtattttgtatgtatgttttgttttttgtttttggttttagtttagttttatttttggtaggagattttttggtaaaatttagtgtggataagggttgatagattatgtaagttgttatttatttattatttattttagttaattttgtagtaagtttttaataatttttaatattgttttttttattttggtagtaattatagaagaagattgaggtttatagaagatgaatagttttttagagtttgtatttttagtggtagagttgggatttaaatttaagtttgattggtttttaaagtttgtgttgttttggatttttgttgtttttaaattattataggtttatgtgttattaattagagttgggagttattttgtattgggtgtttattgtttttggggtagataattattgaataagttgatgttgttttttaggaatttatttattaaaagaaataaaatgtgttggttttattatttatttatttaattgtaaatttttttttttttttttattatttaaagttagtatgtgttttattttaattaaaaataatattttggaaataatttaaaaatagtttaagataattgtaatattgtggtatttataaaattaagtgttggttttttgtgttttgtagatgttgtgtagggtatgtgtttttgatttttgttttgaattattgggtttattatggttttttttttatattgtgggtttgtttttttttggatttattatggttttaaagtaggtgattgtatgtggaaataatgaatgtttatttttgttgtttgtgttgttgatatggttttttgaatgtttagtatgatgtagatatataataggtatttaattaattagtatttgttgaagtttgaatgaatgaatgaatgaaaatatgaatgaatggagatgtatttttatttgggtattttatgttggatttttagaaaagttggttgtaaaaggaatttttaaaattgaattttattataaaattgaaaattaatttatttgtatggagatattaataataaattttggaaatatttgaagaaaggaataagatagaggttggtttttttgtttttttgttatatagaattttttgtgagatttttttatttattattttatttttttttggtattatttgtggttgtttttaggtattagttatgatttttgttgttataataaaataaagttttatataagaaagatatgtatatttttgatatttaattttatttatagaaaagtaatgtttggttttttataaaaaaagtattttaaagaggtatagttagtatttgtagtaaagtaatttataatttattgtttttttggttagtgtttttttttgttaggtaaagttaaaattttttttttgtaagtggaaaagttgatgtttataattgttgttgattgtgtttattttagagtaggatgtttttttttgttaggaagatgtttagttttagggtatggaatttgtttttgttagtaggtgtttttttattttatttgttgattttttattgttttgaaattttttgttttagaggttagttttagttttgggaaaataaggttttttaaataaagtttatttttgttttgttgtgttttatttgttatttttattgttagtttagaatgtttaattggaaaatgttagtgttttgttggtttttttgtagtttttttattttttgattgtgtggttttaagggtaggatattatgtttttatttattatagtttttaggttattttttttttaaggttttttggtgtatattagttaaaatattagtaatattttattatagtttatggggtttgtgtgggatttaaattttttgaggtgttagatttttaggaattttattttttaaaatatggggttgtttgttagtgaaagtaatgtttttttttatttagtttttggttgttttgtagtgattgtgatgaattgtagatttgtttatggatgttggtagttaatttagttttgtaggaggggttggattaaagtaaggtgtttttatttagttgggaaaataaaagattgtagggggttatggttaaatgtttattagtatttaaagagttattgtatagaaaagtaattatatttaatgtaggtggtgttagaatgtagtgttaagatgtattgatgggttgggtaaaagttagagggaggttagtgtggtggggtggaggggataggattttttgtgtatagagtagtgtgaaaggagggtgatggtgttagatttttagtttttagagataggggtgggagggtgttttaggttaggttggatgattgttggtggagggtgggatggggatgttgtgtaaaggatttttgtaagggatggttgtaatagataaatagataatttaaaaagatgttttttagttttgaaattttatggttttattatgttaaggtaagttattttagggtagttttattttttttttttttttttttttttttttttttttttgtaattgtggaatttatttgtgtgtgtggtttatgttaaagaagttttaattatgtattattttttatttttttattttgaaatggttagatttttagttgagttgtgtttgggtattgtagagggaggtagggtgtttgtgtatagttgtgttgggtgtttattgtataaaggatagaaataaggggttaaatttgaatatatattttgtttattaagttatttagaggaagagtttatttttttagtttgtggaaagtgttattagtttattaagttgagtgttagaggggttaggtttttttagaagaggtatagttttttaatttgttagattagaggtttttagtttaatttgaagatgttggttatgattttagagggaggtataatatattatttttaatttattaggattgataaagttaagtttagatatatttgtgaattttgtggtgggttgtataaatatagtgttaattattgttattaatggtgtaaagttttattaagtatttatgtatttttgtggatttattaagtatttaggtttttggaagtatttggaggatttgtttaagtttttattttttatttggatatttgatattgtgtgtatatagttttgtgtattttttttttagtttaggagattttttttgatttttttatttatttttaatttttaggggtaataaatttggttgaaaagtagttgaggatttatgaatgtgaggtatataaaatttttttggatttttagatttatattaaataaatttgtgagtgtgttagtgaagaggaaaaagtttaaaaaatttagtatgttattggtaaggttggttattttttaaaataataataatagtaaataaaatggaaataaaatataggttgtgttgttgatagtaggtagtagttttttgagtaggtgtgaagagatgtagagattgttgtgtatttgtgaagtgtttttagagatagattttttaagtttttttttattttttggttttgttattgttttttttttttttggaatgtggaggaaatattttttatttatttatttataaaaattttggaagagagttattttttttttattttttttatttgttagtttttgttttgttttttggtttttttgtattgtttgtttttagtgttatttttagttagtaagggtagaatttttgttgttttttgtttttagtgttagttttgtgattgttgttttgtgatttgttttttatgtttaaatatttttagttgtttgagttgaatatattttgtgtttttgtgtaagtttatgagttggtgttatttttttttagttattttgatgtttttgtgtttttgttttttgtttgtttgtttgtttgttttttttttgagatagggttattgttgtttaggttggagtgtagtggtgtgattttggtttatgtagttttgattttttgggtttaaggggtttttttattttagttttttgagtagttgggattatagatttgtatttttatatttggttaattattttattttattttattttattttgagtagagatagggttttgttgtgttgtttaggttggttttaaatttttgggtttaagtagtttgttagttttggttttttaaaatgtgaggattataggtgtgagttgttatatttgatataattttgtgttttatttttttttttggaaatttttatagtttttaattattataaattagtagtttttatattgttggtagtaagaaatggaaaaaatatttgttttttttattgtttttttttttttaaaaaaatattgtggggtagatattaatatagggatattagatatttgtttaaatatgggtatggtagggttggggtaagttgggatattggaaaatagtaaataatttttagagtattttttgttgttattattattttataatataaaggttgtttttatattatgaagtaggaagaatagattattgagtagaggatattttttgaaaatgagtaattttagttgtgtgaaatatttattattttaattttttttgtttttattttgtgtttatttattttatataattatagatttttaattagtatgtagaggttattgttgtaaatgattttaaaagaaggagtttttttgtttagtagtaaaataaatatagagtttattagggaggtttattttatttgggtaggaagttattagatgttttggtaggagtttgtttttgtttatgtggttataagatttgttgtgattagggtttttattgtagttggagggatatagagattaggagtattttgtagtttagatttttgtaggagtaagaggggtgggtattggattttgaggttttaggttggggatagtatagttttgagggttaggtgttgagtgggtgtttgtgagtatgtttagtttttgggttgtgtttttagaggatgtgtagatattagatatttatagtgagtagtatggaaattgtgggttgtatgaggatgtttgttggatggtgaggttaggttgtttaattatggaatatgttggaattgttggggagatggaggttagaaaatatatgtttttttttgtttgtttggttgttttatttttgttttttttggtttttatattttttagtttgtttggttaaaaattaaatgtaaaaaggatgagagaaatttttaggggttaaaaggaaggtttattattgaggtatgtattgagaaatttgattttttggtggggtgtttgggttttttggataagtggatgtattttgggtgtgattttatattttgtttattaaaattagttttatgtgattgtagatgtggaggtgtttgtttatgagagatagagttgtttttttgtttgaggaaaattgatttttatttaatagatgtgtatggagagttggtttttttgaggttagtattggatatatatagtttattaaggtttagttttaagtgggaggatttatattttgtagattttgttgtttgtttgatgaagtggaattaaagaatgttgtttttaaatttagatgtatattttttgaaaagattttttattatttgtgattaatttaagtatatattattttttttttaaatttttttttgattttttttttttttttttatggtgttattttatttttttattttttattttttttttatttttttttgttttttgtttttttttttatgttagtgtatttttttttttatggagttttgtttttatttagagtaatttttataaatatttgaaattaaatttatgttttttagaaataagattttttttgaaaatatattttgggtgataaagatgtaatttgtttttaaatttttttaaatttgggtgtaaattatgaaatagaaaaaaaaagaagtagttatttagtatttgattattagtttatattaagttaagtttagtgtgtttttttgaatttgtttatttgaatttagggtatatagtagtaggtatatgttagattaggagttagaaatatatggttttaggattggttatgaaggatttagggtagattatttattttgtttgaattttagtttttttatttgtaaaatgaaggtaattttatagtgtttttttggataaatttagataataattattaaagtttttggtagtattatagttttaatttgtttaggttgttgtaataaaatattataaatggagtggtttataaatagtagaaatttattttttatagttttggagattgagaagttttagattaaggtgttagtagatttgttgtttgatgaggatttgttttttggtttatagatggttttttttttattgtgtttttatgtggtggaatggttaataggttttttggggtttttttaaaaggaattttatttataagggttttatttttatgaatattttttagttgttatattgttaaatattattatattggggattagagtttaatatgtgaattttagaagaatatatttagtttatagtaatgttgtaattttaaatgtttttttgaattaatttatttttaaattttttttaagttaagagtttgaattttagaaatgtgtgtttattaaatgatgattttataattttatatttattatatatagtaattttaggagtggtttattgatttagtaaatatttggaaatgtttattttatgttagattttttgttgtgtttatgggatttaaagattagtaagatattttttttgttttgtttgtttatttattgtagagatgggaagtgggaaatgttagagtggatgtgtgaataaggttggagggtgtagatgttagggtgtttttataggagattgaattgggtattgaaggatgttgggtatgtagtatgtttaggtaggttttatgtgatgtattatttttttttttgataatatttttaatttagattaatgttgatttttggagaagtgaagtttaggattttattgaagatgatagatttttaattattggtttaattgtttggtattattttattttttaatgtttttattttttttaagtggagattgtaagtatgtttatatatttgtatagggtattaaataaagtatattgtttttagagatatagtgaatagttaaggaaagagatgtatagtgaatattagaaagttagttggttttttatgtgatatttatatgtttaatattattattagtattattattattattgtttttattttttttattaattttgttattatttatggtttatggtaatgtattattagattgtagtatttttatttttattttttttttttttttgagtttttttatatgttaatttatatttgaagtttgagagatagatttagggttttattttgattttttattttgggttattttgggtgtttttggataggtgatttagtgtttttatgttttagtgtttgtagttgagaaatgaggatttagatatttatgttattggaatgtgaaaaggattgggtgaggttatgtgtgttaagtatagtatttggttaaagtgtaatagttgaagaaatagttgtagagaggttttttaagtattttggagaattagttattttggttttttaattatatagtgagttgtttttagaatttgaattaaagttatagttttttgttttttagttttgtttttttttttaataagatatatttgatttttgaattatgttattgtataaattggagattggataaaaagtttagttatttatggtattgtggggggtttaaggatatgtgtataagtttttgatatttttgtttttaggaggtgggattttttttttttttttttaatgatttatttttagtgaagtgatgggatggtatttttaaaattagattataaaaggattgtgatttaggtggtttttttgtttttttttttgaattttttattttggggtggatagtggttatgttatgaggatatttagttggtggagaggttgtatggggaggagttaagtttggaaatatatttttttttagttaggttttgaggtgattgtagttttttgagagatttttagttggagttatttagttaagttgtttttggattttttattttttaaaagtgtgagttagtatatgtttattatttttatttgttatatggaaggttaattgtgattaatttagtatttatttgtagaatggagtttaaagtgttttaagttttgagtttgttgtatgttataatatgttataattaggtatttttgtgttagtgtgattggtgaattgagatggtatttttatatttttgtatttagggggttgttaaagataaaagttttaaatgattttgtttgatttagggataagttggagtaggattgttgtttatttgtagtttagtttattatgtttgagttttagataatttatgttttatagtagaaatatttagaattataaatgttttaattttaggtatgggaagagatttggtgtaatttgtttggtgaggtattgaagtttaagaagttaagtgtatatttagtttgtatagttgtttggtggttgggttgttgaggttttttttttgtattagttagggttattgggttatatgtaatagaaattgattttaatttttgtattaataggaattgttgggatgatatagaattgttttaaaattgttagaaaattttgagaagtaggtgttgtagaggtataggaagtaggtgtgagagtttttttgggggaatgagttttgattgttttttttttttttaatttaggtttaggatttaggtttttagtagaggttgtttgttattagagttaggtattttggttgttttgggtagtgaggtttatggattttttaaaaaaatgattttttagggatttagaattagaaatattatttgatttagttattttattattgggtatatatttaaaggattataaattatgttgttataaagatatatgtatatgtatgtttatagtggtattatttataatagtaaagatttggaattaatttaaatgtttaataatgatagattggattaagaaaatgtggtatatatatattatggtatattatgtagttataaaaaatgatgagtttatgttttttgtagggatatggatgaaattggaaattattatttttagtaaattattgtaagaataaaaaattaaatattgtatatttttatttataggtgggaattgaataatgagattatatggatataggaaggggaatattatattttggggattgttgtggggtgggagagggtggagggatagtattgggagatatatttaatgttagatgatgagttagtgggtgtagtatattagtatggtatatgtatatgtatgtaattaatttgtataatgtgtatatgtattttaaaatttaaagtataataataataaaataaataaataaataaataaaaagatattagtaaatgaaatttagtagtatattaaagtaattatatatttaaaaaaaaaaattgagatagagttttgttttgttgtttaagttggattgtagtggtgttaatatggtttattgtagtttttattttttgggtttaagtaattttattgttttagttttatgagtagttggaattagaggtgtatgttattatatttggttaatttaaagaaaaaaaaaattgtagagattaggttttgatgtgttgtttagggtggttttgaatttttggatttaagtagtttttttattttagttttttaaagtgttgggattataggtgggagttattatgttagttttggattttttatttattattttagaatgtttaaatatagtaggagagaagttaattttgtaaaggaaattagagttttgtgggaagaaggaatagatgttttatagttagaaaatgatgatgggtatattgtatatgtttttttttttttagtttttttgagggttgttaggttttttgttttttgttaatatttattgttatttttatttataggagaagagaatgtagtttttttaaaagttattggtatagggtggtttttttaaaataaaattgtaaggaaatttaggtgtgtatgtttgttagtattgttagaataaggtattatagattgggggtttaaaataatagaaatttattatttgttagttttggaagttgaaagtttaaaattaaggtattggtagggttattttttttttgaaattttaagggaggatttttttttgttttttttagtttttggaagttttaggtaatttttgttttatggtagtattattttttgttttttttttatggttgtttttttgtggtgtgtttgtgtataaatttttattttttttttttttttttggaaagagttttgttttgttatttatattggagtgtagtggtgtaattttagtttattgaaatttttgttttttggttttaagtgattttgttattttagttttttaagtaggtgggattataggtgtgtattattatatttggttatttttttttttttttatgtttgtagagatggggttttattatgttgtagaggttagtttgaaatttttgagtttaattgatttgtttagtttggttttttaaagtgttgggattattggtgtgagttattatgtttagttatagatttttttttataaagatattaggagtattgatttagggtttattttaatgattttatttaatttgattgtttttgtaaagttttatttttaaatatggttatatttatatatattagatgtgagggttttaatatattttttaaagggatatagtttaatttattgtattaggtagttgtggttttttttttttatagtatagaaggtggttatatgttgttggatttttatagttatagtttttttatttgtgttttggttgtattgggtagtttttaagtttttgtttttagttttgtgagaaaatattggggttgggagtgggagatattggtattgattgatttggtatgttaattatttatttgttatgagaaagttgtttgtgtttagatttgaagaggatgatatagattttataaatatattatttaatgagtagttttttattataaagatatgttgatgttggttatagagaaagagagtggattggtattaatgtgtttgtgatttttatggagagaaaatattttggtatgtgtatgttgttatagagatttttagaatgttagattgttttgaaagtgtgttttgttttatatttaaaatattatggttagatgtagtggattatgtttgtaattttagtattttgggaggttaatgtgggaggattatttgaggttataagtatgggattagtttgggtaatatagtaagattttgtttttataaataattttttttaaattagtgaggtgtggtgagtgtttgttattttagttatttaggagaattatttgagtttgggaggttgtagttgtagtgagttgtgattgtatttttgtattttagtttgggtaatagagtgagattttgtttttaaaaataattaattaaattaatatatttttaaaaataattaaataaatataatatgtttattgtataaaaatttaaagttatagaaaaaaataaatttagtaaattataaatatgtttattgttaatgaaaaaagtttgttaagtatgttttattttaattattttatgtattgattgaatgagttattggttggttggtggattgttttttagttataaaaataatgtgtatgggagatggtgttgaatttaaaggaagtaattatttaaagtgagtattattgggagaatgtgaaattttggtttgtatatgtattttttaatttgaagttttggttttaagttgattaaatatgttaagttattattaatgtagtaattggttgttttgaaaatggtatgtttagggatttttatgtggatagtggggaagagggtggagtatgaagtttttgggtagaatttatttagttttggtaaattgtattttttgatattattattttttttttggtatgggggagtaggtaggggatagagttatttttagggtagatgtatttttggatgaatggtgatagtttttttttttggatgttttattgttaggattatttataagggtttttttttttatttatgtaagtttatgtattttagttttaaaatattttgagagaataaataggaattgggttgtgatatttgtgatttattttttttgtatttaagtaggataaagagagttttatattgggtttattttatttttgtttttttttggggtagttgaaaaatttgatttaatggggaataagggatatttgtaattggggtgaaaagtattgttagaaatgaggtattgtggtagttttaaatgatagggtggaagatagtttaaattgatatagtattttttagtttgtaaagtatatttataaatatgattttattttggtttggatttttaaaatgattagtaggtttatatggtaggttttatatttgagaaaatggatgtttagagatatggagttatgtgtataaggttattttggggaattgttttagagttttttgttgtatattgaataggagttttatgaaatagaaatatattatttttttgattttataggtgaggaaattgggatttaaaaattttaagagggaaggtttttgaggtttttttttggaaatggttgatatggggttaaaatgtagagtatttttttttgttagtgtgggttagtttttagtatattatatagagatagagagatggggataaaaataaatttttttatggtttaataatgagaatttgtttagtgtgtgatgaggagggtatgtgtaagtatatttatattgatttttgtttttttatagttattgagtatttttttttatgtgttgtttttttttgtggttatatttgtaggttgtggaaaataaatttgttttagggagttaaggttgtggttttaggtttttatttttttattttttaattgtgagttattgggtttattgtttaatttttttgagtataatttgatttgtaaagaggagataatattatatgttttttgggattgttatgggatttgaataaggttagtaagtttttagaaatgggttaggtatataggaagtagttggtagatgattttttttttttggtatgtttggtatagaatatatattttgatatttgtttattaggggtgttgtagaaggatatggtttgagtagaattgaggtttttgaaggttgttatggagaggaatgtaggtttataaagttaagttttgtagaattatatgtttatttattttaggatagagaaaatggtatgataatttttaaaaagttattttttttttttttaaaggataaaggtttgagagagatattttgttaaattttagattagtaaatgttgtttgttaagtaatgtttaagagaggggattttggttatttttatggatatgagagtttttgttgggttttgtgtttttggtaggttgttggtgtttaggggaaggggggtttttggggtaggttttaggtattatttgtgtttttttttagtatttttttttgtgtttaattagagtttgggttagggtttgtgaggttgagattgtttggggtttgatgtttgttgttttttgttttatattttttgttttttgtttttttattttttagggggagtgattgtttttaatagggtggttgtgatagatgttgtgggaattttgagtttgggataatgagttgttatatgttattttatttaaatataataatataaatattttgattaaatattttttttagttgttgaatgaaagtaataaaagtagtagggagtgttagtgaattttttgtttttgaaatgttttattttttaaaagttgttgtttgttaattttttttatttttgtttgtttttttttttttttttttttttggtttttttgattttttattgtatgtttagtttggggttataaataaagaggttgaatttagggatgtgaagggggtgaaattgagtatagttttttattaaatattttttaggttggttgtagagtaattgtagttgttgtgaatttgtaaaatttggtttggtttggttattgtagtatagtttttaagtgtttttttaatttttataattatatttaatttttaggtaatagttttttgagataatttatttttgatggtattaggtttttggagttttgtggttggagtttggttttatggttgatttttatggtagagttttttgggtttttgttgtttattttttatgttttgatttggtttttggaattttttttttttttttttttaggtagagagggatgtggttgttttaggtaaagtggagggttaggagtttgaagggattttgaatatttgtttttggaggattttagtagttttttttgttagtgggtagtaaaggtgtgattgttttgaatgtgttttttaggttgaaatttttaagaggaatgttttgtattttgttttttttttaaattatgatttttgatttagtaatgttattaagtttgaagttttttttgtgagtttgttgtttaggggtgggattagattaggtgttttatttgatattggatattttttaaagttagtttgtttttgtatttttttattttttttttttatttttggggaagtgagtttgagttaatttgtgttttattttggattttagggattttgattttattggtattttttttttttattttattttttttttattttggtggttttagtgttttttatttataaataaatagagttaaaatatttatatagtatttttggttttgggttttttttagttgttgttttgttttttttatttgtagttgaatattttggagtgtattatagtgtttattttggtttttttatttgttagttttttgtagtgtatatattttggttttggaagttgtgtattttgtttgaaattgttttttttttttggttttttggaggtttttgattggtggttgttttgtgttttttttattttttttttgtataattttgttttttttttttattttttaattgttagtttttttttaggttttttttttttgtattttttttggagatattattaattttgatgttattatttatttttgtgattgttttttttgtttttatttttaggttagatgtggtttttaaattttagatttatttttttttagatatttattaggagtttggttgtggtggttattttaaattttatttgttttaggttgaatttatgtttttttttttttttttttgtgtttttttttgtttttttttttgttgttgttttggttttaggattattattaatatttatttgggttagaattttagagttagtttattttttatttttttttttttatttattttttgtgttttttatttttgttttttttagagttttttttttattttatttattttttttttattgttttgttttggttttttgagtttttatattttttgttttttatttttattttattttattttaatttattttttatgttattattaaagtaatatttttaaaagatgtgtttgattattttagttttttgttgagttttttgtgtttttttgtatggtgtaggagttttgaataggtttggttttatttttttgtatgtttttgtggtttttggagggtttttagtagtagtagttttatttgggagtttattaggaatgtaaatttttaggttttattttaggtttattgagttagaaattgttggggtggagtttagtagtttttattgtaataagttttgtaggaatttggaggtaaggttaagttggaggattgatgttggaaagtaatattgagttgtttaggagttattaagtatgtttttgtttttgagtaggttgtgtttgtttgtggtgttttttttttatatttttggttatttttttgagtaaggtttttttttaaggagaggaggtttttttggtttttattttttttttatttagttttttgtttattgtttttttatgtgtggtttttggatttgggatgtttttgagttgttgtgtttgtgggtggttttgtgattttttagtttatgtgttttttttttttttggggttttttggagtaattggtttattaggtttttgggaatttgtggggtttggtatttggtagtgttgtttagatttgtagagtgaattgtttttttttttaattaattttttttttttgatatagagttttattttgttatttaggttggagtgtagtggtttaattttggtttattgtaatttttgttttttagatttaagtaatttttttgttttagttttttgggtagttgggattataggtgtttattattatgttttatttttttgtatttttagtagagatggggttttgatatgttggttaggttggttttgaatttttgattttaagtgatttatttgttttagttttttaaagtgttgggattataggtgtttattattatgttttaattttttgtatttttagtagagatggggttttattatgttgtttaggttggttttgaattttggattttaagtgatttatttgttttagttttttaaagtgttgggattataggtgtgagttattatattttgtttagtgaattggttttgatttgtttttgtatttagtaattatttattgaattttgaggtgttaggattgaagtagtatagaatagaatttgtggttttaattgttttgtttaaattttaagagttagtattgttgaagagttaagaatagttgagtattaatttagtaatgatttgaagggtgggtagtgtaagggagatagtgattttgagggaaatattgtgatttttttttgaaattttttttaaattttaagattttttttgggtattggtttttttttattttttgtttgatttttgtgttttttttttttgtttttttagtaggataatgtagaatgaaagttaatttttggtattttttttttgtattgaagaagggagttggattttagtatttagttttgagtttatttggggagtgtggtttttttttgatttttattttttgaggatttttggttttggataaagaaatagtgtttattttttggggataaagatttttttgaaagtttttatataggagtgttttttagtttttaagattttttattaatgtgtttgtttttttttttgtaaatttgttatattagtatttaattattttttatgatagtattaaattttatgagtgatttatagtgatttatagttataatagagatttgtatgatttattatagttggtatttgaggtttattaaatttttaagagttataagtattgaaattgtttaatttgattttgtttagaataattatagtatgtgtgaaaatttaaatttaagtataataggaatagttgtattatttattttatttttatttgatgttattgtttatgattgtggtaattgtatatatgggggatagtggtggtgagtatatgtgttttttatgtagaaaagagaagggaattttttttttttttttttttgagatattgttttgttgttgttgtttaggttggagtgtaatagggtgattttagtttattgtaattgttgttttttgggtttaagtgatttttttgttttagttttttgattagttgggattataggtatgtgttattatatttggttaattttgtatttttagtagagatggggtttttttatgttggataggttggttttgaatttttgattttaggtgatttgtttatgttgggtgtttttttgtttttaaaaataagattttggttaggtgtggtggtttatgtttgtaattttagtattttgggaggttgaggtaggtggattatttgaggttagaagtttgaaattagtttggttaatatggtgaaattttgtttttggtaaaaatgtaaaaattagttaggtgtggtggtgggtgtttgtaattttagttatttaggaggttgaggtaggagaattgtttgaattttagagatggaggttgtagtgagttgagattgtattattgtattttagtttgggtaatagagtaagattttgtttttataaatatataaatatataaataaataaataaataaataaataaaatgaaataaaataaaagatgagttttaaattttgtgttttggatggataggtataatttgttatttgttggttaattgaagagttgattttggtgtgttttttttgtggttttgagataaaagttggggtagtgtggtgtttattggattgagagttggggtttgtttgttgtgtgatagatggttttaaattttaatgggtagttgattttgttttagggttttttgtaaagaagtgtttagattttaatttgtttatggttagtttttatagtgtttttagtgtgttttaagtttttgttgggaatagtgttgtttttatttttgagttggaattttgatagtatattatgggttttgtgtttttgttttggtttttgttttgaattttttatttttgtgtttttttgttgttttagtttgtgtgttttttttaggtataatttttggttgttgtttaaattaataattattttaatgaggtgttgttttgttattatttttattggggtaggggaggtgtagttgtttgttttggtgtttttttagatgattttatttatttgtatttgtagagaaaaaggtgtgtttttggattttgtttttttttgtatgggtggtgtggataattttttagggtttttggttgtagggtagataatttttttggggttatttgttaattattagtgaatgtgtgaagtatttgtgtaaaggtttttgaagtgagttttatgtattgttgtttgggttgttattggttttgttttttaggtagagggttttgaggtttagtttggttttttttaagtgttggtggtatttttttgttaaattgtttgtttttttaatgaagtgaattgtttgtttgattttgtggtagaaggtatttaattggggattaaagtaaatgttgaagatatttaaataagttatgtatatttgttttgtggagggaaggaaaatagtttggttttatttatttttgggaagaattgttaaggaattgtttaaataataaattgagttgagtgagtggatattgttgtagtttagtttggggtttttgtgttagttttggttggtttgggaatttttttgtagtagttatgaggggagaagagagtggttggatttttgtagttagtaattgtgatttatatatgtgtagagggatttttgttgtgtttggtttaaataagtttaattagtttttaggatagtaggttggtggatggtgattgtgttagtatagtgtgtgtaggttttagtggtagtaagagagtattgttgtggggttgatgtttggtttgtgttttgttagatttggtttggttaggggtttgttgtttgttaggttgggtttttggtgtttgggagaagtgtttgagtgattggggtaaggggattaaagtgtaagtttgaggtagggtttgggtgaggtaggggatttgtatttgggtagtgaaggtaggatgtgtgtaattatttagtgtatttatgataatgtttgttagtagtttttagtttttgttgttggtaagggtgaagtagagaaggttggaagtgggagtatttttgtgggaaatataggtgtatttaggattagttttatagtttgtgaggtttagtgtaaaaagaaaatggggagtttttgttgaaaaattattaagaattttaagatggttattgtgtgtaatattaaattatgtttgggtttttttgattataggtttaggggttgtataggttttatgtttgggtagttggttttgttgtagtttatagagtattgtagttaggtatatttggatttgaggttaagttttgttagtttttaattgagtgattttaattttttattttttttatttttatttttttatttgtaaaatagtatatgaatatttatttttttagattgttatgtggtataagtaagaaaatatatgaagagtgtttagggtagtttttagtatttgtgagtgtttagtaaatgatagtttttttttgagtgtatttgtagttgtaatttttttttttttttttgaaggttaagttgaggatagtgtttgtttagtgtgaagtttaggagatagagtgaggtttttgttatagattttatttagggatagagatatggaggattttttttgggttttatgattagagaatgtttgagggtaagagagaagtatgatttgaatttttagattatttgtaaagttgaagatatttatataaagttgttgatttttatggtaatttgggtgtttatgttgaggaagaaggatttagaaggaatggtgattttttaaatatgggtatagttatgtgttgtttaaggatatttaggttaaggattgattatatgtaagatagtggttttataagattataatggagttgaagaatttttattatttagtgatattgtggttattataatgttatagtatagttattttattttttataaatttagtgtagtttaagtgtatagtgtttataaagttaatagtattgtatagggatgttttaggtttttatatttatttattatttatttattgatttatttagagtaatttttagttttataagttttattaatggtaagtgttttatataggtgtagtattttaaaaatattttaatattgtatttttgttgtattttttttatgtttagatatgtttagatatattaatatttattattgtgttatggttgtttataggatttagtatggggatatgttattgtattgttatagtttatgagtaataggttatattatatagtatgggtgtgtagtaggttttattatttaggtgtgtgtaagtgtattttatgatgtttatataatgatataattatttaaagatatattttttagaatgtattttattgttaagagatgtatgattgttatttagaatttatgaattatttttatttatgttatttggggttttgtataattttgtggagttaatagagttaagttttattagttttattttatggatgaaagaaaatttatattatggttgtagtgattattgtaatttgtttttatagaaatttagaaaatatgtttttaaatgggggagtttttttagttgttttgggtaaaatggagagtagataaatttttatgggaagggtgtatttagttaagggttgtagtatgtattatttagtgtgttgagtatttggtttttttttgattttggagaaggtaaaatttagtagaaaggatggtttttttaaggatttatattgagggtgataaattttgtataagtatatattggtgttaagatgattagtaggttgttattaatttggtttgttgtttagtgttagttattaaatttatgttttgttttaaatgttttgtttaaattttgtattattatgttttaagttattagtaatagttggaaatagtaaagaagtatgagaagtagttttgtatttttaaaatgagtgtaggttatattttttgattagtggaaatttattgaggaagtgtagattggggttatttttgtgtgagtgtgtttattattatgtatttatgtgttgaggttatagtttttagggttgtaggtgtggatttaggtgtataaggtatagatgtagattttagaagtagattatgttttttgtttttaggggtatttggagtatatggatattattgatattagatatttattaagtatagtttatgaagattggtttagaagttaggggttattttgtagagagggaggagaggatttagatggagattatattagagtttgagttttgttagataaggtaagtagttgttgagtttagatgaagggttagtgagattattattgaggttgtagaagtggaagtgtgtaagagagtttgaggttttagggaagtataggtagtagatagttagtggtttaggtttagtgaaaggagttttaggattattgtttttttagagaggagagtttttattagagtttagttgaataggtttgttgatatttttaagtttattattttttttagttttaaaatagaatgttggtaaattgaatttttttgggatgtgtttgagtatattagtttgtttggattgtaggaattatggaggggaagagtgggtaatgagtggtttttgttttttatgggtatggtgggtttgtaggtttaggtaggatgttttttgtttatagtataggttagatatttaaggtattattataggagtaggtgttttaaggggtggatggttagagatagtttgaaatttatttagtattttaattggaattaagttaagaattaaaataggaagttagatgagattgtgaggaagggaagggtagttaataagagaggaagttattagtgggaattttagagagtggagtttggagtagttttgaattagtttgtaggtagttgtggggttttttatttgtatatttagtaatgagtatgaggtagttgtaaagtggatggtggatttgagaaggtattttaaagaagaaaggtattttggatttttttagatgatattatttgatagatgtttatatagttaatgtttttgaggtgtgtgtaaaatgtgtagtttgtggttaatatagggttgtagagaaaggagaaatagaagaaaaatggggaatgttttttatttgtatttttatgagttaagaaatgtgaagtggatttttttttttttaagtagtgggggatttttttttttttttattatttttttgtttatttttttaaggaagttatgttgtgtgttttattgttttatagttatggtgaaagaaatttttaaaataaattttttgttttaaagttttatgtgtttttgtaaataatgatgttttttagatagtgagggtttagagtttaagggatataagaaagtggagttttttaatgtttttagtgtgtagtaaatatgttggaattttaatggattttaaagtgtaataataatagtattaagtatatgttagagtttttgatgttattgatgaaaaaaaaaaaaaaagtaggtggtggtgggggtaaaggggtttttgttatttttgttatgagtttttaaatttttgatttttaattttttgtgtttaagagttttttttatatgggtgttagtagtttgattaagtattttgaatttattggagttattagtgtttttttgatgggaaagggtatttttagttaaaaggttttaattaggattgtgattgttgagtgtttattagtgtttgttttgttttagaggtggtggtatggggtagggtggtgagtttatttattgaagttatttattgtttagtagaaggtaggtagtttggttaggttggaagttgttttttagagtgttaggatttggtttagggtgtgtatgtatttgttgggttttggttttgggtttattttgaatatgggaagtatgtagaaaattgtatagggaggattttaaagaggagatagtttatatttgtgggttttttttattttgtttgttgttggaggttttttaggtagatggaagtgttttgtagtttttaggagggatggttagtttggtttattattgttattgtgtggttttagtttttttttatgttttttttttttttttttattttttttagaatatatatttattgagtttttgttgggtatatatggataagtgggttttttttgtttttatattttagattttttgggagggaaagaagatagttttgatttgtgggtgtgtgtattttggtagggatttatttttatattgtttagtaggaaaggtagtgtggtgtgtttatttttatggttgtgttggtataagttttgtatttagtaaatgtgtgtttgtttgaggaagtgtattgaggatgagtatagggttgttagagggtaaggtagtggggaggatatgatgtgggtttaagtagaattttttgggttgtttttattggttttggttaatttgaattatggagaagggaggaaggagtatttgattttatggagttttttgggaagtttgatggagggggtggtgtttgtattgagttttgaagagggggtaagatttgggtaagagggaatttgtttttaattgaggggatattataagttatgaagtgtatggtgtttgagggggtattgatttttggatggggaggtgttttggatagagtttggtggttggggttttaaatttatggtgaagagtttgggttggagtggggaggttattttgggttattatatattttgggagaagggagggatatggtttagatttggttttagggatgttggtgtggggagtatagtttagataagttatgataaaaagttttaattttgatattgttgtgttaggaagtggaatgtttaagagttttggttttgaagtaagaaagatatatagttttattattgtttttttttgtaatattggagaaggttagtttttttatttataagaatgggtgtatgaatagtatttgttttttagggttaggttttaggaagaaataaatgaggtgaatttaaaaggtattgtatattgtttgatttgtattaaagtatttagtgatttgtatttgtgtttattaagattgttttattattttttattaattattatttatggggtaaattttggaagatttttagttgttgattgataggaattgtagatggagtggatggtttagataaaagaagtagagttaataattttttagagttttttgtttggttttgagtaaaatgaatgtgttttatttattttttaattgttataaagttgttaattagtatatttttgaaatattgttggttttttagagatttttaaatatttttggaagtgattttttatgattgatggtagtatttttttttgtgtaattgtgaagataagggtaaattttttgatatgttgagtttgagttttgataatttttggtaggtttgtatttgtgttgtttgagagttttttagggttgttgtttttaaagtaggattgatattttatgaaggtatttgggtttttttgttttggtagggattatgtttgaagtgttaagttttgtgtgttttggtattggaatagaaagagtattaaatttgtattataaggttatagttttatgtaatattgggtagattatttagtttttttgagtggataataaaattttttttttttagtttttaggattgttttgataatagaatttaagaagaaataagatttaggagaataataataatgttttgggaatgtttattttatgttaagaggattttttaagaagatatatattattatgaaatatattattttattttgtttttatatttttttatttgtttttgttagttttgtaatattgaaagttttttttgtagtaggttaattttgaatagaatataatttttaaattttttttttgtggattagttgttggttttttaattaaattaggtttagtttaaatttttgattttattgattttagggtttttgtagttagatttgagataattaaatagtttttatggaaatatttttttttttgtttttattttataattatttgagattagtttggtttatatggtgaatttttgtttttattaaaaatataaaaattagttgggtgtggtggtgggtatttgtaattttagttatttgggaggttgaggtatgagaattgtttgaatttgggaggtggaggttgtagtgagttgagattgtgttattgtagtttagtttgggtaatagagtgagatttaatttaaaaaaaaaaaaaaaaaaaaaaaaaaaaagaatttaaatgtatatttttagagttataattgtgatttttgaattttgtgatataaaaatatagttattgatttaaaaatttgttattggtaattaatttttatttttaatttttaagtttatttattgttattgaaaatatattattagtatattttaaagtaaatagatttgttatttttaagtgattttttatatgtttatatgtgatttttttgagagagttttgtagtttagttagaatggatgtaaatttttttttatttttttttgttgtttttttttttggttatttttttttttttattttggtaggaaagttgaaaataataaaaatgttggatgtatatatgtggaattataggtaagatatattttagagtttttgtttggaaggatatggttggttagttagtatgtagatgtggttttttttttattattgggtatttattggatgtgattttgaagggagaaatatgtagatttatggatagaagaagttagaagtttttagaaaggggtgagattagttgttggtttatgattgaggatatatttgaagtagtaaaggtagaggttttttttgttagtttatttgtagaggaatatttggtatttttttgtgggaaatatatgattatgtttgttgaggagtatagaagggatttatttgattgtttaaaaaaaaggatgaattgtgggtgtggttagagtgtagtgatgggtagtatttaggtttaaaatattaattaatttaatagtttgtatgtttatataaaagaaatgataaaaagtttgttatttgagtagtggagaatgtttgtggaagtttatagattaggagttaagattgttaggtagttgttagaagtaaaagtttattgggttttagaaatagtttattttttattgttaattagtattttatgtaaatttgtatttgttttatttaatttataaggtaattttaatttttaaatgtttagttattgttattattgttagatttatggttaattttatttattattttgaaatttgtttatttgttatgggttttgttaaaattagatgagatgtttattgattaatgattaatatgaatatttttattatattaagttagttatataagttagtatatgaagaaagtgtattgaaaatatttgatgtatttagtgttattgtttagataatataataaataaaaaattgatatttttttttttgaaatgtaataatttttgtaaattattttattatggtatattggaatagggtttgttaatttttttttataaaggataagataataaatgtgttaggttatgggttttttgttttagttggttagttttgttgttggtgtgggaaagtagttataggtaatatgtaaataaataagtatggtagtattttaataaaattttatttataaagtaatttaagtgtttattaatagatgaatgggtaaagaaaatgtggtatatatatatagtggagtattatttagatgtaaagaagaatgaaattttgttatttgtaataatatggatggaattgtaggttatgatgttaagtgaaataagttaggtgtagaaagaatttgattttatttatttgtgggatttaaatattaaaatgattgaatttagagggatagagaatagatggatggttattagaggttaggaaggatagtgggggttgagtagggagtgggaatggttaatgggtataaaaaaatagaaagattgaatgagatttaatgtttgttagtatagtatggtgattatagttaaaagtaatgtaattgtatattttaaaataatgaagagagtataattggattgtttatagtatgtataataaatgtttgaggtgatggatattttatttgttttgatatgtttgttatgtgttgtatgtttgtgttaaaatattttatgtgatttataaatatgtatatttattatgtatttataaaaaattaaaaaattaaaatataattttatttataaaaattggtttatatgtgatagtttgtagtttttttttatagtatatattttttaagttaaggtttttgttattgtgtaaagtgataaaataatagataatttaaaaaaaaagttttagggtatttttataggatttttagagtatgttagaattatagtttttttaaatttgtattattttatagaagattatataaatatgatgttttattttgatgattttggaggagtttttaattttatataatatgtttgtgagattagaaaaaagatttttagtgttttatgaggtgatgttgtggggattttgtttagtaagtttttagtggggttttgtgggggtagtattttttagattttgtttatggtagattatggtgggttatagattgttttgtttaaaatatgttgttttagattttttttgttaggttatttggggtgtttttagagggtggattagtttatttttggtgttgtgttatttataggtaggaattgtaaggttgtttgagttagtaagttagtttgtattttggagttagtttaaatggttttttatagtgtattgagttttggaaaaatgatttgtaggtatgaggatgatgattggagaagttttatggtgggaagagatagtgatgaggtttgggttgtttttttattattttattagagtgagttttttggtagttggattttttattttgttttttttttttttttttttttttgtttgagattttttattttatagaagttggatggtgattttggttgtagtatagtggatgttgtttaatgatatttttgttgatggtagatgattgaatgagtttgaggggattggttatttttataggttggattaattttaatgatagaaaattatttttagttgattgagatgattttaagttgattgagtaaattttaaggttagggtatagatgattttagtatttaaattatttatgaggatttttgtatttagtagtttatttttgtattgttttttgggtatttttagattatttaagtattatttggtgaattatttttttagggtattaattgagagattttgattttttttttttaatttgtaatttttgtatgtaaattttaaattttaaaagatagttttttaggatggtatttaagagattttatagtttgaggatattataattattttttgggagaaggatgtaattagagataaatttttaagtgttttttttggttattttttggttataggttttatgattaatttaggttgttgtgaagagatttaaaaattaatgttttttgtttttaatgagatttttaatgtttaatgtgatgatagttagtgtgaaatggaatattgataattttatttagtataaatatttttgttatgtattttagtttaaatatgtgttaagttagttatatatttatagggtttaaagattattttatttaagtttgggagagtgtatattttttaaatttttgtttagtgtaagaggatttgggtataatagttaaattttttgtaggtttgtaataaattatttttgtaattataagtatgtatagttgattgtttattattgttttatagatttgtttttatttggtagaattttaatttttttagtaaaattgattttattagttttgtatattattttttttgttttttatttagtttgttagtttgttgatagtagagtatatagtatttagtagttggtttgtggagttattagttaggaaattgtatgataaataggaggtagttaggttttgtggtatttttttttgttttagtagtttttgtttgattttggagaagttattatgtggtgttttgttaaggggtagggtaggagatggttgtggtgtagtaatttattatatatatgtttgagttatgatgtgttatagttgtattgtttatgtgtaaataataaattgtgagttgggtaattatggtggttttggtgataagggtttgtttttgttatgtgggtttttttggatagttttttgggttgatgatggaatatgttgttgagttatatagaaatgataaattaagatattagtaaggtaagtatttaatgtttgaggatttaggagtattttttaagaaatgtgttaggattaatgttatgagatgttatgtatgttataggatatgtttatattgttttttattttttatttattttgttaagttatagttaagtatgttttgaattggaagaggggagttttattgtatttttttagaaagtggtttaagaggtgtgatttttattaataattaatataaggtataattgtttatatagatttttgtaatttaggagaagttattttaaatttaattaagaggggaaatgtagaaatagtgagatatttaaattaaaattagatgtttttggttaaattagattatatttattaattttttgttttttatttaaatataatttttgaatgtagaatttataaatttttttgggatataaataagtattaagaatttggtgtagtgttaggagatgtattatatatttttagttagaattaatttttaaatttatagaatattgtggatttaatagtgagaaatgattatttagtgttttagtaattgtgttttatattttttttttaaatttattgttgtagtgttaggttattttattttttattttgaaagagggagagagggtgagagagagaaaatttaaattttgaaagaataattttttgaaaatgagaagatggtagtgttttttaaatgtttttgatagtattgtaggttttttttgaggaagataattttatatttgttgggtatatgtttttgattttatgggattaattggttggtttttattttatatatgtaattattgtaattttattataaatatttatataaaagattgtgattgttattttggggatatatgaggtatatattaaatgtggaataaatttatatattttgagtgaaaaatgtggttttgtattttgttataatttatagttgtatttatatagagaaaattagatatagttgatatttatttatttggtggagagaattttattatgtagaatatagttaaaagttatgaaataaagaagtgaaaatattttttaattttgatatagttgttagtattttttaaaatagttgtataaattggtgtatgtgtgatgttttgaggagatgggtatgattttatgaatgttgaatttatattttgttttagtaagtttatttttgtgattgttaagagtagatgatgtgtgttaagtaagaagtttgtagggggtatgtgtgtttgtattggtagtgatagttgaaaggtgtggaagagaaagaagagttatttttatattttatggttatttatttttatttggatttgaatttgattgatttgggtttgttttaaagtttaaaattagtaaatataaattagtatatgttaggtttttaaatgagtgtaaaagatgattttatttaattttttgttgttttaagaagggtgtataattttttttgaaaatggttaaatgagagagaatgtttggttttatagagggtggtttttaattgttaagatggttgaattatgtgtagtaatgaaggtgttaatattgttgaataaatatttaatttaaatttttaaatttattaaattaatttttaatatttatattataaataataatatttatatttttttatattaagtattaagtggtaaatttaaaatataattaatttttatatggattttataaaatgtgtaaagtgtgataaatgaggttgggtgtggtggttgatgtttgtaattttagtattttgggaggttgaggtgggtagattatgaggttaggagattaagattattttggttaatatggtgaaagtttgtgtttattaaaaatataaaaaattagttaggtgtggtggtgggtgtttgtagttttagttatttgggaggttgaggtaggagaatggtgtgaatttgggaggtggagtttatagtgagttgagattgagttattgtattttagtttgggtgattgagtgagattttgttttaaaaaaaaaaaaaaaaaaaaattgtgataaatgattaggttattagtatattttttatttgttgaatttttagtattgttgtatattatgatattatagtgatagtgatataagattaaattgatttttttttttttttatgttttttattttttttttatttaattttatgatagttataaagtatggtgagttattgatattttagtaaaatagttttttgggaagttttttagattttagatttggtggtaaattgtagaattatagttttgggtttttttttggtagattatagagtttttatgaatgttatgtttattgttttttttatttttattggatttttttttttataaatagagttttatatttttgaaggtagtagggataaaattaaaataagggaagtaatgtattataattttaaaaatatgtttgttgtgtttatattttattagttgtttgttgaagaaaatttggaaaatagagaaatgggtagggaagaaaattaaaattatttgaatttaatattatatatatttaataattatttatttttatttagttgggatggtggtgttgttgattttgggggatgtagttgattttagtggggggatgttttgtgtatttttaggtggttgattagaatttgtttgttgagagaaggttttattggaattgtttttagagattgttatttttagtattagggtgaaataattggaagttattttgaggtttgtgggtgtatatattaatttttagtagtgttggttttaggtaggtttttagtatgattagtgtggatttgttatatttgaagaatatgttttggtatattttgttgttgtatttagttttatagatatggagttaaatttttaagttttggatttttttattttgttttttgaaatttgggaaaattttgatttattagttatgtttttaagtataaaatttgttaaaattttttttagtttttatagtgaattatttttttttttttaataaaggtttatttttagtgataatgggtgtgagttattaggagtaagtgggggtgggagagttatttttaaggaagagtatatatttagtagtttaggaatttggagtgttggattggggaaaggtggaagtaggagagggtttgggtttaaggtgaatgttaatattattttgggaggaattttttgagtttggttttagatgtttgtgagtttgagtgggttagtttatttttttttggagggttgtatagtgtttttttggatagggtatagatttgttgtttttgtgtggggattatggaggtttagtttggttaagaaggaggggaatatgtatttaagttaaaaaaaaaaaaaagaagtatatgtatgtatgtgtatattagttatagattttagtaagttttttatttttaaaagtatggtgagtatgggagaaatgaaattggtatttgtattatagtgtttttgtttaaaatttaatttgataatgtagttttattttttaaataagtgtgttttaattttttttttttggttttgtggttttttttagttttttttttttggttagtttgttttttaagatagggagtttgtgttgttttttttttttttgtttttgtgtttgggtttgagttgtagttagttttaggttttgtttttttaggtaggtgtaggtattatttatttagttatattgttgtagtattttatagagttttataattaattttaaagagtttttttataaatttttagattaagtgtaggtagtgaagatataatagtatagtaatgttgttttgtgaattggaatgttgtttgaaagtgtttatttgatatagattgggtttttttttttttttagattttttttattttttttttgttttttatttttttgtattaattgatgttagatattatgagggttgttattattatgatttatttttgatttttttattgtatatgtaagtattaatattttttttattaatgaaatggaatgagatgttggtttttattattttaggattttttgttaatggtatgtttattgggttttgaagatgtgatagaagtgtaagatttatttttgaaatatagtaagtttatttgtttgtgggtttattgaagtaaatttttgttgttttttgaggaatgtttgttatattaggttgttgataagtattttttatatattttgttgatgtgtgttttgtgggttgtaaatattaaattaaaaagtaaaagtttaatggaaagttattatttagaatatgtatttggttgatattaggtttgaagtttgttatgtttaaatttttgtaatatgaaagttttgttttggggattataaggaattgtaatgaaatttttatggtaaatttttatagtttttatgtaagtatattagaagttatttgattgatgggaatgttagttaaataaaatggtaaatgtgattgagtatatggtttatagaaagataaaaggaaagaatgttagtgataatatatattagaaaaggaaaaaggaaattttttggaagtaaatattattttttttggtttggaggaaataaaggatggtggagttgtaaagtaaaatagtatttttttgtagtattgtttaggaaattgttatgtattataataattggagttattttttgggatgggttgttttttgttaatggttttgatatatatatttatttatatttaataattattttttattttgagatagtaaagttagaaaagtataaataatattttgaagaataatgttggttatttagatggtagattgtatttttgtggttattagttatagttgtgtaattatatattatgttaaagaaaaatgaagttgttttaaaataagtttttttttgtgaatagaattaattgatattaataattttaattatatgtttaagtatatatataatattttattaatagttttttggatttattttttattattgaattgtaattttagagtagatttgtttggaggtaagtaataaatttgtgttgtagatttttataagtattaaaggagaagtgggtatttatagagagagaatgtagaaatttgtgattgattttttgagtttttattggaatataagtaagtatttatagggttttgaagtttgttaaaaatattttttaataaaattaggaggttaatttaaaattttttatataaagggaaggaaatttttagtttagtttgaaatatgatatgtaatttattttattatatagaggttttatgatatagatgtgattatatgggttttagatgaggatttgttttatggtttagagtatgtaagggttagatagattttggagatatggatggttaattttttttagattggagtttttgtgatgtatttaatttaagttagattttttttggaattttggagttttttatttttttagaaatgatgttttagagtaattttttaaaatgagtttatataataggttgaattattttttttgtatttattatagtttgttttgtaattaaatttaaatatgaatttattaataaaaattttaagttttggttttatggtggaatataatagtaagtttttttgtagtttttattgtgtgttttaggtttttattattgatttgtattggtttgtggtgataatattatgagataagatgtgttatatttggattatttttgtaggtagagttgggggagttatattttaggtgtgattgttgagttgggttttttttggattttagttttttttgtttttttagttaggttttggatattttattagtatttgattaaatggttttttagtagtttaaatgtataattattaaaaagattgatgatgtaaagttgatagataattttgagttttaaaagataagttttggaagattttgagagggaatattattgttgtgggtatagagaatggtgagtttatgggtttgtggttttttgggattgtttggttttagtgtattttggtagggttttgggtggatgttatgtttatgaagtgggttttagtaagttggggtatgttatgtttttgtgtttttgtgattgatattttgtttgtattggttttagtggttttttttttttgtatggtgaatttttgtttatatttatttttaaggtttaatttaagggttgttttagagatttgtatgtagttttgttgtgatgtttttttttttgtttggtgatttattgttaatggttattgtttttttttagttttaggggtagtgtttagtatttggttaggtattttgtaaaaggtgtttagtggatatttatattggtttagtttgagagatagtggaggagtagttagagagtttgaatttttgtttttgtgttgttatttatttgtgttgtgtattttggttattgatttttgtatgtgttggttttgtaatgtggaaatgaagttgtttgttgtatttatttttttagattatagggagagtttaatgaaataatgtttatgtaagtattttgaaaagtatagagttttaaataaatgttgaaggttggtattttaggtagtggggggtatgaaaaatattgggagtttttattttgtttttgtttagttatgagattttgggttgtttttgtattttttgaggtatgataagtagatatttgtgattattttgaaagtggaggttaattgaggtaaatgtggtttggttatagaaattttaaaagtatgtatttgttaagggatgaattagttatttgggaaagtaaaattattttatttaaaatttgaattttaaattgtttgttatataattgttttatagaaaatgagattaagtgaagagtattaagtttttgtaatatttttaattttaagaagataaaatttggagatattattattattttgtatatataattgtttttttggtgttagttttaaaaattaaattatgagttttttaaaaataaggatttgtgttgatggaaatgttgatagatttttgtttagaagaagggtaggtgtttttataattatgttattatattttattattaaagattttattgaaagaggtttataaattgtttttttttttagataaattattttatattaaggtattaatgatatggtgtagaattaaattaaaattttataaaatgaaatatgttttgtattagttgtttgatatttaatttgtttttgaatgagtagaggaaattataaattaatttgtttttgtttttttaattatggtttattaggtgttagaataattgtaattatagattaataataattattaagttttataaatatgtatggaaatatgttagtttgtgttaaagaatttagtttgttaaatggaatgtttttagtttgttttgtttatttttatggtgttatttatagtttatggttaggtagtgtagaatgagtatagaaatttgaatggatttaaatatattattagaaataatttataatttattggtattttgttttttaaattaaaattgtgaatttagatttagaatttttaagtaggatttggaatataagtagtattattttttgagttgttatgtaaaggttgttataaaatgtataatttttgtattgtatttgtttaatttaagtaatttgaaaattaagaaatattggatatgaggaatttttttgtttttttggaaagttattttttattgaatttattaggttttaggtttaataaataaatggaatgttgtttttttttttttttttttaaattttttgagagatttgttaagttagattgtaagaagtataatgttttagaaaaaatattagagtgagtttattttattattgagattattttgtgtattaatgaaagaatttgaatttatatatatatatttttattttatgtgtatatttttattttttggtttttgtattttttgttttgtattgttgatattagggttgttttttttttaatttgaggagatattattgtattttatgggaataaatgatgtttgttaggttaaaaataagtattaatttttaaaattttatttgggaatgtaggtaattggtatattatagtttattattttagaatataattgtattgttaagtggttattttttatagtaataattaaagtatttttttttttgtattttgagtgtgtgttttttgttttttagtgttagaatttaattaagtatgttttttttttaaaagtaggtatggtgtatttgtagaaatttaaattataaagtagttttaaattttaatttgattttatttattttggattttttttgggaaaaagaaatgtagtttttatgtataatttttttgagttaaggttttttaatttatggattagtattaattgaattttgaattgtttttttgttttatattgagatttgtaatttattttttaaagtagggtttttggttattaatttattgtaataattaagttttattaatttttttgttagttgagttgtgagttgtttttgttttgtgttgtggatgtgaatagtattgtattttaagttagtttatataaaggttgttgtattttattatttattttattaatttatttttgaaaattagtttttttgttttagggaaaatgagtatttatgttttgttttgtatgttagttttttttttttttttgttgagttaatgtgtttttttttaaggttgtttgatattttttggaattattttatttaagtaaggagagttgttttttttattaaaagtggttatttttttttattttagggagaggatttagtattatgaagattattaatattagttgtgagatagagtgtattggaaataggtaaggttttgtttttgtaattatggttgtttgttagggatgagagtagggagatgagaggtaagtttggtatatgaataaatatatttttttttagagagaaaaagttttaagaaaaggtatattattatggtaaaagtttagagaaggaaatagtaagtagatgattagggttattattgagttttttttttttaaatttagtatgttgtttgttttggtattatttttattgagagtttatatatttattttaaaggagtttttttagtttagttgtttattgaaaatattatattgggtttgtttatgtaatagtgattttatttgttgtatttttagggaagtttttggtaaaatatggagatttagtaaaattttataattatatttggggttaaaattagtttggaatattttaatagtgtaatttaaaattaataaaggaaagtttttttttgttttttttatttagtgtttgtgttttattataatattattaagattggtaaagtgtaatgatatattaaattgtaaagtttagtaaatattgtagtaaattttaaaatattttttattgtttttttaaaaaagaaaaagaaaatatgaattaaattataattatattttttagggtgaagatgatttgtgtatttttttgtatttgttaggttgagtttatgttttatatatggtagtttttaaataaatattatttttaatgatgataaaaataatagggttattgttatgattattattttttttttgtttttgtttgagtgtgttattttgtgttaataagttaggatttaaaaaataaaagtttagtgattatttttgatagaatagattttattaatagtagttattgttatattagatgttttttattgttaaattaattttttgatattaaagtagttattggtttttttatatgattgagtgttatttaatgtattgttgttttttagagttgatatatggaaataaaatgaatgaaattagttattttaaatgaataatttaagaagattatagtaatattaaagataagggtaaaaaagagatgaatagataatttagatgaaaaagtatataattatgattatagttgatatttttgaatatttattataggttaagtataatattaaagattttatgtagttataatatttatgtgtgttaatatttataataattttatgttggagttattagttttattttaaagatatggaaattttgatatagagaagttatttagtttataagtaggtagtgtttttgagttaatttaggtattagattttatatttttgttttggatttttatgttttgttagtgaaaatgaagattatagatttggttgttttagtttttattttttggatgagtataattatttttaatagtatttgataggaagtttttagtgttattggttgttattgttttttgtaaatttttaaggtggaaatatagtagtgtgtgaagagttataaaaagttatgtttaggttttttgatttaatgtatttattgagtaatttaaaaatgagatgtttattagtttttgttgttgtagaatgtatgatattatataatagaatagtttatatatttagttattggagtggtttggtaaattgtgatttattaattgggtggagtgttgattaatatttaattatatttgagaagattttgttagaatatgggtagataataattagtgattatagtggtaaatttaatagaagggaagttatgttagaatataatgtgtatttgtgtagagttttttttttttagatatttatggtttgttttttttttttatatatttttttgtttagtttttgttttttagagaggttttttgtgaataattatttaaaatagggattggtaaattgtggtttatgggttaaatatggtttatggtttgtttttgttaataaagttttattggaatatagtgatattttttatttagtattatttgtggtagttttagtaatataagggtagagttgagtaattgtgatagagaatatgatttggaatgtttgaaagataaaagtttgttaattttggtttaaaataatattttttttttatttttattttgtatttttttttttgttttattttttttttttttatgagtaatgttatgtgttatgttttttatttttatgtttttttattgttattgtttatattttttattgtatattatgttaaattaaaaaataaatgttttattatttggttattattttttgtgattaattgaaaaagtttaagttttgtttaatttttaagaattattttaggttatttatatatatagtttttttatagttaggaaaagatggttgagttttaatttttaaatttttaaaattttgatgagtgggtatataaatttagatttgttgatatatattttattttgtgttaagaaataattataaaatagataaattgtatttaaagggtgtatatttttttttgttttgtagtatttttaatgattgaaatattgaatttggtttttagttgtagagaaagtaggttttaattatagtgtatatttagagtttgagttttagttttttggataaaatttttgtgttttttgtgttgtgtttagtagtatggtttaggagtagatattgattgaggtatttatgtttattgaattggaagttgttgattttatagaggttgttgttaaatttgttgtgggggtttgggaggtattgggttgtaatagatttttttttttgagtataatgtttttatttatgttaagtttggttttaaagaaaatagaaatttattgttgttattttatttatttttttaagtatgtgtttgagaaaattgaattttaatagaatttgttttgatgggaagatattttgaggttaggtttatatggtgaatattgtttaaattgaagttttttgtagttttttttatgtggttgttttttttttatttaggtaatagagttttattttttttatttaaataaagatatgttattttttatagttatattgtaagttgagtttattttagatttttttttgggggaataaaggttaatgatatagggttgtttgttatttattgttgttattgttgtatttttatttttgttttggggaaaattatatattagaaaataaatgttagtagatatgtttttaggaatttgtttgttaattttttgagtatgaagtaatagattagttagattttggatttttagtgatttaagtaagttaagtatattaaaaggaaataggaggagagaggtggattttgaaatttatttttggagttttgagaaaattagggatgttttggtagagagttatattgaaataaatttgaaaaatataattttggttatttttagttttgatgtggattttgtaaaaggtagattagagtagaaatgggtatgattgtgttgtagtttagtaaaaattaataagttaaatggtttattggtttgtgtttattttttgtgttgatttagttaatttggtgatattgttttaatttttataattttgtgttgaaaaatattaagtgtgatgttagaaatatattttgtttttttttttttgtgtgtgtttatatatgtgtgtaggaagaaaataatgtagggagaatggttagagtggtaggaattgttttagagtatgtgagtgtatttttaataaagataaaagtgagtgtttaatttaaagttataggtttttaaaaattttattatttaatattttggtatgtgtagtattatatatgtttataagtgatagatatttaaaatttttttatgtaatatagggaggttatagatttattaaaagaaaaagtttttagttgggatttttatagggaatggaagtttggttttagattgaaaatttgaattaatattaaaatgaattgtgtgtatagttgtttttgaagatattttttttaaggttttttttttaaggtttttttatatagggttttttattgtttggaagtatttgtaaattgtttttaaggagttttgtgtatattatggttaagtttagtatggtttaggtagttagtttaagggagttaggttaattgggtatagtaaatgatttttttaggtttgataaggttaatatgttttttaaaatttgggaataagttatatatgaaataggaaaattgttaatatttttttaaatatatttaaatagtatttaaatattgttaagtttattataagtgaatagtatttttattatttgatggggagtggggagagggaagttttagagttaaatgaattgttttatttgtaaaataaattattaaattatgttgtttgaatatgttttatatttttaagatagtatggaaataaatatttttagtttattaaaatgttttttgtttttgtttaaagtaatttttggtttttttatagagtaaaatttttatatttttagtatttattgttgttaatatatattatgtatattaaggaaagtttttaggaataaatttagaattgtaagtttataatgtaagtaattagatttttgaaggggtttttgattttttatatgttatttgttagggatataataaattaatattagagttatgttggattatgttaatatttttattatttgttatgttgtattgatttatttaaagtaagtattttatgtttttttatatatttttattatgttattgtatatgtgtatgtatttgtatagtatttatttttgtttgtgttttttgtagtattttaagtttgtttttgggattagttagttaaagatagtatggttttttattttaaaggaagtagttaagagggggaaaagaaggttagttttaagtattttaattttgttttaatgattaaagttattttagggttgtagtgatatatgtagttattggattgagggaagaatagtttaagttaagagtttattggaaatagaagagtgaggttggagttgtgagtagaggtgtagttttttttagaaagttatgttaggttttatttttgtaattgaatagttgtatggttgtggatgttgtatattgtttgtgagagagaatttttaaagtttaaatttttgaatatttttggagtttttttttattttttggaatgtggggagtaggttgtggggatttgatttaggaggtgggtatatttttaaaggtttttttgtgatttgaagtgtgatttagagatgtattgtattatatttaatttgtgttaatttttttatttttttttattttttaatttagatagattggattttttagttatttaggttattattggtggtggtttttgtgtttgttggaggagggagttgagttggaagttgggagttgtggaagttgaattggaaggagtgaaaagtagagtttattttttttttttgagtgtattggagagaaatatttttttttggtttgtttgttttgtaagggtgttttttgatgaggtttttgttttaggtatttattgaagttttagtgtatttaagttttagaaaagtttattggtttttttttgttttttttgttgaattgtttattttgttttttttttatgaggttttttggttttgttttgataatgtttttttgtatgaattatatttttttgagttataagttttttaatttttttagtttatttgattttggtttgtgtgattagtttatggttttgatttgttgtgggtttttgttaagtagagtgtttgttaagtgtttttaatgtggagatttaaagatattttttaattttattagtgaggagagtagtgttttattttagtttaataatatggttatttgaattattattagttttaaaattagtgaaagaggttattaagttatttggtttttttttagtgtgaataaggttattgaaggagggtagtttaggtgttatatttaagtttaagttagtaatataaattattttgtgtagggtgagaggggagtttattagttttatttgagttaaatttatatatttaaagaattttattataatttgtataaaatggattgttttatgtatagaaataatgaataataaaaataaaattatttgagtattttattataattattatatttttttgtatatatgttattttttgaagtatggtttatgattgggatagaaatgaatagttgataaatttatgaattatgtttttaattttattaataaagagtaaatattttattttttaatgtattatatttttaatgtagatagtggtaaaatattgtgatatagtttgataaaatttagttgttttaaaagtaaaatttttatgaagggtatatttagttgtttttatttgtttttttgtgtatgagaatttttatttttaataagtaggtggggtgtattgtagttaattaggggtttgtatttattgataatgtatttgggagtagttttaataataatttaaaagtattaaataataatatttaattaatattaaaataataattttaataaattataaataaaatataatttttataaaataaaaataataaaaaagaggattaaaaagtttgttaggaatgattgaatatatagtttgtgatgaaaatgatatagtataaatatttatttttaatatagaagtttttttttaaagaattggggaagtattaagtagtggggttagggtttggttttattggtatttttttttttttttgttgggtttggtttgaatgaggttttttggggtttgatttttgtgagtttttaatatggttgtgtattattggagtatagatgttattgtgaggttttttgtttgtgttttatttagtaaataaatattttattgtataggattaagttgtttttttatagagggaggatttattaggaagatgggagttaaattttttttggttagaaaaggtattttttgtttggagtgggttttgtaaatagaatttttagtgagttgaattgtagtttttataatattttttgtgtaatatagttaaatattttttatgagtgtgattggattatggttttgttgaatagtttttttgagtatattttttttttatttaataatatgttggttatatttatttatgataatgttatttggttgggttttaaagtgtaattttagtaaatttaaatatagtgttgttggtatatggttttttatgattatttttgtaaaataagttaattatttgtttttataatatatgtggattttagtgaggttttatttttaattttattataagttaattggatttttgagtattttttgttatttttgtaggttttgtttttatgtataaaataaattaattaaatgatttttaagattttttttagtttttaatattttatgattatggaaaaatttaaatttgtttgttgtttttttttagagtgtggatatttataaggggattttatgaaaatattgtggttttgatatatgtatgtttatatgttatttttttttttaagttataaagtttgttgtttgtattttttttatgtgaagttttgttgaaaagttttgtttgaatggtggttatattttttttattattttttatattttgtaagtgatattttgtgtatattgtagttattagtgtgatttgttatggtattataatttgaatattaatttaaatagattttttttggaagttaaggtagttagataattatattatttttttttattaaaagttttaataatgttaaaaatgtaagtgtaggtatatatgtatatgtgtatttggtttggggtagtttttttttgggtttaaaaatatagattttgaagtatagattgggtttgaatttagtttagatatttattgttagattattgaatttgtttaagttagttttattatttaatattattttatattaaggatttagtaaaggagtatatatatagtatttaatatagtgtttgttatagtataggtatttgatgaatggtaggattgtttattatatatttatttttatatttaaattatttattttaagtagtatatttttttttttattttttaatatttttgaagttgggatgtattttataatttatagtgttttataattgtttattggtgaagtggtagttatgaggaagttttaggtattttttaataaaataattttgtttatattttttttttttgtatatgtgttggaatgatatatgtttaaaaaatttatgtttgaataattttaaaagagtttttttaataagtaaagtaaaaattaaaagtgatagggaattattatttttttttagtggtatttaatataattttgtatttttagattagtaatattttagagttgaggatatgtagtatgttatatgtatttgtgtgtgtatgtatgtatttggttaaaaaattgatttattgttaagatttttttttttgagagtttagttatatttttttaaatgttataataatggatttagttgtaagaatgtaaagttaaaaatgtaaagagaatgtttttaaaatgttatagttgtttaaattttgtaaaatgaaaaatgagtatttttttagtttggaatagtttataaaggaggtaagtatgtgttgtgtgatggttatgttggtgtatttgtgtagatgtatagtataggttttgagagggtaagattttatgattaatggtgtttatttttgatagaagttttttttatttatttgtaatatagtttagtgattttattaggtatttgaatgaaaaatatttagttatattaatattgtagtgtaaattgaggagagttattttttattatatttttttgttttattatttgtatagtaattttttagtagaggtttgatatggaaaggttggatttagttgtatttgatataaagtttttttaattttttttaaaagtttaggttgtttttagaaatgtgtgtgtgtgtgtgtgtgtgtttgtgtgtgtgtataatatataaatttttttttttatttaagtaattttaggatttgaaagaataaagataaaatgtataaatttggatgggagaaatgttgttaatataaaaatagttgtgaatttattggtaaaagtttttttagtgttgaagtttgtggtttagtattgaattttttgtaaggttatgtggttttatttttttttaattaattattatttaaatttagttagtataaagttagattttattgttttttttgggagtagtattaaagttgaagattatagtggtttagagaggatataagttgttgtaatgattgtgatgttatttttgagaaaggaaaaagaaaagagtttttatttgtaggatatttaagtgatgggttattaaattttaaataaaagtgtatttaagtaatagattttataatatggttaaagttaagtaatgatagataggggaatatggtttgaattatagaaagtattggattttaggaataaatggggttttaaattttgtgagtagaatggagattatttattttaaagttttttatttgatagatgaaatagtgaggtttaaaaagttgtttttgataagattatggttttgtgtataggttttttaagggtaatatgaataagtaatttttgtatattatagatatttttaattagatgaatttttttttttttatggtattggaagatttgttttttttttgaagaaggaattgtagaaggagattttgtagttttttgttaagtagttagatttatttttagttttttatgatgttgttttttatgttttgagtaaagtttttgaaggttatgataataagatttttaagaaaagtatttttttatgtagaagttgatgttgtttttttgttgaataatatagataaattgttttttattattatatatattttatagtatattatatatattttttttttatatgtaatttaattttgaaaagttaatattttttaaggggataaagttttgaaatattgagaagtatgtttaggatataaagttttagttttatatagtagttttataagttttatttttagttatatttaaagagtttgttattttaaaagggtttattttttttatttttatgggattaatggttttagtaaattttgaagattttattttggaggagagttattgaattattaatgatagttttttgttggatatttttatataatttaaaataaaggtgattaaaagaattaggggaagtaggagtgagatgttaaggtttaagggataatttaaaaaatagattagttagtagttaatagtaataataattatgatgaggatgatgatgatattaatatggaaaaagtttttatattagttagaagatgagattattgttgataaaagatttattttgatttttgaggtagttttattgtttttttggtttagaattttaggtgttttttgtttttgttataaatattttttataatatttgttattagatttaagattaagtaaggattaaatagttggaatttaattttttgtttttaattaattatatttatttagtatttgaagttttttgaggggaaagtttttgtttgaataatagattttgttttagtgttgttgagatttttaaagtagttgtttattttgaattgttgagatttttatgtaaatgatataaatatgagttggtttgtttgtaaatagatttaattgagttttttgtatgtatgttagagttatttttttttatatttgatgtgtattatggtttagatttaaaagtttttgttaaaggaaattatgatggataagtttttgtattgttggaaaatgtaatatttatataaataaatgttatttattttaggagttttttaggtatagttagtttattatagagggatttagttgtttgaggagttattttttttatattattgggtgttaatatttttttattttgttttgtatttttttttggaaaggatattattttgtttatttgagtattgtttttgagatggaattggtaatttattaaattatagaaaataggattggtagaattaatggaaaatagagaggaaagttatagaaattaaattgattaaaaaatttttgttttttttatttttaaagataaaagtttttattttttttttttatggtaatgaagttgttgaattaaaattatagaattattatgtttttgaatttattttgaagaaaaaaaatttattattttaattaaggtaaattaaattgtttaatttatttgttaggagaaaatatgagatgggtgtgtttaagtaatgttgaagtgatattatagttgaatttatttggttataaatagtttattttttattaggtttttgagggaaattagtatttaataaggtaatggaagttaggtgattttggttttaattaatttagagttttaggaatggtagtagtagtaggaatgaaggtgttggttgtaggggttaatatttattgagaatttattatgtgatagttattaggttatatgttttttgtatatttttttgttaaaaaggaaatggtatagtgttgttgtttttttgtttgggtttaagtagttggagagtaaagtaggtttttaaggatttagtttatttaataggtaaatttaagtttaagattttgtaattggtgtatagaatagtttattgaatgtatatttttaggtatagggagtaggagagtgagatagaaggaaagatttttttgattttttgggtttggttggattggtttttgttgtggtttgttttattggaggaaaagggattatttaagggaaaaagtttggttgattaaaggtaattatttgttattttaggggaagaggagaggaaaggatagtatttgtgtgtttttttaatgtagattagttaggaaattgtttagaaaatagagttttattagatgttatagaatttaattaatgagagtagttttttattgtttatttaatatggtatttaggtggtaggaaaagaattgtaattggatatatgaatgttttttttgatagtgatagttgtttttttattaaggtggtatttttgtggatattgtaaagatggatatagtatattagtttttttaataatgaattatatttatttttattatattaattaatttataatttgtaattaagaattataaatgaatattatatttatttatatttattaattttattttatatttatataatatatatattatataataaaatattttatataatagttattggttttattttttttattaattttagtaattaggggaagaagataagaaaatgttttttatttattagatattgtagaaataaggatatttttgtgtgaattatttggattttatttggaggataaaaaagtttgttaaaataataatttaatatataatgtgtatttatggaattaaaatatttaaaatatatgttatttaaaaataagttgttatttgttatttggtttaggtatgtttttttttttattttttttttttttttgtttttaattttaaaatgtgagaaatatatattgagttttttttaaataaaagttagtgggatagaatgtagttttatgttatgagatgtggttatttagtttttaagtatttatttgaattagtagtatgtttattaagatttttttttaataatagtgtattgtatgttatagtggttggaatggattttttttttaattttttgattttgaaattttaatttattaatgagttatatttatagtatagagtagagataaatttggtatattgttttttgtagttttttttggaaggaatgaaattaattttagttataaataattgtattgtttttgtatagtgatatttgtataatattgttttagttgttggaagaatatgattaatatgtatttgtttggtttttttttttataagaagtttttttgattggtttagtggtagtttttgttttttttaaagttaatatatagatgtttattttttatagtttattttgaatttagattaatgtgttagttagattatttttgttttatagtagtagatatgttattatttatgttatttttaaagtattaatattttgtaagttttgagaaataaaaatgtgtattaatttgattttttgaatttaattgaaatggttgaaattattgtgggaaattttgatgtatttggtatgtatttttttaaaaaattattgatgaataatatagagaaagttgtataaaatgtatatatgtagtttagtaaatgatgatgaatgattatggagtgaaaatttttaatttaatagttttagaaatagaatatttttatattttataagttttttttttatattttttatttatttgaaagttaatattattttgattattttaatattgaagttgatttttgtttgttaaagaattttatataaatgggattatatattatatttttttgtgttagtttttttttttttttagttaattttaatttttttttgatgaattttttattttatttattatatattttttatttttaaagtttttttattatatattttttattttaatagtttttggggtataagtggtttttggttatatggatgaagtgtatagtggtgaagtttaagattttagtgtatttgtgatattagtagtgtatattgtatttaatatgtagtttttttattttttatttttttttgttgattttttgttttttgttgttttttagtttttaaagtttattatattattttgtatgtttttgtatatttatagtttagtttttagttataagtgagaatatatggtatttggttttttatttttgagttattttatttagaataatggtttttagttttatttgagtagttttaaaagaaattattttattatttttatgggtgttgggttttttttatttattattatgtttgtgagattttttatgttgtagtttgtttatttttatagttgtttattgttttattgtatgtattatttgtttattttattgttgatagatattaggttgtttttaatttttaagtggatgattaatgttgttatgattttttgagtatatgtggtatatatgtatatgtgattgttttatatattttaaagaaaaggattgttggaatatatggtaagaatttgtgtaagtatttaatgtttgattgttttttaaagaggtagttttagtttgtgtttatattgagagtttttgttggtttaaatttttattaatatttgttattgttagattttttaattttagttattttagtgggtgtttaatgataatttattttggttttaatttgtattgtattataaatgatgtttatggagagttagttaaaagataatagaaaaattttattatattaagaaataaagtataatttaaaatatatgatttttatttttaatatgtaagaagtgtataatgtttgagaaaatgttggaagtaattatgttaaaatgttgatattggttagtttggatagagtgaatggttatttttttttttaaataattatttgttttttttatttatggaatattaagtttttttatatttagaataagagattttttttttttttttttgagatggagttttgtttttattgttttggttggagtgtaatggtgtgattttagtttattataatttttgttttttgggtttaagtgattttgtagttttagttttgtaagtagttgggattataggtatatattattatgtttggttaattttttatttatttatttatttatttatttatttttgtatttttagtagagatggggtttttttatgttggttatattggttttaaattttttattttaggtgatttatttgatttagttttttaaagtgttgggattataggtatgagttattatgtttggttaataaatttatttataaaaattttttgaagtaatgttttattattaaaataaatatttttttttttttttttgtttttaaaaaaattagttttagtttttaaattttttatgtaagaaaatatttattattttagtattaatgtatatgttaagtaatattttagtttttatttttagtggttatttttatttaaattatatttattttttgtgttggtttattgtttatattttttatgatttatatgtttttgggagttttttgtgaatgttttttagttgtgttattatttattaggttatatttatttatatatattttttttgagtgtagttttttgttttatttgattgtaggtttttttagagaagagattatgtaattatgtattatgttttttgaaattttttttaagtgtagaaattatagtggatttttagggaatggatttttaataaaatgttatattagtttatttttatgttgttgataaagatatgtttgagattgggtaatttataaaagaaagaagtttaatggatttatagttttatgtggttggggaggttttataattatggtggaagatgaaaggtattttttatatggtggtagataagaggagagagtttgtgtagggaaatttttttttataaaattattagattttatgagatttatttaatattaggagaatagatttgtttttatgatttaattattttttatatgttttttttaataatatatgggaatttaagatgagatttgggtagagatatagttaaatgatattaaatgtatatttaatgaagagattattgaaatgtttatttgtgtggttatatatgtagtttttaaaaattaaaatttaaatggtaaatttgtaaaaagtatatgttaattaagaatttatggaaaaatattttatagttataaagatgatgaaaataggattggaaatggaattattttattaattaggggtttgggggttgatggagtgggtatgtatagaggtgtgggtagggttaaggggataaataagtaatagtaaagtttttaatatagttaaagttggaatgaaaaagtgatttagtgagggttggagtagtagaggagggtttgtttattaggaatagtggttttgggggagtaatgttatattatagagttatagttagtagagagggaggaggggatttgttttttttttttgttattttttgttttgttttttttaagtggaaattggagggaaggtgagttagttgatttagattttaaagatgagattttttatataggttgtggttttggggaggaggaagagtagatggaaagtaattattataattatttgtattttttagggttatgtggtgtttttagggtagaggttatttgaaagtttattttgtatagagggaaaaaaaagtataggattgtgtagatttatgatagtgtttattgttttatttttgaatattttagatatttgttttttttagtgtatggaaaggaagaaaaatatatatgtgtatatatatgtgtatatatatatatatgtgtatatatgtatatatatatatatatgtatatatatatgtgtgtgtatatatatatgtatatatatatgtgtatatgtatataggtatatatatatatatttgaggtaaggttttatttttttgtttaggttggagtgtagtggtgtatttatggtttattgtagttttaattttttaggtttaagtgatttttttgttttagttttttgagtagttgggattgggattgtaggagtgtgttattatgttagtttaatttttttatttttatttttttagagatgaggtttttttatgttgtttagattgattttgaatttttaggtttgagtgatttttttgttttagttttttaaagtgttgatattaaaggtaggagttattgtattgggataaaagtaaatttttttttataaattttgatttattaaaatggtatttattgaataattaattaattggttaaaaatgtattaaaaagaataattattttttgttttttattagattattgtttgaatatgaagaaggatgtttatttgttatatttaaaaaaataaaaaataagtttatgtaaaaaattaatatattttagttttttagtagttggagtagttatgtagagatgtaggagatatgtgtatatttttagtattttaagtaatgtgtgagtaaattgtaataatttggtatgtaaattttgtttaatgtttttataatgggtaatgtaagtgattaaatattgtgattttaattttggtattttagtaatttagtaagatagatgaaaaggtagtaatgaattagattatataataatattttattttaatttagaagtttagttattttttgtaatatgttttaagttttttatggtgtattgttaaaaatgttttgataagaattttttatttttttattgtaatttatttttatgattatataaaaaatattttgaaattaagttatttatattaataaatagtttttattgggtaatatggaaataaaatgttagtgatttattaggtttttaatgttttggaagatagaggggtagaaatagtataaagggttttatttttgagaggatatagaggtattgtatataggagttaagatatagggataatggggtgaggtatatttttttagttgtgttttgtagttttaataatattttatagtttgggaatttttggtgtttagatagtagtttgttagatttagtttggagggttataggtatatttttatatttttttgttgtaatataaatagtatggaatgtttgtttttggattagttttgaattttagtgttttttttagaatgtttgtttgttgtttttttttttttggtttgtgtttttttttaatgattgagttatagatagttttaggatagagagaaggtggattgttataaagattgaaagtggtgatttttagtttatttttgtgtgtatttattaaaaatgtgtattaagtagatattatagttttttttttggtattatttttaatttttaaatgaagatttttaataagtttgataaatatttattaggttaagttgatgatagtttgtaggaaaatatatgttatttttatgggaaattttgtggttgttttttttatattttttttgttttttttttttagtggaatttagtttttttttggttataattttgagtgttttttatatagtagtgaatatatgtttgtttgataaatttaaggagtttaatttttttttttagatttgttttttagttaaaaatataataattgggttgggagttatggtttatgtttgtaattttagtattttgggaggttgaggtgggtggattatttgagattaggagtttaagattggtttaattaatatggtgaaattttgtttttattaaaaagataaaaatttagttgggtatggtggtatatgtttgtaattttagttatttgggaggttgagataggagaattgtttgaattttggagggtggaggttgtagtgagttgagattgtgttattgtattttagtttgggtaataagagtgaaattttgttttgaaaataaaaaataaagttataataattgataaatgatttagttgttaagaatttgaagatggttttgttaggtaaggttaaaaatatttttatttaaagattatttatatgttaggaggttgtttggttatggtagttgaagtttggatgtttagttttgtttgtttagaaatttatttttgttatattttagtattagagaaatatgttaatttagtttatgagagtttaatgtggaaataattaataagtgattatattttaatgagaaattgaatattagttattgttttgttagggaataaattgttatttggatttttttttttttgagtttagaattagaagaaaagaagtgttgttggttggttttataagaatattaataattatagtatttaggtattgtgtttttatttttatatataggattttagtttttatggtagtttttggagggagttgtgattgttttaattttgtgtataaggaaattgatgtttgagtgagggaataagtgaagaaatttttaaattttatttttttaaagtttttgtatttaattattgattttatttttttaattattttatgtgattttatgattttattaagggaggttttggaaaatttaaggaggtgtttttaaggtgttgttagggagaggagtaaagttgattggtgtgattagatttgttatggaaaggggatttttttatataaaaaatttggatatagatgtttatagtagttttatttataattgttaaaattttgaaataattaagtttttttttagtaagtgaaagagtaaataagttattttatataatggaatattatttagtgttaaaaggaaatgaattttgaaaaaatatggaggaaatttaaatgtatattatgaagtaaaagaggttaatttggaaagtttatatattgtttgatattttggaaaaggtaaaattatggtgagggtaaaaagatgagtggttttttggggttgggggttgggagaaggaagaagggaagaattggtgaaagaggatttttaaggtagtgagattgttttgtatgatattgtaatggtagatatatttgtttaaatttgtagaaaggataatattaagagtgaattttaaattatggattttgggtgatgatgatgtgtgagtgtaggtttattatttgtaataaatgtattattttggtagaagatgttgataatgataggaggttatttatatgtagaggttgggggtgggggttatatgggaaatttttgtattatagtttaattttgttatgaatttaaattgttttaaataaagtttgttaataaaaagaatgttttaatattttaatatttgaaattatatagtatgttgtatttgttatttttattatgtatgtatatatgtttatatgtgtgtatatatttgtgtatatatatatatgtgtatataaatatgtttgtgtatatgtgtattatgggtggaatatgttagtatagtatgtgatgtatatgttatatatgattttatatatggatgtatgtgtatatttgtatatatgtgtgtgtgtgtatgtgttgagtatttagtatatattaggtttagtatatgagattttatttttgttaattttttaagatttttatgaggttattttttttattggatttttaaggaagaggagaaggtgagtattaaggttgaggtttatgtatattgagttttattgtttggatatatttgtatttagaatttttgatgatttttttatgattgtttgatgtatttgtatttttatttttaaattttggaggaatttttttttttattgttgttttttagtagtatgtaaaaggattgtagagtttagtgtttttgttagagaagatatgattaggttttggagttttatttgtgggaagttggtttagtaggtatttttagtgttttggtgggaaaggtttgaatttaagtgaagtagtgatagggatattagatttgatagatttttgtgaggagaaaatagttttttaggttttttttgggattgatgattattttagtttggttgttataatttttgtgtttttttagatgttgattggtttttttgtgtataattttttaaaatagaatttggatttttagggatatttttattattttttttaattttggaattttggagaaataataggttttaatttttgggtaaattaagaaaagttagtaagaaatgttattgtttattttgatgtttagtttatgttgtttagattaagttatttttggattgtaaaagttggtttaggaggtgttattttatggtttttttgaaatagtttttttgtatttggtggtattagttttttagtggaaatttataaataagtttgtgtttagaattagattggaaggattgtttgtttttttttgtgaagaataaatgaatgaattagagtattttttgtattttttaaggtagtaaatatatttaaatatggtgtaagatttaattaatggtggatatgtttaaatggagtttaggggttgagttaataaagaatagaaagttaatttgttttgtagtaaagagttaaaataggaaagattaataggttatgttgatttttatttaaataagttattttattaatttttgattgggtgtgaaagttttaagttgttttgaaaagaaatagttatttgttggtggtgattttttattttttttatgtgtaaatttagaaaattttggatttttattttgtttttttaaagtagtatttaagtaataaataaaaagttttattttttttttagtttaaaatgaaaaaagagttagaaggagaaagtgagaaaatttatttttattattatattttaattttttttattttttattgagagaaaatttattatttgatttttgattttatttattttagtgtttgtgttgtgtatttagtggagttggtttttattaagattatattttgatagggtgatgggggttgggttgtgtgtgagtatttgttttgtaaggagaaaatgtgttttttttttttttttattttatttttaaagttagtggtggaagaggaatttgttgtttttagttgatttttttttattagggttttttttttttatggttgtattttttgtgaatgaggaaaagtggggagtataattgtttaatttgttagagttagttttttgattatttatgttaaatgttttttgttagagaaggaatttggtggtttaggaggttatgtagattggttattttagaagtggttgttttagggtgtggttgtggttatggggtagtaggtgtgaggggattttgaggaatttttttttagaagtagattaggatattgtggtagtaaggtgtgttttagaatttatttttattaattaaaagtttatattttattttagtttattataattgatgtaagggtttgattgaaaatgtatttttttttaattttttaatttgggagtatttagttgttattgtttattgaatgtggtttattgggatgttttatggaaaagggtttgagtagaaagttgattttaggtgttgttgtataaaggggaggagttgttttttaagtatttatatttggatttataaaagttattttatttattattgtgaggttttgggaagttaaatagatatgtgtttggatttttagagtgattgattttttatttttaagtagatttttgtaatgggtttttttttttatggatagttttgttatgtgtatgattaggtttttagattagataaatttgggattgtatttttttattttgttttgttttgtttttttttttttttttttttttttttttttttttttttttatttttatgtaatattatgttagtaagaggtaagttttaaatggtaatattaatatttgggttaagtggaaaatataattgtagtaattattttaagtttagttgtttgttatttagaatttttttttatggaagaagttataggttgatttttattttattattttggagtgtaatgaagttttttagagattaatttatttttttaaataattgtatagtgatgttttgtttgtattatattatgttgattttaaaataatagtattaatatgtatttgtttgtagttttttttataaggtttttttgaatttatttaaaattttatttatttttttttagagatagtttttgtttgtggagatatttgttttatgtatattttttgtatttggttttttttgtatttaggatttttgttttatttagtagttttatgtatttggatttgttttttattaggatttttttatattggaattttattgttgtttttgagtttttttttagttttttatatttttatattaatttttatatggattatatttgttttttgtatagtagtttattgttttttatgattttagtaatttgtgggttgagttttatagatggtaagtttaggatggattttgtttttggagattatgtagttttttttttgttttttatttgggatgtgtataaagtagatttgatgtttagtgagtgttttttatgtgttaggtgttgtgttttgtgttttatatgtatgattgtgttttagttttgtaatattttattggtagtggtgttattatttttatttttatgttagaatagtagtgtgtagtggggtttatttgtaatgtagttaattttatggttagtaaggggtagaggtggaatttattgaaaatgtttttgatttttaaatttttgttggtaattagggttttgttttgttgttttatatatgattagattggttttgtagttatttatatatgtgtatgtgtaatatgagtgttttatttattttttgatgaatatttttttgttttgtgtgtttgagtatatttatatagatgtgtttgttagaggagggttttttaaattttagtgtgtttatgaattatttggggagtttgataaaatgtgattttgtattaggtgggattaggtggggtttgagattttgtgttttttaaaagttgatgatgttagtgttgttggtgtttggattatattttgagtggtaaggttttagaaaatattatggtttagggttgttgtttgtgttttttatttttgattatgttatatgaaaatttgaagaagtatgtattgggaaaggaaatgagtttagatttttttatatttgttgtttattttaggtttttaaggattgaatttttgttggttttgttagtttttttattattttttatatgattttttttaattggagttgtgtatttttttggtgttaatttataaattggttttttgatttaggaaaagtattttttatattatgtatatataggaatttatttgtttaataattattggaatttgaattaaggtttagaattgtattatttattaattataggtagtaggttttgaattttttgtaagagattgtaaattattattgtttgttttatattagagaaatattaggtattttattttattgagtagtgtttgatgtgatttttatgttttatttatattttttaggtagatgtttttttgaggttgggtgtgtatggtgagaagttgtatgaagtgttttaggaaatatttatttatttgggtttttagaaatagtttttttttagtaatagttattttttttttttttgatttagtgtattgaatttattggttaataatagtaatataggtagttaaagaataagttttgttttttgggtaggattaatattttattttattttgagaaagggttttattttgttttttaggttggagtgttttggtgtaattttagtttattgtattttagatttgttgggtttaagttatttttttgttttagttttttaagtagttgggattattggtgtgtattattatgtttagttaatttttatattttttgtagagatagtgttttgttatgttgtttatgttggttttaaatttttgagtttaagtgatttatttatttttattttttaaagtgttgggattataggtatgagttattgtgtttggttaagatttatattttaaaaataaaaattaaatatgaattagattttttgttttagattttattttgtatttgaagaattggagaattattttttttaagtttttgggagttggtggaaatgattaataaggagaatagattgagggagagagggaggttagttgataatggatttggaattatgtttggtttgtagaaatttatttgggttagtggaaagttatattatgagttaaattattgaaagtatttttattatttgttttgtgtagtatttgatgatgagtatatatattatattttttgattggtttatttgtttttttttttttgttttttaagaatttagttaatataattaaataaagtaatatgataaatattttttttgtggtttaaagtttttttttttaaatttttatttttattatgtattatggataaaaagtatatgaaataaatataaaatatttataaatttattattagagtgttggtatttttagataataattgtaaaatttttattgattgaatgttatgtgttaagtgtgttatatatataatttaatttttgtttttgatgattttatggagttagtttaaatttagatttttatgagtttggaggttatttttagaattgttataatgttttgttgtttttgtatgaaaattggtaggtggaaattgattattattttgttagaaagttgagttttggtagtaaattgttttagattgataggtatattttttttttgattttgtaatgaagaaaaggaaaagagagtttttaaattatggaatgtaaaattgtagtttattatttagttgtgttattaaagttgtgttgtttttttttatattggtaaattttgattttttatgtgagtgagagttaatttagatatttttgttagaaagtttagaaaagtattttaagtatgtttggaaagatattatagttttttaagttgtttattattgtaagaaatgtaaatatatagtgatttgatataaaaatgattttatttggggggtaaatgtggttatgtatatatatatattttaattattttgatttgttgataattttttagattaataataaaaatttagtaatgtattttatttttttttattttttttttttagttttatttttaaataaaagatgttttatggaagtaagagtataatttgagttaaaggagttttattttaataagttataaaaggaattgttgatgtgggttgtgtaatggattttgagatgttttaagagaaatttttagttgatttttttttgttagtaattatatattttttgtttttttttagtgttttatgtaggagttagtttagtagaatattattattagatggttttgttaattggttagtgtagtttttatgtagatattatttttttagttgttattgttggtatgggggttatttatatggaatatttttatgttatggatagtaagtgatggggttggtttttagagttttgggaaatggtaaaggtaattttatgaaatagagaagaagatataaagattaggtgattgtgtaattttttgatttggaggagaaagtggaattattattatttggtgttttggttttttttgttttttagaagtttttatagatttggatattttgagattttttgtttagtttaaggatattagtgaattgatagatgtaggtaattgtaattgatagtgatatataaatattagttggttaaaaaaaattttagtttaggtgatatagtgagatttatttttataaaaaattaaaaattagttgggtgtagtggtatgtatttgtagtttttgttatttaggaggttgaggttgaaggattatttgagtttaggaggttggtgttgtagtgagttttggttatgttattgtattttagtttgggtgatagagtgagattttgtttttttaaattaaaaaaatttttttttgttgtgattgttttgataataaaataagggggaatggatttgatatatggatggattttgtttttttattttttggttttatggattttatgttttaaaaattaattttaaaaaatatttgttttaataggttttatatttttgttttaaatgattgtttgttttatatgttttttttatattaaaaaaattgtattttattaagatagtttgtagttgttgaatatatgaaaggattagaatagttattaagttattaatagttgttaaatagtttatttggaaaaaataaaaattttttttaaattagaagggattatttttagtatttagtagtggaataaggtgagattatttgatgtatgttgtattatttattttggggttttttaggtgtgtaatgatttttgtgggttatttatgtagatgtatagataagtaagtttataattattttttattagagtattttagagtgtttatttttttagattttttaaggatatatttgtttgtaaggtgttttgaagtgattttaaagtattatttaagttatatattagtaaaagttattatttttgaataggataatagtatgattttgagtagggtttttgtttagtgttttgtttgttttttttagtagtagtaattaatttatatttttttatttataatttatttggatttttttgtgatagagggtgagtatatgttttttagttatttagttttgagttttggattagaaagaaggtgattattttatataggggtaaaaattttatagttttagtttgtttattattaagagttatttttgtgtgttttattggaatataagattttgttggtttttattgggaagtttattattatatggaaagtaaaagaaatgtgttatgttttttttaggtgttttgttgtttggttttttagtatagagagtttatattttagatttattataattatattttaattagtgattgttgaaaaaaaagttgtgttattatgtaaattagttatttaaaatttgtaaataaagaattaaaataagagagaatttttggaaggttagtttgtattattttttttatttgatgagaatgtgtttagttaggtagtggtggtttttatttaaataaaggatgaagttatttttttattttgtaaaaattaattaaaggaattttaatttgtttgagtatatggtaaattgattgttattaagtaggaatttagatgttttattatttattatataaaaataaattttttttttttttgttagaattttttattagaatagggaaataaaataattaatagaaagttagattggagatatttgtgttagaataataagaattttttggtttatatttaagaaggaagtggtatgattagtgaagaattgggttattttttttttggttgttttgaaaatgtttattttgtattttagtagttttttttaatagagtattttaaattattgtttttaaatgttgattttttttttttttgtttgtttattaaggagttgggaagaatatattaaagggttggaaagtttttaaggtattatattttttttttttaaagtaattgaagtagtatttattaatagttatttagttagaatataagaagattgtttagaaatttttattataggagattttttttaataaagaagtgaaatattaattttaaatttttatagtggttgtttatttgtagtggtagattgaaatttgggatttatttggttattttttattttttgttatagatatttaggattttttaattaatataatttttaataaattgggtttaggtaagtatttgatttttaaatagtgggtatgtttaggttttagtaagatgtaggatagagtgtttatatgtagtttgttaggataaattagtttgtttatggttttaattttattttttagtgttggagtgattttaaaagatgagaataaatattttttataaggaatattttagagatgagggtttttgaagattattatttatattggtggaaatagatttaaataagagttagttttggagggaaaaatatagagaggaaaggttttagttaggttatgagtaagttaaagggttttatggaaagggtgaaaaggttttgagaggttttttattttttttggaggatgtgagagtgatttaaggtttttagggtttgagagtattaaatgggttttttttttttgtattataattagtgatttaaaatattagagattttttagggatatatttatgttttgtttagtatgtgttgttatttttaattttgttagtgattattgagtattattgagaagggtaattattgtttaggattatatggaagttgataataaatttggtttgttatttggaagtgatatgtatttttttattgaaaaatttttatgatgaaattagttttttatggtgagtaaatgtgaaggagttgtgtttaataaggtagatgttattataaaagtaagatgttgatttaaatgttttaaaaatatgtataggtgggtgtagtggtttatttttgtaattttagtattttgggaggttgagattggtggattataaggttaagagattgagattattttggttaatatagtgaaatttttgtttttgttaaaaataaaaaaaaattatttgggtgtggtggtgtgtgtttgtagttttagttatttgggaggttaaggtagaagaattgtttgaatttgggagatagagttgtagtgagttgagattgtgttattgtattttagtttggtaatagagtaagattatattttaaaaaaaaaaaaaaaaaaaggaaattgttgggattgttattttgtgttaatatgttttaaattaggttggtaatgaaattattttaaatgaaggaatttgttttagttgtgtttgaaagaaaaatttgagtaggtattatatttattatttaagttggtttttaagttttatatgtggatggtattaatttagtaaattttagtttgtggatttttttttattatttttatagtattgataatgaagttatttatatttatttattttatttaattaaatgatttttaagtatgttggattgttattttgtattaagaattatttttattgaataaaatatttttaaagaattttttggagattaagagtttggatatttttttttaaataaagaaagattatttgttattttagttgttttgggtattgtaaaattgttatttttttataaattggtatatttattttatgaggtgttagaaattttttattttatttaaaattaattatgttttgtttgttttttatgtggtgagattatgtttttatttgtttattaaattttagtttgatgattttgtaatgtaaatatgatttttaaaaaggtagaatggatttgtgggttatatttatttttgtgttttgaagtttatatttttaatatttattaaatttgaatgtaaattggtatttaattttgaattttttaggaagaaattattgtattaagttggtatgtatttaagtttgagttatttatttttggatttggattttaggttaagattttattagtggaatttttttgaaggttaaaaattttaataaatttattattttttattgggtttgattagagaaataaggtttagagaagagttaaaatgttttataggtttattgtattttgttattatgtttgtaagggttttttttttgttttggaaaatttgtaaataagtaatatttttattttttaaatgttttttgggatttatttttttatatggggaatgtaaggtagaggtttttaattttggtgatatttgggttagataattttttattgtggggagggtgattttgaatattatagggtgttttgtagtatttttagattttattttttagattttagtagtatttgttgagttttgaaaattagaatgtttttagatgttgttaggtgttttttggggggtaaaattgtttttagttgagaagtattgatttagggtaattatgtagaagttgttttagtaatgttttaagtatattatagagtaggtaattttagaaattattgggtattgagggtataattgagttgaatttttaattttaggatattttaatttattttttttttttggtttatgatttaaaatggtgtgtgttggggtggggagggtggtatgttgttattgtgggaattattgtttttgttgtttgtggtgaattaatgatgggaatatttaagtagttgttagatttataaattattagaaatgaaagggataatatataaaaattttttttttttgtttagtaatttattattttttttgtatattaataaatagagtttttttgaggtaagtttttggaagataaatatttttttttagtttttttaattgtagttagtagattatatgggggaggagaggtgtttgttattgtaagttgttagttttttattttttattttttttatgtaggtaagtagtaataaatagttggtatagagtttaattgtaggtaattaggtttttttttgtttatataataggtattagattttttagttttaggttgttagttaggttgagttgaaaatgtatattgtttatattattattttttgattatagttttgatttttagattatgataaggatgttttttaattttttggttatgatttttaataatttttgtagtagttttttagtaagtggtttttatggttatttatttgtaagtgtaattaggtatgtatttttttgaatttattatgtgttttttaaatgtaatgttagtatttgtttgtatttgtagtgatgtatttttagtattaattgtttatgaggaagaataaaagtgtatgatgttgtgtttatattaagaggtaggttaaatattataatgaattgtaaaattagttattgggttttagattattttgtgtttgtagatattagttaatagtttttatatagaaatagtagttattgagttatgatgaaatttattttgtagagatagtaagtagggtaaatttttttatttagttttttttttgtaataatgttttttagaggaaaattgattttatatttggttgtatgatatatgtatagaatatgaataaaaataaaaagattagttatggtagaagttttgttttataattttgaagagaaaggagtttatgggagggagagagaaatagtaggattttttgtttgatggaaaataagtgtagatgatattggaaagtatagatattagaggaaatttggtaaaagaatatttttttgtttttttattaagtatttttagtttaatttgaaagatttttattttgattatatatttttgttaattgtggatagttttttgtttgatagaaagtgttttgatatttttttttatgaagtattttatgtttgtttttgtatgtgaaggtataagtatagatttttgtaaatatgattaatataaaatattttttattgttaatgattaatttggattgatgttagtaagtagggaataaaagtaagttaatatatgaattttaggtgaattatttgattatttattgtttgaattaagttagtttataaatggttgagatatagaattagatagtattttaattaattaatttagtaattttggttataaattttaaatttttattttttttaaattttttgttaataatttaagaatttagttattagtaatttttttgaattgtagttttgttaattgtgaataattttttgtttgaaaagtatatattaatggatgtttttattagtttttgttttaataagtgaggttttgtttgtttttatgaatgagtggtagtgttagttgtttattgataggttttttatggtagattataattagggaaattttattagtttagaaaaaaaagtgtttgtagtagtaagatatttatatttagtaaaaataatgaatattgttgtttttttttaatgttttttattatagttttaatttttgtttaattattagtaatgttttttagtaggtaagttaatatttaaatgtggtaaattttaattttaatatgatgttattttttgttgtttttttttgttttttttatatggttattgaagtgtggaaatgtggatagttgtaagtaattgtgatagtagttagtgtatagggaggggttttggggtattttttagattaattattgtagttataaatataggttttagagttggatatgtttatggttagattttagttttgttattaattagttatataaatttaatttattttttagttttttgaagtttagtttttatatttgtaaattatagataagatattttttatataggaagaatgtatattttattaaagttggtgtggatttgtaatggtaggatgagatttttatttggggtgaagttttagggggagttgagttgggatggtttatttaggagaggagttattttgtgatggttgtttatgttatattgttttttattttagtttggttttgaggaagtatgttagttttagaattttggtttggttgtttttgtatttttggtgaatatttttgggttatagattgatatggattggaggtgattttattgtaattgtgtaattattatatggtatgattaaagttatagtatttaagtagtagaaatgtggtatatagtgatagttagaaagataatatataaaattattttatgaatatttattttttttgtttttttttattttttttttttttttgttttttgtttaggttttttgattttttatagtatttaaaggatatagattagaatatggtatagaaatggttatgatgttatttttatttatttttattttagtttttttagtttttatggttttttggtttttttatttttatttaggtaagttagtgatagtatttaatagattgttaatttgttgatttgaaattattattgtttattttgtttttaaggagttatattataattttttatattattagagatggaagaagagatttatttaaagattagttaggtttttggaggttgtgatagttgggtgtttgggtttattgtgtttttatttttttttttgtttttgagatttttgattgtatttttttttttttagtgtaatttttttttttttagtatatatttgttgtattttaggattatatgtttatttttatatagagtaggtaatgtagataatttaagatgagattagttttttatataatgatgataataattgttattattggtattatttgttagttttttagttggaggagtgttagtgttttgtttatttttgttgtaagttttattttttgagatttaaaaattgattttaggaataattagttagtggtagtattagaggatttgggaaaggaaagaagtaaggagatatttagaaaaggtaattaatttttttaatagtgaaaggtataggagagaaagttgattttaggtgtgtttagtttttgtgatatgttgattaatagggtaggtgtatggtttatgtttatttattgtttttatgttatagttatttggtaaagtaagtggtgttattattattattatttttttttgagatagagttttatttttttgtttaggttggagtgaagtggtatgattttggtttattgtaatttttgtttgttaggtttaagtgatttttttgttttagttttttgatagttgggattatagtggtttattattgtgtttagttaatttttgtatttttagtagagattgggttttattatgttggttagtttggttttgaatttttgaatttaggtaatttatttgttttggtattttaaagtgttaagattataggtgtgagttattatatttggttttatttttgttttatatataagtttagtgggtttttgtaagatgaagttagtaaagttttgtgtttggtgggtattagtattagtattttagttttttgtttgttaatttattttaaatatatttgatttttatatttatatgttttttaatatttaatttgttgttggtattggtagtgtattagtaatgatgtttatatttttaaatatgttattaaatgtttaaagatatttatttagtttttaagaaatgttatagttgttttttttatatttatgttttagtgtaaatgtggttaaagatgtttgtaatagtatttattattatttgatgtttttatatttttttttttttttagtagtttgttatttatttttttttaatagaatataagtattaaaaagttaattattgtgtattttttgttttaatttttgtgatatttgtatttttttatattgatgttatttagtaaatattttttgagtaaataaattaaggagtttttttatgagtaattagaatttttattatttttttattaaagtaagtttttatatggtggatgaataattttggttttttgaaagttgtaatttgtatgagtgttatattattatatggttagagattgatagatatagagttagaggggtgaatagaaaataaaggattaaaaaagtaaatgtttattttaagtttgtgtgtggtttttttgtttatatatttatttaataatttagattattataaaaatattatataaaattaatatttatttataaaagtttattgatatattataatagtatttgattatgttagattttttaaaatgtattgtttagatgtatttgataagttttttaaaattttataattaaatagtttttaaaaataattttatgtatattggaaagtatgttataaaatattgtatgttttaagaagttgtggtttttttattatttggaagattttttatttaagattagataatttatatttattaaatatagttagtaatttttattttatatagttaaggttaatgttgtaaatagttagtgaattatagtaggttaaaatagtgtatttttgttaaaatttttttttttaggaaattgggttattattggaagagaaggtgtttaaaatgattttttttttttgtagttttttggtaaatgtaaatgggatgaagaaatgagtattttatgtatttttaatttattgggtattatttttttattttttatttaatggttataatgaaagtggttttatatttttagtggttttaattttggtgtgattaggaaagagattttagtgaaaatgatatttttattttgtatattatttttttgagtgttaagatttttagtgttataaaatagtgtaatgtttttttgttgttaatattgatgagtttagtttgatgatgagagggtaagttgtgttttttgttttgtggattattagttttgtttgatattaggattttggagtaagggtgtatttggtaggtttattgatgttgtttgaggtagggtggaagttagtttggtttttatagttttttggttttgtgtttagtaaatattttgtttatgttagagaaataatatataaatgaattgagaaatatattgataaatagataaatatagtgttaaattattgatgtttttaaaatttttattttgttttttaaaaatttggagatgatatttttttttttgatttttagtaaagtagttaatattattttaaaaagatagtttttatttatttttttaaaagtaattaatattatttgaagtggtagttagttttatatagtattttatttaattagttattaattttttaaatatttagttgagtttaattttgtgttagttgttgtattgggggaatgggggttatataaatgtttgagagagatatgatttttatttttatggaatttatagaagggaaaagtttttaagtatattaataaatgaatgaatgagtaaaagagttagtgagggaataaatgaatgaataaaggagtaaaggagttggtaagggttttggttagtgttgtaaaggaaatgatttagatgttaagaaagaatagtattatgggtttaatttagtggattggttattgatttataggatgatgataagatattttggaaagttttttataagtttttaagaaggaggttaagtaggtgaaggttttgaggtgggaggagtaaggtattgggggaattgttagtagatgatagttaaatatggggtaggttagttaaagtataaggttggtgatataggtagggtttaagttatattatagtattttggattatatatttaaggataataggaagggtttaagatttggggttttagatttggaagagtagaaatttaagggttttttttggaggttttttataaggttgtttaattttatagataaggaaattgatgttaagagaggttagtagattgaattaaaggtatttagttatttatatggtagaattataaatttaatttggtgggttgaattttgagtgtttattagatatattttttttttttttagaaatttttaaatgagaggtatggtgaaaagtattggtgggaaatgttatttataatagaaataataatatttgatgatattttgaagaaatggattatgtatatattaatatgatttttttaattatatttaatatatttgatgagttagattttatgtaagagtgtgttattgttatttatgtttattgaggttatatttatttggttgtttaatggtaagtagttttttagttttttagattagttttataatgtaaaatttaatgtatttttttttaaagtattatttagagagtatatgtttaaatgtaaatgttgagatatttaagagtatgtgggtttttgtgtattttatttttgaggttgggttgggtttttaataaatttgttttggaaatttttatagatggaagtggaagttttattttttttttttttaaatagaagtatatgtgtgtatgtgtgtttttatatatatataagtaatgatagttgttggtttattttttgtaaaattggaaaaaaaaaatggttttttggatggtagttgttgtgtagtgaattttatagttgtaattagagtgaggatgattttttagtgtaatagttataaagtagttaggaagtttggtttggttttgaatgtgttttttttttttttttttttttgaagttagttttttatattttggtattatgttattttagtggtttttgttgtttgattttatttttaattttgattttatgagtaaaagaattaggagaggtgggatatttattggatttttttttggtttgtagtaaattaggtttgttgtagtatgaagttttttaattttagtgttttgatttaaaggaatatattttgatattattatatgagttttttttaaggatgttgaaaaaatttaaatttgaatgaaatttaataattaaagtaattggaagaagtgttttataggtggtgggtagatagagttgattttatatttataagatattttttaagaatttagaagtgttatatatttattattttttatattggattgagagttggtgtttttgtgatggagtgtgattattatttatgttagggtttgtttgtggtttagttttttaatgtattatttatttgtttagttttgtgtatattgtgttgggttattgagagattttagagatgaatttggaaattgaagagtttttttttttgtttagttttttatatttttttgtgttttttttttatatatattgtgtgttggtgtagaaattttggtattgtgattatatgggagtgagatattttatggtaattttaggaaaagttgttatgttagggaagggttaagaatgttttgtggattgaaattattaaataataaaatagtagtttttatttttaagtgtgtggtggttggatgatatggttttttgatattttttgtatttttttttattgttttttttatttttatataaaaataaattttttgaatattgtaattagtttttatttattattttaatttaaagggttatagtaagttatattatgttgttttatttatagtattattgttaaggaatttagtatatttttagtgttttgatttttttgttttatatagaatttttgaagtatttaaaaaatataggttttttttatatattgttttaattgggttttatttatttgatttgaatattaatgattttgaagtgtttatatgtatagtagggtaaataaatgtttaatgattgattttttataatatgaattttgtgtttttattttatatattattttgggaataaatataaattgtattagtagaatggattataagggtttttgtataaatgttgatttatattatttttttggtgtgaaaaaaataaatatttattgtgaaagttaaatatgattatgtatttttaggtttaatgtattaattataaattatatgtaattttttggttataaataattttttttttttttggtaatataaatgggatttgtataaagtatttagttaaaatttgttgaattaatgaatgagatgtagtgtgtagattttaggatatttattttggttgtttagtagttttttttttatttgtattttgtttagttttattgggtatagtttttgagatttttagaagggagatttttatgtaagtgaggtgttattgtgttgtttattgtaatgttaagaaataagaattagtttgtaaattttgattatattttttaagagtattgataaaattttatatgtttgatttttgatgtatatttatattagaatttttttaaagatttagattttgataattttattttgaagtttttgtaaaatagaaaaaatggtttttagttagataatggtttgttaattatttttaattgagtttagagttgaatatggagatgaaattgattgagaaattatttttatttagattttgtatttagtggaatgtttttttaaattaataatttagtgattatatatttgttttggttagtaagttatttaataattatatttttttttttgtttgttttttagtaaaataaagggtaaattaatttttaaattaatttattttggttttataattgttgttttagaagaatgttttttaaagtgtattgtgaggaatattggtttttggaagtttttttatattttgttgttatttgtatttggggtggatattaggaatgtatagagaaataggtttgggttgtatttttaagagtttgatgattttggtatttttttttttttttttttattatatttatttattttaggaggtttttgattgtgttagtatgttgtttgggaagatttgggttatttaatattttttttttattgattttattgattaaatatagattaatagttataggttatatttttataaatgtttgttgttattgttttaaattattttattttttatatagttatttagaaataaaagttataaaagtaattttagaaataataatagattaattgttgaatgtagagaatttagaattagaatgtaaaattaatttttggtgatttattggaaagagtggggtgaatagaaatatggaggttatgaggatgggaagtataggtattaaggtttagattgtagattatgttttgttttagagaaggtataagagattattaataattttaattatgtttgggtgtggtggtttatgtttgtaattttagtattttgggaggttgaggtggttggattatttgaggttaggagtttaagattagtttggttaatatggtgaaattttatttttattaaaaatataaaaattagttgggtatggtggtgtatgtttgtaattttagttgtttgggaggttgaggtaggagaattgtttgaatttgggaggtggaggttttagtgagttgagattgtgttattgtattttagtttgggagatagaatgagtttttattttaaaaaaaaaataagaaataaaaaaataaaaaaaaaaaaaataaattaataatagtaataatttttatttgtaggaaattgtggaatgaatatatgaattatttaggaaggtttttatttagggtttttaaaaatagaatttattttttgtttttaattttgatatttttaattagtaaagtttgttttgtgttattgaagtgttgtagaaagaaatggatgtagatattagttttgtttgtgtaatattgttttatagatatgttgttaaattgtagtttttagaggaaaatatagttttttttgaggtgatttttttgagtgtggtaggtaggataatggttttaaagatgtttatattttaatttttaggatttgtgaataggttattttttatgttagaatgatttttgtaggtgtgattaagttaaggattttgagatgagaagatgatttttgattatttgggtggtagtgatgtaattatagggttttttgtgagagggaagtaggagaggtaagttagggttagaggaggaggaggaggaggtttgagtgatgtggatttttgagttaaggaatgtgggtagtttttaggtaatggaataggtagggagtttagattgtttggaataatgtagttttgttggtttattgtagatttttgatttttagaattgtaaggtaataaatagtgtttgtttttttaagttatttagtttgggttgtttgttgtagtagtaatagggaattaatagatattgaagaatggatttagttatttattgatttagtattgtgtgtttgttttgttaggtatattgtttggtttagttggattttgttttttagatagagagatagaaagagttttagagagtattgtgtgttgttatgagaatagaattgttatgtagtagaaaatgatggggtaaggaggtgtagaggggttttgttttgatggggtatgagtttaagaaggtttttttgaggaggtgatatttaagttggaatgtgaatgtaaaaaaggaagtggttattgtgagttttggaagttaagggttttaggtaggggatattgtgagtgttgaagatgtagagggatttatgttgtgataggaggtaaaaggatgtaggattttttttttttatggttttttttattttgatttaaaggaggaggttgtggtggtttaggtttttttatttttttagtgggaaaattttaggagaatttttttatattttgattttgtttaagagagttgagggtatgtgtgggaggtatttttttttatgggtattttgtttgtgatttttgatatttgtttgttgtgtttagttattgtttgttttttgttttagtattttgatggtagtgttttgagagtagaggagttttgatttttaaatttgttaagtgatattgtgttagagttgagaattttttatttttgttattaaattttaaattggttttgttatttggagtggagtagtttttttgtgtatagtttttggtaggagtagtagtagaaggttgagggttagtttttttgggtttagataagttgttttatattttgttttggtttaggtttgtgtatgaggaggaggagaatgtttttgttgttggttttttatgaataagtattgaaggtttaggattattgtttattgtgtgtttttttatagtttttgtagtttaattgttgatgtggattttagagaatatttatttttgttatttggttttattagtaaaaaggtggaggttttgaatggggatatggttaaagtatgtgaagagtttttagaatttttatttttgttttttgaggataaggaggattgtagatttaggaaattgtggtgggaatgttgagttttattttttgtaaggatattttttatatttttttatttttttatttttatttattattattattattattattattatttatttttgagatggagttttgttttgttatttaggttggagtgtagtggtgtgattttggtttattgtaatttttgtttttttagtttaagtgatttttttgttttagatttttgagtagttgggattataggtgtatgttattatgtttggttaatttttgtatttttagtagaaatgaggttttgttatgttggttaggtttgttttgaatttttgattttaggtgatttatttgttttaattttttaaagtgttgggattataggtgtgagttattgtgtttggttttttatattttttttaaaatgtattttttttatttgtttgtgaatgtttttgagttgtttttgtataaaattaagggtatgttttttgaatggtttttatttttaattaagtattgattttttaagtttttaaatgttgtgttttttagaattagaagtataaatgatttttagggatttttttttaattttgttagatagtttaggtttttagaattttggaaaggtgtttggagatatatgtaaagttggtgtgttatggtaattatatgtgaagtgggttattttggtttttgtttatttaatgaatagaataatgtagttatatttagtaatatttatttatttaaaggaaggggggttgttaaattattgtgttttttgatgaatggtttgtatattgaaaaataaattggataaattggtatagagtttagtgaatatgaaattagttattagaagaaagtttgtgaataaattttgaggtagatatgtattttttgattaatgttttattaattatttatatagttattttagttaagttttgttataattatttatgtttgtttttggaaatattggtagtaattataatgttgtagaaatggaatattattattgatttttttttaatttattgtgaataatgattgtttttattatgtttttgtttttttttattaaggaaatataatgtagaatgaaaggagagttttttaaagtttggtgaaatttttttagggtatttttaatgatatttagttttaaatgggtaagttattgtaatgtaaggttttttgtaggaatgatagtaatgtaattttattgaagttgtttgttatggattgtagttaaataggtaaaatgtagagttatattaatgaatagagtatatttttggaattattatttaaagttgttgaaatggtttgaattttgttattgtaattattttatttttttttaatgtgtttaatagttatagtaattaatttattagattggaaatttgtatgagttttaattttgatattataagaaattttgattttttttgggtattatatagtaggatagggagaaatatatatatatatatatataaatattttttttattgattatttttttaaaaagaaatttttatgaatgtaattattagttttttatgtatttttaagttattggtaaattttttaagaatattttatttttttaagaggatttgattttagaattatattggtataaagaatgatttggtattgtttgttagttgagaaatttttaggtattattattgtttttttaggatttattgtagtttgggaaatagtgtggtataataaagtggtgatagttattagtatgtataatgggttttaatagatattaaatgttgtttagttagaagagggagtagtgtttttttattggaatatttttttattgaagtttattgattattgattttagtggggagaggttaatttattagtttttgtaattagatggtattgatggaaattttttaggtggtattttggatgaattaagttttttatttttataaataaatgagtgatatgataagtatggtgtttaaaatatatttaattaattgattttttttttttttgtaataagatttggagatatatgaaagtgtgtagtgtgagttaagattaaaggaattgttttatgtataggaatatatggaattaagagttaataaaagttttataaagtatgtagttatttattttttttttatataaagtttgttattgtaataaatagttattattgaattgatgttttttatttttgtttttgtagaattttgttttaggtttgtgtgtatgtgtgtatatatatgtgtgttttattttagtgtttattttttttttagaagtttttaagatgtttggtaataattttatttttttatttaaataaatttgatttgggatggtaaaattatagatagaaagttgtagattttgtgtatttgtttgagtttagtgtttaagtgatgattgtttttttttattttttttgtgtagttttgttttgagttttatttatttttttgtgtttgtttttttttatatgtattagtagattttaagttgataatagagtttaggtttagtttttggatatagttttttatttatttattttgttttaatttttttaatatagaggtttattttagggatttttatggttttgaattttgtttaggttagttttggtttttttgagtttttataggtgagagggataggttgatgtatttggttgtgttggttagttgagggtgggggtaggttattatgttagttgttaattaatatggtatttttgtgtttttatagtttttgtattagtattttgtttttttaatgttgaggtttagtttttagttttggtggatgtgttgtgtaaatgttttttattaaatagtttttttttttagggttatttttttatgggtatagtagtaggttgtttgataaggttttattgtgatttggtgttatttgtaatttgtattttatgttagtgtagtatgtggatgtattgtttttatttggttattgtttattttttttgttagaattatagttgtgatttattattaggtggtattttagagtaagattaaaattgtgttttgttttgtgttaattgttgttattttgatattgtttggagaagaatttggttgttttaattaaagaattttataaatggaatgtgttggttttttattttttttataattttgtttttttgaaatattttgttggagtttgttaaagtttagggttttagttttatttttttagtttttaaaagttatagggagtttatatttatgagttaaaaatgaagagttgttgtatgaatgtattttttagttttgaatatattatttgaattttgtttatattgggattggagaattattagagttattgttttatagttaaataagattgtttgttttgagttggtaaggttttaattatggtattgttttttgttgatgaaaatttttttgtttttggttttgtaaatgtgattagtagaataagtttatgagtgagtttgtagtgagtagtattggtgatttgatgtataataagaggtttaagattaaatttgatgaagatttttttagtttaggggtttgggggtagtaggtaggatattgaggttgtataggttagtgtttattttttttaagattggtgtttttgggttagtttttgttttttttttagatttggtgttttttttatggtagttttttgtttattgtattgttgattttggttgtattttatatgttgtataaaaggttagatatggagtgattaaattatttttttagtttagaagtaaatataggtagtgtaggaagttatgtgggatatatttttttgatagtttaggtagtttgggagtattggtaattgtagtttgtagaggaaatggttgtattaatttgttgttggttataggtgtgattaggttttagtttttatttgtgattttgggtttgaattattgagtttttggatttaagtttgagttgtggtggatttattgatggtttttatattatttttttttattttgttattttttattttttaggagagtttggtgaattagaagggatgaaaatataattaatttaaggttagttggattttggtatttagtttaaaattttgaaaggaagagtgtaggattttaatttggattttgtttttagttatttaaattttttgggttttagtttaaggatgtgtaggttatatttataatattattttatagggtttttagtttgatgtaggaaggagttttatgaatgttaattttttattatagagattggataagagtttagatgtttatagaatttggattttgttgttattaggttgttttagtttaaattttagattgtttgtttaaattttttttttagtaagaatgtggaggttggagtaaattgtgttatgggttttgaaatggatttttttttttgtatattgttagatagtaataattttgttggttatattttaatgtttgtatatggtttttattatttagttttggattgggatttgaatttatataagatgaatttttaaaatgatttgtattggtattgttgtgaagttgttataggggtttaggaaggattgtgtttttgagttttgatgttgtggtttttgggttttgggtagtgagtatatttttagagattagaggttgaattgagagggtattatttttataaagtttataaaagtgttttatatagtttttaatagtagtgaaaatagtattagaagtattagtaaattatttttttggattataaaatataagaataaataaagtaatagattaaaaataattaaaataattaaataaaatagaagtattaattttttgggtaaagatttgatttgatttatttttttatgagttttgttttgttttttgtttgtttgttttatgttttgttttgggtttttttttagatgatatttgggtttatttttagttttgtaattagggtagtaaagtttgattttaatttttaatttataattttgataggttgttgttttgaattagatgtttaaaatttttagagtgtatttggtaaatttgaaaatatgtatagatatgattttattgtttgatttttttattttataaaattttagatttaaatttaaattgggtttttattttttttttttgtttttttttttgttgtgtttgattttttttttttttttgttttttgttttttattttttttttttaggaatagtttgaaggaataatttttgttaaggaggaaggggataaagatgaaagtaaataggagtttgaagttatttatgagataaattgttattgggaaggttgtgtgagggagtttgatatttaagagtagtttgtgtatgtaagtggatggtatttaggaattgagttttatagttttgtgatattttttagggaggttagtttttttgattttgagttgagttaagttttttaggagttgtattgtgaattggagagggttttatgattttttgagaataaagaaaatttggagttatggtgtttgatttgtttagttagttaaagttgagtgtaaaatttaataaagtttttaatagagagtgtaatgattttgattttgtaagttagaaaatattattttgagttagtgattttgatggttattgagtaatagtaagttggatatgaattatgattaattttttaaataagtttgattttttttttaagatttggtaataatggaaaaaatgtggagatgagggattttttttttttttttttaaatttttaaagtttaaggaagtttttgtttttttaagttgtagttagtattttatatgagttaggtagtataattttttggtttgaggttagtttttgtggggttagtagttttatggaaaaagttgtaagtgtttttaaatgtatttagtgatggatgttttggaaattgtagtatggttagattgagaattatatttttttttttaaattaggtttagaaatttttatatatttttttgtatattattttaaaaaatgtagtgtgtataaagttttttttttattttatgtttgatttgtgatattttttttttagtgttttattgtttttggtatttttttgaaggttagtggagttttttttggaaaatgggattaggattggttgatgtggagggtatttagatgattgagaataaaaagatgtaggtgttataatttttggtagaagtatagggttttgttgaggtattaagtgtggtagttttttaaatttttaatatgaaaaattggataaagtagtatttgttgtgatttttttttttttgttttttttttttttttttttttttttttatttttttttttgtggtatatttttttttttatagtaattgtatttttaggtaatttatgttttttgataatttttttttatttagattaaatattaaaattatgaagttttttttatattttatatgttttataggtagtgtgaatttttaatgtgtgttttttgtaatttggtgtattttatgtaatgtattttatgtattgtagttatattatagtgttaagtatgtaggttgttagattttgagttttgttttatatagaatgttttgaggattttatatgatattgttagggttttttttttttatttttttttaaattatgttttttggtaattgtatgggaagaattatagatttttgagtatagaaaaaaaaagttaaatgtttttaattaaggtatatttttagaatttttttatgaatttaatttgattttttttttttaatttaatgtaagtgttattttgaagttaagtttgatttaatggttgtttatttttgttgattgttttaatggaaattataaaaatattggaatattaaaggggaaaagtttggaatttttgttttattatggggaaatatttttaaagagtagtatatgttatgtgtatttttagtgatataatgaatgattaataaatatgaagagaattgtttgtgtaaaagttgttattatagaatagatgttggtagggtgttttggtttttaaaatattttgaaggtgatagttttatggtgttgttttggaggataagttattgtagtttgtaaggaatgttggatattggtttagttattattaaattaggaatgaaataagagtttattttaagtttatatttaaaatgaattgtgttttttataagaggtagggtttgaagtaatattttttggagtgtggtagtagtttaatttttttataatttaaatatagtaatgtgaaagtttttaaaagatggtgaaattgtaggtatttgaatttaattttagtggttgatggttttgatgttttaatagagagatttgagtagttttaaaggaaggttgtttaaaattattaattaaatgattattatattgtttgttttattgaaatggtttttaaaaaatatgaatgtgtatatatatagtggattattttaattttagattaattagaagaaatttatgttaggattagaagaaaatttaatattttatttttatgatattaattttagtttgagataaattatatgagtaaataaatttaattaaatgaattaagaattataatttataataatataaataagaatattagtttatgttatttattttttatttttttatttattgtttgaggtgtaggaattttaagtttgtatgtttaaattgattttatattgtatgatatgtgtgtatttttttatttatgagtatatttggtagtagtaatggtggtttgttatagaataggtaggtgttttgtattatgttgattgaaggaatagttattttaagtttatttaattattttggtggtagaataaatattagttgtaaaaattattttttttttttttttttttttttttttttttgagatggagttttgttttgttgtttaggttggagtgtagtggtgtgattttggtttattgtaagttttgttttttaggtttatgttatttttttgttttagttttttgagtagttgggattataggtgtttgttattatgtttggttaattttttgtatttttagtagagatggggttttattgtgttagttaggaaaaaattatttttttatagagggaagtattaatagtttttatttttgtgattttttttggagagaggatattttgtgaattagttgaatttttatgttatatataattaagaggtaaggtgttaaattattttgatgttttgttttatttatagttgtgatttatttttttttttttttttatagttaatagaaagatttatgattttttatggttgtttatttagtgtttgatagttttgattgtttgttaaagtaagttattatttataattgatatttttttggggaatagggtgttggttgtaattgaagggttttgttgaaagtttttaaattttgataagttttttttttgttttggtttagttgttgagttgtatggttggaattttagagttatttgaatttgagatatgtgttttatattagtaaattataatttgatttgaagaagagaattagaaatttggttgattttgtttgttaggtagtttgatttttattgtaatgtattttatgtatttttgaaaagattattttgtttattattatttgaatagatgggttaaatatttgttttttttttttttttttttttattttaagttttttttttttattaattatgtgtttattttaggtttgttgttgggtttttattatagggatgtttaattaatttttttttttagtagtataattataattgggtttagttatttttaagttagtattaaatttgttataaatttatttttgtgattagaagttaagaagataggtgtgtatttttgttagttttgtttttgtattttattttttttttggtgttggttaaaattgaaggaaataaaaaagtaagaggagtatatagaaagaaaattaattttaagtatattgaagattgaatttattattgatttgttaagatgtaagtatttttttttgttatttgaaaggtatatattttaatattttaaaatgagttgaaagtttatatttttttttaattttaaattaattagatttttttttttgttgagtattatattataaaagatgtgaattataattttaaatgtgtttttgagagttgtagtgtatttatttttaaagtgttgtttggttttgttttttgtttatgttatttggtttgtgttgatgttatttggtttagtttatgtttattatgtaaaatagtttagtttaattttttttaaggaggaaggatgttttttgtttatatggagatttattttttttatgttttaattttgtttgagaagtaagttttatttttgggtttttgatgtttgaggtgtttgaaatatgtatagtttgtagtatatgttagttttaggttttttgaaatttgtatattttggttgtgtatgatattgtatatattaattatgttttgagaggttttttaagaggaggaataggaataaatataaagaatttttattttagtgtggagttattattgttgagtggttggttatgtttgaaaatattagtgttgagattgaaagaataatagtattattattatattttatgtttatttgtttgttgtaattttgtaattttttatttttaattttaataatttaattttgtatttttgtgtaagaaataatatatgtaatattatttttaagggtttttaaaaagttaaatgattttaaaagttttattttttagtttaatttttagtagtataattttgtagggtttttggtaattgtattgggggatgttgttttttatttgtggggtagaattgtagagaaagtgagatgtatttttgttagtatttagttttaattgggtggtgtttaagtttttgtaattttttatttgtttttgtgaagtattgtgttaaaaatttatttttttgtagagtgattaattatttatttggattttaaaatgtttttatatgttgtgaattttgatttttaaaagtatgttgaagttttttttattagaagaatatagttataattatttttgttgttatttggaaataaattttatatattagtagtatgaaaatgaggggttttttttttaatatagagatttagatataaagaaaatatatttaatttgtgaagaattgatgtgtttgtagaaatgtaaggaagagttaggatgtgaagatattttttttatattaatattgtgattttaaatttgtattttaaatgttttttatataattttgatttttttgttaaagttgtattgtttatttttatttaagagaaaattgagtttaagatgtgataggggttttagatatgaggtagaaattagttttgtgtgtatataaaatataaaataaatgagtggagattttgattttattttttttatatggagttgttagttaatttggttattttaattatttggaaatatggtatataaaatatagattaagaattataaattttaaagttattttttgataattttgttttaagggttatgttttttttaaagttgttgattaaattgtatttgtagaaattgtttttataaagagatatttaggagattagattgattgtgagggtgtgtgagggttgtgtggtttattggttagagttttttaggtttagttaggattttgagtggtagttttatttttgttttgatttttgggatgatttttttagaattatttgattttttagaatgttatttttttatttattatattgtgaaatagttatgaaaataaatgttgtttttaatgtttaaggttaagtatagattatatgtagtaggtttaatgagaaatagatagagggttttgaagaggttatttagttttttattgttttatgtgtgtgttttgttgggttgagtgggggaggagaatgtggtggtattgttggtttttgtggtttattttatattaattgttgttaaattgggatgtatgttagattgaagttaagagatttttttttttttttgtattgtgtgtttgttgaataagatttggttttgttttgtttaattttggttttagttaaagaaagtaaaaagtttgaattggatagtttttaggatagggatggtaaatagatttttttttaagtgtgagttagttggttggtagttattaggagtattgtgtagagtttttttttttttttagtttgggagggagtttggggtgggttgggagtggtggggggttgtgaatagttatgggtgattgtttttaggtggagtttaagaggtggttatgtattagttatttttttaatttatttatttgttgtatattttttgaaatattttattaaaatttttttttgagtaattgtttttgatatttggggaatatttttttattgaaagttttttagttggtttttaatgatattttaggtgagattttagattttgttaatagttagtgttttggaatattttgtatggatttattttagataagtgggaatggtggttattttgggttgggttgtatattttatttgaatatgtttgtttatagtagatgttgttggtataatgtatttttttgtttattaggaaaagtataagttaatattagtggattagttatttgtttaatagtttttgatgagatgtgtagagttttggtaggtgttatatgggttggggatagtttatgtggtatttatagttttagttttgtggtggatatatgatttatatttttaaagattggatagtttgattgggaggaggagataaggaaatataaaagtatagtgaataataagaggtgaaatataaagaagttataattgtgtattgtgattttatgggttgagagagggaggagtatagaggaatattggaaaagatttttaggaaataggtggaaaatatggttagggttaaagtaaattatgtaggtaaatttttgaggtttgatgaaatgatgatggtggtgatgatgatgatgatgatgatggtggtgatgatgatgatttgagaagaattagtatttgatttgaaggaataattttgttttttattattatttagtggtagtatagtgtgaatgtgttttaaagtagatagatttgggtttatggtttgttttgtttttaaggaaaatagtgatttttattatataaaatggtgagggaattagttaaaaaagttatatttaataaaatgttagtgattttgtttatgagagaaaaatgttaagatatttagaggttgttgtgtttatgtatgttatgtataaaagtaggggttaggttaatatttaggtagtgttggggttggtatgttagtatgaaattagtaattgtagaaagatgttgataggtttttagtttatgaaatattgtaagagaagaattggagtggtgttttgggtttattttttttattgtaggtttttttttgtgtttttttgtagtgtggagattttattttttttgtttatgtgttttgatatttttttggaaattttttttggtggttatattaaattaaggtttttttattgtagtatataagggtagattattttttggtgttgggggttgttttgggtattgtagggtgttaagtagtattttaggtttttttttatgagatgttagttttttatagtgggaggttgttttgtgtatttttttttttgttatgataattaaaattgtttttagatattgttagatgtttttgggagatagtattgtttttagttttgttttaaatatttttttttgttgtgtagtgtggagaaagaaaaatatatgtaagaaaaataaaaaaaaattgtgattaaagaaaaagttttttttgtttaaatgttttttagaatgtttagattagaaataagagatgattttattaaaatgtttttagtaagaagttatttaaatatatttatgtgtgggggggtgggtgtgtgtgtgtgtgtgtgtaaattggtagagtttaatttaaaaattatatttgttaaggttaggtatatagtagtttttagtaaggtttataattagttaagtttgtttttttggtggagaaattttattattatttttttttttaggtttagggaagttatatagattttaatttttgagattatagtaagtagagttggagattaggtttttgttttgatataaaatagagttttgggaatagaaagtagttttttaatgtgaggattttttttttaagatttggggatatttaggtttttttgggattagttaaatattattatggaggtatttttattttttttagaataattaatgttgtaagagaagagaattgtaaatgggatatttttaggagataatgtgtaagttaaggttttaaatttaaattaattttatttgattttatttagttattagtaaaattagtattaattagtgagtgggggatgggaagaatattagataatgtgttggagatttgttttttatttttatatttgttagaaattgtttttgaatttaagtaagttattttgtagtaaattttttgtgttttatttgtaaagtggagataataatatttattttaggttttttattgggttttttaatttgttttttgtttatgaggatagaatgagattttataatggaagtattttgtaaatttaaaagttttatttaaatataaggaaaaatttatagtaagtagtattaataaatttatttaattgaagaatggagagattaagtgtatttttatgaatatttaaaaatagttataagtatattattgattttagttgtataggtttgtttatgtaggttgttgtttattttatttgtttatttatttgttgttgatttattgttattatttggtggttattatagaaattgtaggtatagtagttagaagaaaatgttttatgtatgtttgatttagggtgttggggttgggggttatttttttgagtaaggggagtatatagggtaggttgttatgagtattattgatgtataagtaggatagtgggaaaatgagtaaggtgaaggtatagaagaaggaatgaaagatatattttatggagattggatatgagtatggtatggaataaattggtggatgtaaatatagaaagattattgtagaaaggtattggggattttatgtggagaagatagtaggaagaagttaaagggtatagaaagtatgggaaaattttatttatgattatagttaatataataaaagattgaggtttttggtatttttttgaattagaaatataattataaatgatttgttttatgttttttggttgaagagtggtatgataagtaatgtagttagagtagaattaaagtatgtttggaaggtagaagggtagtgggtagtaagattaaagagttgagtagtattatgttatgggagatgtgattgttagattaggagtttgatttttattttaggtggagtaaggataattaaatgtttttgatgagaggaatggtttgagttagtattagttttagaaagatggggttgagttttgtaaaatttggtaagttgtaagtatagtgtattaaagagggtaaggttagattggggtagggttagaagtgagattttgtagtggaagttatttgaaattattttttaaaatttgggaggatagtttggagatgttttatgagtatagtttgagtagttgatgtggatgttttgtatgatatttagagagaagttagaagttttagggttgttggttgagtgttgggaggagatgttatttatggaatttttgtgttttgtttgtgtggtattaggttttttattaaagggtattaagattttgttatttttttttaaaataggattattagggttgttgggataattatttttgatagtttatgggagatatttattatagtgttagttaagtttttagagttagttagtttttattgtgattgttattattttttttttgttattattttgttttgtgtaaaataagatgtgttaggttaagtgagtggtatatgtttataattttagtattttgggaggttgtggtgggagaattatttgaatttaggagtttaagattattttgggtaatatagtaagattttatttttataaaataataataataatattaatttagttgaatatggtgaggtatatttgtagttttagttatttgagaggttgaggtggttgtaatgagttatgattgtattattgtattttagtttgggtaatagagtgagattgttttaaaaaaaaaaaataaggtgtgttttattttttagttatgaatatataattttgtggtatataggtattatttggtaaatagttttatatatttatagtggttattttttttttaattagggtaggattgttttggatgaatatagagaatgaatatttaaagtattaggtttggtgggtttagataaataaaatagataggtaggttaattatattttatttttaagtggtgatttagatgaatgggatgtagtttttgatttgtttggtaggaatgaaaatgtttttttaattaggaaaataaaattgtattagttgttttttgttagatttataggattttttttggttaattatgtttttaatataattggtttaattttattttggttgttttatttgtttaaagggatatggtgtttttttaggtttttttttgtgttttagtatatgtgatttgttttaaggagttttttaggatatgtgggagagtttagtttgtgaagaggaggtttttttggtggttttttttgggggtagggagagtttgtataggtttttttggtgtagtttttattataagataaagtagttaagttgtaagtgaaatatagtttttattgtatttttttttgtgtttagtagagataaattttattggaattttagtattgagttatttggtttttggttgtagttttaattgatataatgtagatttttttttttttgattaagaggggattatttttgttattagtttagagtattttattttaagatgaaaagtttttatggaattatagatgttagtatttgtataaagttttttggtgattgataatttaaagagaaagtatgatttattagtttataatggttaattttgagtaatggtttaggttttattgatttgtgaaattgtttaatgtgaattgtttttttatgttatataagttttaggttatttaagtaaatgtagtgtttgtattatatgaaatgttataggagagagaagaagaaaagggaggggggagaggagtaaggtggattttaaaatttattttggtggtgttttttatagtagtttggttgataagttggtagaggaaagattaataatgaggtttgttgttattagtatttgtttgttgattttttgtaatagggttgtttgtttagtatggaaattattgattaaataaaaatggttattagattgtgatgtgatttataattataaataatggtggatattttttttttagatttttggttatgtattaagttgtttttttttttttttggttgtaatttatattgtgttgatatttgggtttattaggtttattttttttgtttagaggtatgagtggtgaggattagtaggaagttggggaggaagagaggagagatgatggttttggttagggatttggttagtgtatttattgggttagtataaatatgttgtagtaaaatatatattatatagtagttattattttgtttattttgaagtttgtagttttgtgtggtattgagtgtagttatagtgttgtgtaattgttaatattgtttatttttaggatattttgattattttataaggtagttttgtatgtatgaagtggttattttttattttttttttttgttagtttttgaaaattattaatttgttttttgtttttatggatttgtttattttggatattttttataaatgaaattatataaaatgtgattttttgtatgatgtttgttttttttgtatttattatgtttttaaagtttattgatgttgtggtaggtattagtgttttgtttttttttatggttgaataatatttttttggatggttggttatattatattttgtttatttgtgtatttgttgatggatatttgagtttttattttttggttattgtgttattatgaatatttatttataagtttatgtttgaatatttgtttttagtttttttgggtatatttttagaagtgggattgttgggttatatggtgattttttttgttttattttagaaattgttaaagttatggtagggtttaagttgtaggttttgttttttttaggtggttttatttttaattttattttgttttttttagtattatttttttttgtttgagtgttgtttaagtttttttgggttggggatttagtttggttgtggagtgttttatgatattgttatttgtgggtatataggtattatttagtaaataattttatatatttatagtggttatatttatagtggttatattttttttaaataaagtgggattgaatagttaaagtattaggttaggtggatttagataaataaaatagattggtagattgattatattttatttttaaatggtgatttagaggaatggggtgtaggttttgttttgttttgtaggaatgaatataatttttttttagtagttggtttgtgtttttttttttggatattattgttgtggttttttttagttgtggaattttaaaaatgatttaattaattataaggaggtttagtaaggttaaaaaatatattgaaggttattaaatttattagtgagtggtttgttattgattaattagtttttttatatataaattatattgttttaatggttgtttggtgtatataaggaaggtttggtttttagatgtttttaattattaaatgtatgtattttattattttatattttattttaataaagatagttttttttttttgtttattttagttaagttgttttaagtttgatatttttttatatgtttatggttagttagatattattgaaagtgaatataatattttattagaaattttagattttttgattaaaatataggtgaaaattatatgtttatttataattgaatatttttatttaggttgaaatttatgaatttatttagaagaggtatttgtttattgatgtggttaggtgtgttattgattattttaaatttaaagttggaagtaatatttagaagaagtataattttttaatttgaatttttaagtttttagtgtatttttttatttagttttgtgttatttattgttttattttaagttgtagttttatatggagagaggtagagatgaggtttttttagagggaaatagtttttagggtagtttttggagttttgtgtaggtataggagtaggtgtttaggagtagttttgagtgttaattttggtttttttgggggttttgttgaatagtaagagattttggagaaagtgttgtaagttagttgaggattattttagaaagttattgtaagtatttatggattatttaagaaagaaaagattaagtttgaagaatatagattttaatggaattttttgataaagttagatatatataaaagattgaaagaaagtaaatatgtggaaataagaaagaattagtgatatagatttatttgaatatatttagtttattggggttattgtgggttttgatggttatagagaggatgttgtgggatttaggaatggggaggtatattttttggaatgaatggtttataattaatgaatggtagtgaaagtaagtagtttatttttttgtttgtttattttttgtgttggtttaagtgaatgtttatttgtttattttgttatttgtttggaatgagaattgagaggatagtgatgatgttgatgagatttgtttttttggggttttttattgggaatagagatagtaggaaaaggaagtatgtgtgtttagttgatataagagtaagattgttgattggtaagggagttagaggttagttgagtggtaatgttaggattgtaattttttataaatggtatgatgaattaatattagaaatttttgattaattataaaaaaaaaaaaaaaaaaaagaataatttgttgggggagatagaaagtggtgattattgttttgtatttttaaaggggataagaaaatgaatttagaaagttttaagggtagggttaagttaattttagagaaaattttatttttattattataaatgtgttgttttgttataagataaaatggtgattattgatattttttgggtttattaagaaaattgttatattagattgggttgatatttttttttataatattattagattggttgtttaggaaaatatagtaaatatgattgatgggattttagtaaaatttttaataagaaattatggttaaggtagaggaagatggttgtgttaaatagtagttaggagatgtagttgttgggtggatgataagggtatggtttggtattagttaagggagttgtttttagaattgtgttgttgggttgggtttttagttttggtttgtataataatttggtgtatttgtttttaggatgaagttgtggagtgtaattattattagagttgtttgtgaggaatatttatatttagttagtgattgaattaggatttttagagattttgaaaaataaaaaatatgaaatagttttaaggagattaaaaattatgataataatataggatttttaattaattataagtttattattataagataaagatagtttttattaagtttagttaatgtgatttttaattatagaaatagaagtatgttattagaattatatttaaagtatttttggaaaagagtattttagtttggtattttattttttaaagatatattgatgtataggtattggattaggtagagaaagaattagatttgttttgtgtagagtggttgatagaattagataagaaggtgtggtttgtgtttatagttttagttatttgggaggttgaggttggaggattatttgagtttaggagtttaaggttgtagtgagtatttgtgaatagttattatgttttaatttgtgtaatatagggagattttatttttgaaaaaataaagaagaattaaggaagagaagttttgtaagttgaaggtgggtagaaagtgttaagggatatgataattgtttttaaatatttgttggtggttggttgttttgtgggagttgtatttagtttgtttttaatgtatggattaaaggtttaatgtatggaaattatagggagatagatttaggtttggtataaggaaaattgaattgttttttgagatttgtttaaaatgtttatttaggggaaagggagtttttgtattgtaatgtgaggttgtttaaattgtatattatgggtgtggggtattatagaggtaatatagagtatttagtgggttgttggattagatttatttagttttatttgaatttgagtgaaattttttatattgtagaagttttttgtaagttagttatatgtttatgtttaaagtagggatttatttttatttgtttttaataaagaataatattattttagttttataatattttagtagttttttttttttatttaggttaagatttttttttttttattttaatttttttattataaaatatattattatttagtaaaataaattaggttgatatattgtttgaaagggtgaatttttgagttttttaggtaattgatatggggtaagaatgtgggtattgtgaggttttagtttttttttgtatattagagttatttttattgtaaaaattttttagatttttttagttttttttattttattttgatgtaattatttttgttatgggtattatatatgaaaatttttatataattttttttagaaattagttttgtgttgtgagtgtttttgtattatatatattttattttgagattttttgagataaaaatattagtgttgagtttattgagaggtaaataattaagtattttgagaatattaggaaaggtgtttttttttttaataagtattttttttttttttgggtttgtattgtggaaatgtgtgttttaatttttaatttgaaggatataaaatttggtgtgattattgagtttttaaaattattttttttaaattgtagtttttagtagagtgtattttaattttgtttttattttaagtatataagagatgatataagaatttttaatttggttgagtttttttttattttgtttgttgtgtagtaatattttgttgttgggtttttttttttttttttttttttttttttttttttttaaattttttttttagtattattattttggtaatttattttattttatttttttgtgttttgggtggagttaagatatttttggtggtgttggttaattggttttttatttttttttttttttttaagaattttgagttaagaatgaatgtttttttttgagagattgttggttttaagttgaggttgagttaaaaatatttgggagagttttatttgttgtttgtggaatttagttatatttttgttgtttgagaaatgatttaattttgttattatttttattttttaatgtttttattgttaggaatttttgaaatgtattaagaaatttagaaattaagaaatgaataaaaagaattaaatagaaatgaattggtttttaagttttaagaaagtgttttgtgaaatgtatttattagggtttttttggtaatttttgttagggattttgtaagtgttagaaatgtttttttttgagaaatttgggttttatttggttgggttatttgaagttatttatgtttttttggaatagtatatttttgatttgggaataaattttattgtttttagtttttaaaattaggagttgtagtttttgttagagttttttgggtttgttttttgataggatatttgtagttttatatatatgtaggtttatatattgtatattttaatatttagaagttgtaagttaagtttataagttgataaatgaatgaaatgttttatattttgtttaatatatttgtattgtgattagggagggtaggttttatagagaatttttggattttttagagttttttgttagtatgtggtggtttagggatagttgttttttagtttatttttttttttttttatttttggagatgtttgtttttgagttttattttagagttgaggaataatttttgtgtatatagagatttgagaattattgtttttattaattttgtattgagggaagtattaggtagtttgtgttttattggagtttgaagtttggtagataatagatagttttgttttgggtaatgttgttttttgagtttgggtattttttatatttttttaagtatagggggatttatattttagtttagaatttgttttttgtgttatttgttaaatttattttattttttgagggatgatatatttaaattagggataagtggtaaagtaataagattttttatggtagaaatatgtatttggttggttttaagagttgtaatattattttgtttatggagattatgttgaatttgggattatttttagagaataatgtgagatatttattttttatgttttgaaaatagttttatttttttttttttttttaattttttttattaattagtgttttttagaggattttaaggggaattttgtttttggtttttagaatttgagaggaataaaataaggaaagagaaattgaataggaagttagagagatagtaaaataatattttttgtttttatatgtttttttttttttttatgttgggtagtggttaatgttgtagtagagtttaatgggttggtgtttgaatagtggataggagatttggggaggtgagtatttgggttgtattttagggaggtaggtattagttgttttttgttaagggtataaaaggtagtattgtgtttatttaatggattttaaaatttagaggaggtttatttagatatgattttgaatttgtgtgtgtgtgtgtgtgtgtgtgtgtgtgtgtgtgtgtatgtgaatttaggataaaaaatgttttttagtagttaagtattttgtattatatttatttatttatttatttatttgtttttaaattttgatgttttaaaatatggtaaatattatagttatatatggtagagagtttttaaagagattatgtttattaaagtatttaataaggggaatataatgaggtttattaaagtaatagggaaatggtaaggtttagataattatttttttaaagtttaaatttataatttttttaaaagtagttaaaattagaggtaatttttattaaaatattaatattttaaaatatttttgtttttatgtatttttaaaaattgagtttgtattttatgtgttggttttgtgagtttttattttgtgttttgtttttattatatgtatgtgttattattattgaattgttgtgtgtaatttatggttttttttattattttttttgttattagaaataataaatttttttgtgtaaaattttttgtttttaatttggattgttttttttagatataatttttaaaattaaataattgagttaaatagatgaattttagaatgatttgaattaaatttaaaagaatatattatttggattttgtttggaatgttattaaagttttgaattgaaaagaatattattttttaaaatttagttttttggtttagtatggtggtttatgtttggaattttaatattttgggagatttaggtgggtgtattgtttgagtttaggattttaagattagtttggtaatatagtgagattttgtttttattttaaataatttttttttaaatttagtttttttagataataatggagtatatattttttttattttttgagttttttattttgatttattttatattttatttttggtttatttttaggtaggaagtttttttttgtatgtatttttttttttttggttattgtttttaatagtaaaggtatattgggtttttgtttttttttattttatgtgtaattaatttattgaatatttttgatatttttttatgtttttgtattttatgttttgggttttttaataatatatttttgtgatttgtaagtaagaataattttattttgttaaatattagatatatatttatttaaaatattagatatatattttatttatgttttattgtattggatagattttttggtattgtgttagataattgtgttggttgtataatattagttttgtatttggtattaaagggaataatgtttttggggtttaatttttattattttttttattgtttagttaatatagataatgtttgggtatgtgaatgaagtgtttttttttttttttttaaattttttaagatttttattttaagtgattgtagttattttattgattgtttgttatatagagattattgtgtggtatgatatatttttatgttttaaattatttttgtattttttgagtgtgttaggtgagttatttttttgatatgttgttagatataggttttttgtttatttataagttttatattgttatgattgagatttatatttttgttttattttttgtgttgttttgatattagagatatggttagatgtataaaaatatatattttatgttatatttattatttttgttttttgagtgttttatgtagtataataatttgtttttggaatttttgaaataatattttggtaaagttgtttggatttatagttttttgagaataaaattttttaataatgatttttaaaatttttttttatgatttgggttatatttgaatgaatgagttatttttattttttttagaagaattttgggttttgatgagatttttaattttaatattattaaattgtggttatttaaattaaatgtttgttgtatattttattaaattatttttattattttatttttttgttatttgtatttttatttatttgtttagttattattagtggttttttttttatttgttttattttttttttaggaatgagtttttgaaattagttatttatgttgttatgttaaattttaattgtgttttttaggaaatatttttttttagtattatttttttgggttgagttttgtttttttttttataatttttagtgtgaaatgttgtttttatttttttttttttttttaaataatatatgtattttgagattataatatttattttaatttatttttgatttttatgaattttgattgtttttttttttttgatattttaaaatagtttgtaattatatttgtgtgatttatttagttattaattttttattgtttaataaatgtttttggatttattgttattagttagatattgttttggattttggagatatattagtgaatgaaatagttaaagatgtttgtttttatggtgtttgtatttttgtaataatataggttttgaaattaatattaggtaattagtgtttggtttgttattatgtgttatatgttaggtattattttaagagtatgtattaatttaatttatttagtaatttaatgaggtggatattattattagttttattttttagatgatggaaataagttattgtgagtttgagtagtttgttttttgttatattgttagtaagtgggagagttaagttggttttttataaattgtgttaataagtatgttatgattttttatagtttttggatatgagattttgtttattagtgttttagtttgtggtataattttataattttattttgatgatagagatttaaatattttattgaggttatttttatgatgtgatatatatgatattttgtggttaagtgaaaatagatttttaggtaatattgattgttatgtgtttgtttttttaggatttttaatgatgtttaaatttattttgtttttatttgtttttttgtttatgtattttattataaattggtattggtatattaaattttaggtgattatggttttagttatattttttttattttaataggttttattttatgttttgatgttttgttatttggtggagaaaagtgttgtttttttttaatgattatgttagagaataattatagttgttgttgttatttaaattttttgttataagtttaatttgtttaatattaagattattattattaatatatttatttgtttattttttaataattttttataatttttagtgatttttttatgagtattatagttgtgtttattattttttgagaaattttgttttaaagtgggtggtaatgagttatttattttgaatgtgaatttttgtgtgtttttttaatttttttttttatttgtatatgtgtgtgtgtgtgtgtgtgtgtgtgtgtgtgtgtgttttgttatgttttttttatttttattatggttaatttggaagtaaatatagtgttttaaaaatagtgtttttgtttatatatttaatgaatatataattaaatgtatgatttttaattgtggaaaaataaatattattttttgttttttaaatatatatatatgattttgtaagataatttataatttaaaaatttttttattttttgtttttttttttttttttgtttttattaattaatgtagtagatttagttattattgtaaaatgattaattattttattattgttttttttgtttattattttatatgtttatttttataatagtttttaattttgttttatattttgttttgtgtgttagttgattttaatgttgggtttttttatgtaatggtttttttttttttgaaatatttttgttgttatttttttgttttttagtaataatttaagaatttggtagagaaaattttatttttttttatatgtatttattaataatattttttaaaatggattgtagtatattagttttgtaggatgttgataagtattaggtgaaaatgaaagttaggataaatagagttaattatatttggttgtgagatttatttaagttttttttatgttattatgttttgtagttttttaagaggagaatatggttaggttggttttttaatattattgattatagaattttatttttgattagtatatggtaaaattatgttaatttgtgtttttttttttgggaggatatttttgtgtttgttttttttttttttttttaatttttttttttttttttttgagatatagttttatattgttgtttaggttggagtgtgattttggtttattgtaatttttattttttatagttaaatgatttttttgttttagttttttgtgtagttgggattatagatgtttattattatgtttagttaatttttgtatttttagtagagatagggttttattatgttagttaggttggttttaaatttttgattttatgatttatttattttggttttttaaagtgttgggattataggtatgagttattgtttttggtttttttttttttttttttttaaaatgttttaatggtgttaaatatatttaggttttatatgtgaagtttaggtttggtttattttaagaatgtttaattttgttgtgatttaatttattttagttttttttattttattttttttttttaggatatgtgtgggtttatgagttgatttgatttggtttttttggtttttaattagttttttgttgtttttattgtgggttttgttttgttgttgtatgtttagattgttttttattttttttagttttttagttatatgtttttttatttgaatgttttttttttttataggtattattgttttttttatttggggatagaaagtagatatttttaatttttttttgattgttttttaattttttgtttataagtttgtttttattgagtttttagtggtttttttttttgtttttagtaagaaaagaatgtttgtggattttttatgattgtgggggtttttggtttgtgtgtaaggtgtataaaaataattttattttatattggaatattttttattttaatttgtaaatatttttaggttgttaaaaatttgtttgttttttttgatttattttatattgtttttagagttttgaattagaatgtatttatgtatttaaaaaattagtaagttgtaaagtttatattgaaaaattttttttttttttttgttttggatttgtttaatttttattttattttataaattaattatttttaatttttgtatatttttggaatttttttgtagatatataagtaaatatagtatatattttttttttttatttttttttaagatagaaagtttttgttgtgttttttgtgtgtaatatggttaatagatgagtgtgtttggtttagtttgaattagttttgtgattgatgggtatttagttttgtaggatgaaggtgggatgttttttttttttgtttgggtaagatattgttattggtttttttttagttagtatagtatgttatagtgtgggtttttggatgtgtggtttttagtttttttgttggtttgaggttttatttatgaggttgttgtaggtgttttttttttttttgattttgtagagttttggggtttaaaatgtgttttatgggtagagaatggatagtatgtatttagaaattttgatggtattttgatattgttaaaaagtgtgggatttaaaggttttttttattaaatagaggatagatttatttggatgttattaaatttaaggttgttaaggagtggtttttatttgttttagttatgtgtagtaggattatatatttattggtgatagatgagagaggttagaatggttttttattatagagagttttagggtttttgatgtagggtgttggagatgtggtgtttgaaaggtgtaaaagaggagtggatgagggtaagaataattattttggatgattttgatgtatttgtggtttatgggaagatgtttgtttaattttgtggttagtgaagttttagtagtttagagttaatgaaaagtaatagtattaattagaatttttttttgtttttgtggatagtattgagttttgatttagaagatgtgtttaaaggttatattgtataagttaagattatgttgttttgtgagggtgtagtagtttgtggggtgagtttttagtgttgttgttgtgtatatagtgatgaaggtaggtgttttaggttatttttattttttttttatgttaatttagatggttttatttttttttttagtagtttttgttatttaaggtttagtatttattgatgataattttttattatggtgtaatgttttgtggaaaatgatatgttattttttttttaataggaaattttatttatttgaataatttattttttatattaagtaaatttttaattttttaagttatttgatattaaatgtggaaaattttggatatatttgaataaaattttagtgtatgtgtttattatattttatagagggtgaaaggttgtgtgggggaaaatatagaagattaaataggatattgaagtaggttggggtgaaaattaatatttttagtagaagagaaagatgtaaaataattgtaggtgttagtttatatttatattatagatttgtataatataaaaaagtgttttgattgttgatgtttaaagttgatgaataatttggtgagtaatgtagaggtgaaaatatttatagtttgtgtattaagttggttgtggagtgtaatttgtattgagttaatgttaatattatttagagtttttgttaataaaattaagtattttattgaaatgttttaatttattattttatttttttattaggagtaatggattttgtattttatagtttgatgagaggtgttaaaagttagaggtgaaatttatttttgaggtatttaagaagggaaaaattatataagtgagggttatggaataggttttattaatgaatgtataattagtaatttgtttgatatattttgtgttttgttatggtgggaagtagttgtttgtagtatattttgggttttttttgaatggtttttataggttttttggatattttagataagaagtagtaaaagagttatttttttaatatgtataaagaaaatatagtgttttttgttatatgtttggaatttgagtttgtggtgtgaatattttagaagaggtgttatatattgattattttagttattttagtttatttgtaaaataaatgaagttagtttttggtttttttaagtttttagtgattatttttattttttattgtttttttttaagtattattttagaatgatttggtggagttagtttaatgataatatgtgaattaaaaagaatttttaatttttgttttttgtaaaaaataaattaaaatttaaattaaaaaattttaagtgtgtagttggtatataggagatgttttttgttttagagtagaagttttttttttttgatgtagagtaagaaaatattaatattagagttaaattgagaaaatttttttagtgtatttggattggtgaatggtttaattgtagttataatgaaatatgaggaaatagattattggtttaagttatatatttatgttgtattaagtattagtttttgagtatttgtgtgtggaagttagggtgaaggtttgtggggtattaggatgaatgtgatatagtttttttatttaggaagtagtttagaaggggttaaagttatgtttatgtaaaataaatttagttagaaagtaaagtagaaggtattatttgagggattttgatgtttaggagaattaggatatatataatgtttagttagaatattagttttttttttttttatttttaaatttttattatttggatattttttttttttgtttatttaattatatgattgtaaagagtaatagtggatttgatatttagtattttggaatgattattggtatttgttagaattgttagtagtgtttattttagtaaaatgtgaatattgtaaaatttttaggttttagttatgtttagtgtaaaaatgttagtttgtaaagttggtaaagtttagttattatatagtgatttttaagggtgttgtaaaattttttttataaataatgttaaagaagaaaaaaaaaagttggattttttaaaatgttaggtttttttattagttttttaattaattatttagggatgttttttttttttgggagatggtattataggtttatattatattatgtatggaaatatttgggggaaaaatttaatttttattaaaaaatatattttatatagttttgaaaggaaaatagtgaatgtttatattatttatagttgagattatgggagtgttttttttagtagtttttttatatgaagaaataaaaattttaatttttttgtttattgttttatggttatatgggtttgtataggaaattaaggaggaattgtaaaatattgtatttatagagtttagttttattttattatatttgttatatatagatgtattaaattaaattagaataagatgtgattttattgagaaagaatttttataatattatgttatttttttttgaaaatttttttaagtatgtataaaatttagaagattttaagtagaatattgaagagagtttttaaggttgaaaagtaagttgtatttattttttttgtattatattatatatatatattataattatgttagtgattaaaagtattgttatgttgtattatgaattgtttttatgtttaggattagataattttttttttatatttttttagattttttttatgttttaagggtaaatttttttttttgggttaggaatgtaataaggtaggtttttttttttttgggatattgtgtttgttttattgtgtttaaattgatttagaaagttttttagagtaaaatatagtattttttttgtatatgagttagtggttgattaatttttggggaattttttgtgttgagtatttgaaaggtataggttgggtatgtttgaattgttgatgtttagtgaagattattgggaaagtggattggttgtggttttgagagaggttttttttttaatgtggatttgaggaaaaaaaaaataattgttttaataaataatttttaatggtataataatttaggaaaattagttagtttattttaataagaatggattaagattaaaataaagagggaattatagtttatataaatgtatgaatatatagtttaaaggtatttagttattaaaaataaattttttaaaaatagtagttttttttttatttattgtatgaagtgttaatatattttttttgagagttgaattataggttttgggattaaaatagagtaaatttattatttatattgaaggggatttttatttagatttggtatttttttttagattattagttagtagaggttagatttattgttaattaaggataattaatttaatttttgtaatgttggttattggttttgatagtgttttagagtttaggattttggaatatgtattaagtatagttagagtattaggagtatattgtgtgtgtttgtgtttgtatgtttgtatggatgtttttggttttttttttttttttttttttgtttttttttttttttttttttattttatttattttaatgggtatatagtatttttttttttttgtgtattttttgtagtatttaattaaaaggtatttgggaaatgtttttttttgttgaggtttttgatttttttataaatgagtaaatttttagattttgaaattgttatttttttttttagttatatttatatagtgggtagaaagtttagttttgaattttgtttttatttatgttataaatttatggtgtattattaggtaagtttttgaatttttttgaatattaggaaaatttttttgtgggagatgaggtgtgaggaggaggtagttaagtagaaagatattggataagtaggttaggtagaagagttggtatgagttaaagtttagtgtgtgtagtttatatattaggtttttgtaaatagatgagagaagataaattaggaaggagtataatgtaagtagttatgtttttatatttatgatggatggatttatatttattatgggtggtaaggattttaatatttatagtttgggattaggggatatattttgattttttgttaaataaattatgtttttgatatttgtattgtagttgtgttatttgataaatgaaatatatagatattattttgtatgtattttagataaaataattaataggatatttttattttaaaaatttaggtggtaaaatttggttgaatattgagttttagttagttttagtttggtttattttgtaagtgtatttattatttattttttagagagtgttgaaatttataaatttttaattagttgttttggtataattatattaaattaatattttgtttatatgtaatgtggagattattatgaaagttatgtatatgttataggtatgtgtttgaagtgttaaatgaaagattttaaagatttgaatgattatgtaatatatattggttaaatatttttaagaaaatttgtttataaaaataagttttatggaataaaagtattaaattaaaaatatattttgaggaataaattagtattttttgaggaatgaaatttttattttggtggggaggtaaaagataaagtaagaaaataaaattgtagaaatggtttaaatttaagaaaagttatttttttttaggagtgattttattatgtgaagaatggtgtttagtataaggtaggttttttttttagtttttttttggaaggattatagaattttgtatatatatatatttttatttatttattttaaattgttaagtttaaatttgtgtttttaggtaaagtgttttttttattgttttaatgaaaattttgtaggattaattttattttttttttttgattttttaaatatgttagttatgatagggggtaagatttttattttgtgaatgagatttttataagtagattaaggaggaaatatgttttttagttttttatttgttgatagtattgtattgggaagaaatttttgtgtaaattgtttataagaataatagttaggggtttaaattttagtgagatagagtgtagtttaattttgttaaggataatttggtttttgtttttttttttttatttgatgttttaatgaattattttaagagaaatttatgataaagtattagattatttttttttatagttagtgggatataatattgaaagttagggttattatttaaatgttagaatttttattttatagttatgttaatattgttatggtgggtaaaaataaattttaaaattttttttatttataataaataggagttaattaagataattttgaattatgttatgattaatttagaattttagtttaaaattatagtttgaaaggaggttttttttggtggattttataggtatttgtgatgttgaggtttattagattgtggggaatagagtaattataggaaattgtttttgttttttgtggtttttgatttttaaagtataaatttaaggtaggtagttggttgggagtatattgaggtttgggattatattggttttaaagtttgttgtttttaataatatatttttaataatatatttttttagtaagtatttattgagtttttattataggttgggtattgttttaggtatttggaatatattattgaataaaattgataaaaatttttggttgtgtggaatttatattttggtgggtggagtagataataaatattaaataatgttagttagtaaattatagtgtgttggaagtgataagggttatgggaaaaaagggagagtagtagggtagggtttggagagtttaaggatggggaggttggatagtaagtggggttattaggattaggattgagtggggtgatgagtttttgtaaggaggtggtatttgaagaaggattgttagaggttaagttatttttgtttagtgattttattttagatgtgattatatgtttttagttgtggatttttatgttgttagtttttggagggtatttttttttaaaattttggttttgttttgttttttttgttttaggggtggttaggtgtgtttttaggttagtgtggtttttgggtttttttttattttatttttttttttgttggatattttgttatatatttagttgatttttggtgattatttatttgtattttgggatgaggttatagttttatttttttagtaggtttttttgataaaaggttgttgtatagaattgaattttgtaggtagtatgggagaaataaaaggtttaaaataataaattgtttaaaatttgagtgttatattgatttttatttgtaattttttagttttttttagtatagtaattttaaatgaattagtttttttgtttaagtttatattttaatatattgttagatattttttgttttttttgtttgatttttttaaatttattggggttggtaagttattattggtaaagaatttaatatttttttgttttaattgttttttttggggttttttaaagatattttatatgatgatatgttttgttttttgttatttattgtgttttttgtttttttttttattttttttttttgtttttttattttttaaaatattggttttgttattgtttttaattttttttttttttattttttgtatagtttttattggttaggggtttttaaattgggttttgtgaaatttttaaaatattgtgtaggtgttttttagtttattaaagataatatggggtagggaaggggtttatatttttgtattagttgtagttttttttagatttttaaatttttatgtttaggattgttttttttgtgggatttttttattagagatgttttggaggtatttttattatgatatgttttatatagaagggtaattgttattaaattttttggttttttaatattgttattgttttagattttttaagttggagattttggtattatttgttatttttttttttaatttattatttataaattattttataatgttttttatatttagttttttattatttatttttttggttattgttgtagtttaaggttatagtttttttggatgattatagtaatttttagatggatttattgtttagtttttgtttagtgtttttatgatgttgttagagttattttttataagaataaatttgattattgttttgtttaaaatttgtttttggttgtttgggatttggttgttttagggtatttaattttttttataatttttttttaggttgtttttgtagtatttattttatagttatttattagtatgtgtatatatatatatgtatatatatatatatgtatagatatgtatatatattttttaattttatatttggtattattttttaatatattgtgttttttttaatattgggtttttgtattttttttttttttttttttaatttatttttttttgtgttagttttttttttttttttttgaatttagtttagttattttgtttatgaaatttttttttttttattattttattagtgtttattttattgttttttatttattttatttagatttaggtataatgtttatgttttatatatgttttgtttatggtatataaatgaatgaatttttatagtttattgtttgggtttatgttttttttttaaattttatgttttttattaataagttaaagaaaattataatttaggtatagaatatgtagtggatatttatattgtgtgtatggagattttgtttttatatatttagatgtattgttaatagggggttaagatgtttaggagggtattgtatattagggtggtttgtgaataaaagttgattgaaaaatgatagagttgatatttttataggttgaaaagtatgttgaagtggaggggtttgttttttattttggtttggtaggataaatttggaaaagttttgggtaatgggtttgttagttttttatgatgtggggagtatgagtgaagtaaaagaattatgtatttttttgagtagtttatttttaattgttaagtaaatgtgtttgtgtattgaaggttaatttttagatagtatttgtttttgtatttttgtagttaattttggataagatttaatggatatgttttattttgttttgtttttttagtgttgagtatagtaattgttatattataaataagttttgagtgaatagtgaatgaatgtgttagtttagtagggattgtgggtagatttttaaagggataattttgtttatttgtttgtttttttttttttttttagtagtttttgagatgtgtttgtgtttttgtgattagtaattattatttatttttatatatatatatatatatatatatatatatatatatttgttttaatttatttttaattgttaatggaaagtttttttagtatttattgtgtaagatttttttttagtaatgtgatgagtagtaggtttttagggagagttatgattgtggatgtagtttggattgtggttggtattaaaaatatttttttattttttatttttaaaagattttattaaaatgaattgttaattttttttttaatattaaaaatattttttttaaatttatttgaaatttaaatatattttattgtaattatgattattttaatttatattttagtgattaaaattatattagaatttttaaatttgaaggttagtttaagagttgattgttttaatgtttagaattagattttagtgatgtggagggagtatggttgtttttgtagggtattgaagatagagattatttatttaaattggattttgttttttatttatgttttttattttatttttaatttttgaatttttttggaattatattgtatgtttagattttttattagtaatatttatatgtttaggttttatgtggattgttgaaattataaaaattaggaaataaaggttaatgttttgtgtatttttagatattggtgtttttagtagtttgattttttaataggaaaattttgtgtttatttttgtaattaaggagattaaaaattaaattttttttgttttttttagggatagttattgtgtgtgtgtgtgtgtgtgtgtgtgtgtaagtaagtattaattattttatagttaaaagtgtaaatgtattattataaatattattatatttatttgttttattttttaaagttttaataggaaaataagtattatgttttttttttttttttttttttttttggagatagagttttgttttgttatttaggttggtgtgtagtggtgtaattttagtttattatagttttttaggtagttgggattataggtgtgtgttaatttttatttttattttttgttagaaatgaggttttattatgttgtttaggttggtgttgaatgtttgggtttaagtaatttttttgttttagttttttaaagtattgggattataggtgtgagttattgtatttagtttaaaataagtattattttgataataggttgaatagtaaaattgttattagtgtagagagaaattatttattaatttttttttttgaatttggtagaaaattaagtttataggtgagggaattttaatgttttgggatataatttggtttttgaaatttttaatttggatataaatgtaattgtaatggatggtaatgttttttttgtatgttggatttgtaggaatgattgtgtataagagtgataaatttatttgattttttggagaggttgtatttatagttatttttttagtttttttggtttttttattttttttatttaggagttagttgtggaataggaaattgggatttaattgtattttttttggggttagagtttaaattagaaattttggtttttattatgtttgttggatttgtttattatagagatgaaatagaaggtgtttttttggagaatggttttttaaataattttgttttatgattatatagttaaaataattttgtttatttgtgtttaatagttttttttaaaagtatttttagaatagatattattgaatttttatttgtttaattttatatttttttttttggtaattaagtttttaattaatttgtttaagaagagtttattggttttgttgttatttggttgaaataaagttgatatttaaaaggatatggtataaaattaaatttgtttagtaatttgtagaaatgatgtgtatagagttttagaatagtttatatatgttattttatttttttatgtaaaattataataggatttaaatataggttattttaggaaagaaattttgagaagttttttaataaaaggtaatttattggatggtaagagaagttttttaagagataatagttatatttttgttttagtaaaataatttagaatttagaaaataaaattttaagagaaggagtatttttatagtttttagaaggaattaggggtttgttttagtttgtttttgttgtgataataaaatattttaatattgggtaatttataaataagagaagttgattttttattgttttggaagttgggaagtttaaggttaagatgttagaagatttagtgtttggtgagggtttattttatgttttatagttggagtttttggttgtgtttttatatagaaagggagagggttttttttagtttttttataaggttattaattttttttatgagggttttgtttttttaattatttttttaaggttttattttttttttttttttttttttgagatggagttttatttttattgtttaggttggagtgtaatggagtgattttggtttattgtaattttttttttttgggtttaagtgatttttttgttttagttttttgagtagttgggattataggtatttgttataatgtttagttaattttttgtatttttagtagagatagggttttattatgttggttaggttggttttaaatttttgattttaggtgatttatttgttttggttttttaaagtgttaggattataggtgtgagttattgtgtttggttaaggttttattttttaatatatttatattggtgattaagttttaatatatggattttaggggtgatatatttagattatagtagggtttttaaggtattttgaagaatgaggatgtttttttttgatttaaataatataaataatattaattaatattatgaatatttattttttagaaattttttttaaaaatttatattttttttagtttttaggttatgttaatattaagttattattgtgattttatttatatgagtttgagtttgtgatatgtgtattttttagggtagggtggagggttagttagataaattatgttataaattttatatttatatttagttattatataatttaaggtaatagtaaaattgaaaagatagagattttgaattaatagtgtgttaattttttaagtatttttagtaaattttagaatatattatggattagaaattatttgtttttttaaattatgtattattttgtatatttgaattgatgttagtgtatgatgttttttggttttgttttgttaataattttgtataaagtttaggtttttttatttttttatttatttttataatttggatgatgaggatagaggaatatagagaagttgttatttatgtgaggtttttaggttattaattgaggttagtaagaaatttattggaaaatattgtattataaaaatatgttttatagttgggtgtagtggtttatgtttgtaattttagtattttgggaggttgaggtaggtggattatgaggttaggagtttaagattagtttggttaatatagtgaaattttgtttttattaaaaatataaaaattagttgggagtggtggtgtatgtttgtagttttagttgtttaggaggttgaggtagaagaattatttgaatttgggaggtggaggttgtagtgagttgagattatattattgtattttagtttgggtaatagagtaagattttgttttattttgttttaaaaaaataaaataggttttattttgatttaatttatttgtgtgtgtgtgtgtgtgtgtgtgtgtgtgtgtgtgtttgtgtttgtgtttgtgtatgttgtagtagaagttgtgattaagatgtagttttgtgtttttatggaaaaatatttgttgggttttattttagttagtttgaaggagaggtgtagttttggggaagttagattttattttatttggttgtttttttaattttttttttatttttttataattttttggtattagattttattattaagtatatttttgtgagtttttttttggaggtgtggggtgggggtggggggtaatatttttattgagatataatttatttattatgtaatttatttatttaaagtatatagtaatttgtatgttttgatatatttttaaagttgtgtaattaatattatatgaattttagaatattttttttattttataaagaaattttatatttttttgttgttatttttaatttttttatttatttattttttttaatatatagatttatttattttggatatttatataaatggaattatgtagtatttatttttttttggattggttttttttatttagtatgttgttaaagtttaattatgttgtaatgtgtatgtgtattttattttttttaatagatttttgtttttaaatgtgaaatgatagtgttttgttgtagtgaagtatagtttagttttttttggggaggtttggggaggtgatggggtggggtggggtgggggttatattttaggttagtttattttttttttttagatttaatattataaagttttttgtttagataaaatatttattttgttaaagaattttgttttttttatatataagaaaaaataattttgttatatatttgtatttaaaagtaggatttaaataatagttaggaagaagtttatttatttatttatttttaattaagaagtgtatttttttattttgttttaatttttaatatttataaattagaaataagaaattgttttatttttataaagagaatgttggtttgtatttaaagttttgagttttttgggtattttttggtataattttatagttatgttagaaattgaaagatgttttgatatttatattaattagtttgaattgaaataggtattttgtgaagttttagggagattttttttatagtagaggttgttttaggtttttaaataatttgttaggaaggaagattgatgggtgttattaaaataatttaaattattttatttatttaaaattaaagtgtatattgatatataaggtttattttagttttgatagtttgtgatttatgtttttttttatgtttgtttagtgaagtatttaggaatttaattataaggtatttttaatataatttatattatgatagttgtaaaatttttaaaaatgttgtatttattaagtaatatataaaattggagggtatagattttattttaggtaggaagttttgagggatttttgtggaaagtgtttttttaggtaaaatattttagttttttttgtaaattagttttaatataaattaaattttaatagattttaaattatttttttatttttttttttttagaaatatttttggattattatttaaagagtaatattatttaaagagtaataggtttataatataaagttaagaaatattgaaaattgagtttatttgaaatagtttatttttttatattttattttatgttaaagtagaagatttttttaatatttttttttagtaaattttatagaagttttaaattattgaattttgtttagtgtattaattaatttaagttgtatttatgagtttatttggtagattaatataaaaagattttgaaattattaaatatttttagtttgatattttgagaagagaatgttttagttttattttttgttttttaaaaatataattattgtaataaatggtggtattttaatggtttaagagagagaaatgtagtaaaggtatgaattggaaatataattgggggtggagtaagtgtgtttagttttttattagtgatttattagtgaatttagtgaattattagttagaaaggttgttttatttttttagatgtttatatatggaatatattgttttttaagtttttattttattttttatgaaggttataatattatttgtgtgtgtatatgggtgtttgtgtgtatgtgagagagattatatgtatttgaaaattatgaatatatattttgtttttatatgtagtttgtgttgtgatgaatttggtgttgtattttgtagaaattttttaaattgataaagtagttttgtgggatttgagaaatattagatattgatagaaagattggtgtgaaaagtatatgtgtaggggagttgtttggaaattggtgagggttgagtttgaagttttgtgttttttttttttattgtttttagtaatgtttaaaggtaatatttttattataatagtggaatttatttttttgatgttaagaaattggttgatgtaaagagtggatagatttttgaggtagttaggtgtgtatttatggattagtgatttttttgggtagggtttgaatggggatgtgtagattttgtatatatatatttgagttttgtggtagtattttgaagaagttatttagaagggaggatatttattgatttagagaattgtgtttttgagtgggaattggtggagaggagattgaaggaaagtagaagtgtattttttagttttatgagttgtgtgaatggtggttttatttggagagttgtgagttatggattgtatgtgtttttttatttggagggttaggaatagattaagggaaaattgtttgttttgagttaatagtgaaataataaagtgagaagaaaggattttgattagtttagtaaagtttattgtggtatttattttgttgttagtgaaagaaaagttttatttttttatttttttttgtagttttttaagtttttttggtggatatttagggtttggttttttaaagaaattttgttaaaagaaagaagtattttttgtttttttgattgttaaattagtttgtgattttttttatttttttatgggtttttggagttttaaaggagtggaagaaatagtggaagaaatattgagttgtggtttattttgtttttatttgatgatagttaaaaaaatattattttattggtttgttatgggtttatgaggtgtttatttttttagttattagttttttaaggttaatgtttggagttttaattggaaaattgaagatatggatttattgggaagtttagtgttgggatttggtttttttggggaaattttttggttttgatgttttggttttgtttatttagatagggagagtttagagtggttgtgttgagagagttggtatgttatattgtaatttatattatttatttttttttgatttttgggtttttggtaaattgtatgtttatgtgttggattagtttggaatttaattatgtattattttttttttaattaaattatttatatatttgattaatgtttttattgttgggaagttaaatttttaatgaaattataaataaatttgtgtttattgaattttaggttagttttatatggggttaatttgtttattgaatgttaagaatttattgtttattattttttttatttattttggattttggtgagaaaaagaatgtgttttttttttttagttttaggaatatgatataaatagtgaagtttggtttaatgtatggttttttttttgttggggtattttttatagtgtaggattttgatttttagttttttttattgtttttttttttttttggtattagaatgtatttttttttaattttgtttttttaggtttgagggtttatttgttagatgttagtatgagaaggaaatagagtttatttattttggggattagtagttaatggtttataggttaaatttagttgtttgtttttgtgtagtttatgagttaagaatggtttttagattttttaaaagttgaaaaaaaagttaaagaatattttgtgatatgtgaaagttttttatatttataaatgaatagataatttatttatttaaatgttgtttgtggttgtttatagttttgtaaagtttaaaatatttattatttagtttttatagaaaatgtttgttaatatttgatttaatttattattttaattttatagatgagaaaagtaagggttaaataggtgaattggtttgtttaaaggtatataatttattagaaattgtttggaatgttttttttattgttttttagtgttttgtttattgtgatataggtttttagatgaatatttattgtagagggtaatgtataatgtatttttttttttttttttttttttgagataagtttttgtttttttaggttggagtgtagtagtgtaaatttggtttattattgttttgattttttgggtttaagtgatttttttgttttagttttataagtggttgagattataagtttatattattatattttgattttttttttagatatggggttttgttgtgttgtttaggttggttttggagtttaagtgatttttttgatttagttttttaaaatatggggattataggtgtgagttattatgtttggtttaatgtagttttttaaaggaaagtaaatatttagaatatatgtatatgttaagtttgtgagtttttagaattttaatttttatttgaaatttagttttaggaaatatgttaagtttaaaatatatttgaattgtttaaataggtagagagatgtttttttttttttttatagtaattgattatattttttgtgtagtatttaagtagtaaagaagaggaagattgatttggttttttagttttttaggtgtagaattttatttaaagaaaaataattgtggttttaatgtaagtttgaatttaagagtagttttagaaaattgtaaaaatatattagttgggatttgggtttaagggattggaaagggaatatttttaagatgttaattttatgaaaatgaggttgttttaagtgtttaatataagttttttttatttttttttatatggagataatagtaagggtgtttatgtttgttgattggtgtgggattttttgttatttaaatttttatatattgttttagtggtaaaggtagaagaagttgggtgtggtataaataggaaatgattgggatttttttaggtattgtttttttttgttggttgttagtttttttttttttgtttagtgttggattttttaatattattgtaggtagattttatattttttttgttattttggataattaaagtgtttaatttaaatgtttaattttaggtttaatttagagtttttttttttttgttagtagtgaggtataggttttaagggaattggtaggttgtttgttttttttttgttattttatttaaaggagttggggtttgggagtgttgttaggagatgttttttttttttttttagggtttagtttttttagtgtgttggatgagataggaaaggaaaatatgagagtttttttttttattggttattgttggtattttttttttagttatttttgtttttttgagtagtattaggtttttttgatgtttttttttttaggggtagatatgtaagtttggtttttttttggggtgtatgtgagttttatgtaggggtattttttatatttttattgttggagatatgattgagtatatagtattttaggtgagttttggtaagttaatttaagtttatttatgttatggatgtttatttgatttatagaaaatttatgtttttttgttatgttaagtggtggtagtttttttttggttagtttttttttgttatgtgtggtttttatgttgttttttaaaggtattaggttttgtttttttgtaggtatttttgtgttattggtttgttgtagtgttttatttttttattttatttttttttgtatatttgatgtgtttatttattttttaggttttgttttaaatgttgttttattggagaagtggattttgatttttgatgttgtatattgatttatgattttattatatgtttttataaaattttgttatttttttttataatgtttattataattgtaattgtatagtaatttaagttatgatttgtttttttttggtagatttaattttttggggtaagaattatgtttgttatgttttttagtatagggtttggtgtgagtggtatttagtatatttttataaaagtatgagagagaatagggaattaataagatatggatttaattttaagtagttggtttagtataaattataatttagttttttaattttattttttttttttttttttttgtgttttttttttatttttttttttttttttgttttttttattttttgtttgttttttttgttttttttttttttttttttttttttttttttttttttatatgtattaatttaaggatttaagttttatttttaatgatttggaaaattgaattaagagtaattgttagggagtgtttttgtatgattattttttttttttttgtttgagaatttatagaatttttttgtaagatgtgagtttggtttttaaggttgggttttagtatatatttgggaaagttttggttttgtgtatgggttataaagatttattagaagtagatgtgtggattgaatgttgatttttgtttagaatatttgttttttttttatatttgtgtgtattattataattttaaagaaatattgatatggagtatggttggttttttataggaaatttatatttgtttgttgtggggttgttttttaattattgtagtttttgtgttatttttggagttattgatgggatattggttttttttttgtgtgttgtaatgtattattttttttttgttttttattagatttttttgggaattgttttaaggagaggagatagagaataataattttttttttttgtttttatttagttttaaattttagaaatagtatagaaaattttatttttgtaaaatttttttttatttaaagtgaaaggttatttagtggagtaattgggaaaggtatattttgagggtagaattttatttttagatttatagtgattattgttttaggagttttggatttagtaggaaagtaatgagaggttgtgttattattatatgaggtatggagttaaagggagtttttttttattgaatgaagttttttggtgatgtagttttatgtatattttagaaagtgtttttataagttttaaattaaggtaaataaaatgtagaattattagaaaataaagattaatagtattaatttaggatgtaaatgtttttagtagtttatagttggatattgaaatagtatgtttaatttgttgaaattgattttaatttgatttaaattaagaagttttttttttttttatgttgtagtaggtttttaatgatttttaattgtattaatttaagaaattaaatgattttaaaattatgaattggtaagtaatttagagaattttatttttatgttaaaaattgtattaatagaattttagagttagaaagttttttagtaattagtgaatttagttatttattttttataagaagaaaattaaggttttgaaagattaatttatttgttgatgattatatagtttttttttttagtataatttttttttttgtaatttttatttaggaagtagtttgattaattttgagttaaagttttatttgtaagtgtttttggtttttttgttttggaattgtgtatgtttgtgtgtgttttttttttttgaagtttaagttgtggtgttaatttatggtttagtatgtgagagttggagaatatttttgtagttgtttagttttaattgttagttttggtaaggaaaaatgatagagatttagaaaggttaatagtggtttattttattttataattagttggttttaaatttggaattgaattttgttttttagatggttagtgtattgtagtatattttttggaatgttaggttttattttggttttgttatttttattggttaggaagtatgtatatatagttagtaaaagtaaatttatttgagaagtgtattaattggaatttttataatttgtaatatggtaaagttatttttgtggtttttagaatttttaagattggggtattttttgtatttttttttgttgtttttagaaatgatgaatatgtttttatttgatttttttttttttttttaaattttagtatataaataatgattatatttatggagagaagaaggagtttgtgtgtaggtggttggattgtttaagagagtagaaattttttaaagtttagtatatgttggtagtgtatatgagaagatatatgggtgagaagttttataaatgtattgtgagtatagaagtgggtggtaggtatatttgggtttttttttatatttataagagttgtgtaaattgatgatattagtttaggggaagtgtggttgggtggtaagagaagaggattagagtattgtttggtgataaatgttttggtgtttgagtgattgagttggatagtgtagttttgtatagtggtaagggggtagtggtggttggtattgggaatgaatagtgggttattttgttggttgtagtttaatagtttatggtattatggggtttggaaggtaaagggaagtgttagtttttaatttatagagttgaagttgatttttaaaatagttaatttttatatgaggttttaaagtttttttttttttttttagtgagtttttaggtataggtgtatggaatgggaagggggtgttgtaaggttgtgtattttttattgaggtgtttatgaggtgtattgggtatgttgagttttggtattttatattttaaaggttttttataaatatgattaaattttatgtttttgtatggatataaagttatattaatgaattttgtgttgaatttgaaattagtgggaatttgaggagattaatgagtagataatgaaatttattgtttatattgagtggtttattaaaaaaaaaaattttaggatttttattggtattgaaaattttttatttggaattatattaagttatatttgaattttaataaatgtagagtttagtggattttttgtttttgggttttgaaaagttgttgatttttgaaatattagttttttattaatttggagggtgtgttaggtataagttgttgttgttattgtgtagagtaatttagatttatttgttgtttttagtttgaaggttgtataaaggtttatttgagattagaaaatttgaaaatatatttgagattttatattggagagaaattatatgtttgtgagtatgaaggttgtaataaggtttttttaaatgtttttgattgtgttaaatattaaaatagaatgtattttaatgaggtaagtatttttagtgggtatggagtttgtataaggaaataaagaattattttggggaaggtatatgggaaggtgtagtgtgttttgttttgttttttttttggttatttttagtatgaggggttttgtttttgtaggtgaaggtttgagttttttaggtgggattggaaattggattttatttggagaataataagagatgaggaggaaattttttaaaatttttgtgaatttattagttttatgttgttttgaattgttatttattggttaaatagtgggagtatttgatttggaatttgagttagttatgttgtttaaaatagtaggaatttatgtaaaggatgattttataagttttaaggatatattaagaagtagtatgttgatagttgatagttttttgttaagttatttatttttatttgttttttttaagtggtatttttaaatggtattatattaaaaaagatttttatagagtaattagttttggttaaatgtaatttttagatattttaaattttaaaggattttggaaaatggttttagaaatttagaatattttttaggtagttatttaagaaaatatattgagtaaagttttagggtgatttttgttgtgttattgttatttttaggtagtgattttttttaaattgtagagaggtataagaataaaaattattttaaatttattgtttatattttagtgaatatttttttatagatttttaatttggttttggaggtttagtttaaattttggtttgtttgtgaaatttttttttgaatgtattgagagattaataaaaggattttttatattttgagtggaaataggatagttaattagaatttgttaatatgagatatagtttagtattatagtgtgttattagtttgtttgaaatgtgttagagaaggaatattgtgtatatatgagattttggagtggttgttattttattttattagtgtaggttaaatatatttatgattttttagatagagagttgggtagagagaattttgatagaaataaagtgagttattttgtttagtggatttttggttttaaggtggtaaagatggtttttattatgttttttttagttgaaattgatagagtaaaaatatttttaaagggattaattgtattttgtaaaaagtatatttatttataaatttatatatgtaagtttatatatatattaattttttgtgtgaaaaggttatggaaattggagttatttggaattttattttttaattgtttgaagatattttaaagatgttatatttttatttttaatgtaaaaatgtttttatagtatgtagtagttggaatataatttattatatttgttttgtataaaattttagggagtttagaatagatagatatatagagatagaaagtagattagtggttgttaaaagtagaggggagagggaatagtgatgattgttaatggatataaggtttttttgttggggtggtgaagatattttggaattaggtaatggtgatgattatataatgtttagaatgtattaatgttattgaattgtgtaatttaaagggattatttttatggtatgtgaattatattttaatttaaaattttaaggggttttgatttaatagaatgtattttatatattttatagatttaagtgtaattttgattagaaatttagggggtatttatttttatagatgttaggttaatgttgttttttattattatggagaagtttggatagagggtatgttaggattagaatgtatatatataaagataattattaagtttttttgtttttttatggatttaaaatatttgtatatgtttgtttgttttaattgtggtgtagttgagtttgtgtttttttttaaggtaaaaagtgtaatgttgtgtgagagttgagtgtttgttataagattaaaagataaggatattttgggtagtaatgttattgattatatttgagtaatttatttaaattattaatttttattataaatatataattaaaattttatttatagatatatttataaataaattatattttttttttttatatgtaagattttggttttgtgtgtgattgatggatatttttagatgtattaaaattaagtttgtttaggaaatttagatttgtgtaattttataattttagatgaattaagtgatttgtttttatttatttttttttttatttgtaattttatttatttattgaataaatatttaaagttatttatgtgttaagttttttgttgttttaagtgtggttaagaaaataatggattgtaatgggaagggagtaattgttggtatttttttgtttttttggttgttttgtttatttagggttgttagattgattgtagttttgataggattttttattttagattagatagtttattttttttttaaagatattgttaaataagttttttgagttttgatttggttgaatttttttttttagaaagttgtaatggtttttttttttttatagggagatttgagattttttaaggttgtgtaagtgttagtttttatagggtttaagtttatttttttagttttgattttttattattatgattatgaatgaaattttttagaagttggtgttgtgtattgttatgtttaggtgtatgaagtggttttgttattggatttttgttgaggatatttttttttggtattttaagtaaaatgatttttaataaaagttttgtatattgagtgtttattatgttttatgtattttggtaagtattttatgtatatgatttaatttagtatttattgataattttgtgagttgggtattaagtttagatatagaattttaataattgatgttttttatgattattttagttgaaaaatgattttttttttgtttatatttttatatagtttttatattttatattatagattattgtatttttttattttttttattagattttgtattttttatgattaaattttgttgtatgtaattttgtgtttgtagaattttgtattttagtaagtttgagaatattttttttagtttttaattatattttattttagttattgattataataaaatttgtgggtaaaagttgtgtgaagggttaatatattttgtttatgttatgttgttgtgaggtatatattttttgaatttgtatttttgtgaatttgtgaatttttgtgggtagataatgtgtatgtttatatataagggtatatgggtataggtgtatttgtatgggttgttgtttttggaagtgtaggagttgatatatttgtattttattatatattggttgtgtttttggttttaagttaatttataatgtatatttatatatttataggaagagtagttttttaaatatgtaggttttgtgttttttttttttttttggtttttatatttttgttttatatattttagtttgtttgttgatggaataatttgttataggaatgttgtgagtaagtatagggtttgtgttagaatattgtaaggtaatggtattaattattagagttagttttttgtttttaatgtatagaatttgatgtgtttattttattatatatatatatgttgtaaattatataagtttttgaatagatgtaatttatagttaatgggaattaattttgtttaaaggagttttaggtttggaggtgaaattttttagttttaggatttttgttttattgtattaggatattttagtattttaggtagtatttagtttgtttttgggtttttagtgaaaaagtattttttagatatatattttataagatatggtatttttttaaatataataggtatattatagtaattttgttttttatgatgtttgtttatgtaaaagtttattttttgttatatatagatataaatatatatttatgaaagtatttttgtgtatattatattttaagttaagtgaataaatttataaatttgatgttggttatgagttaaaggttagtagttttgtgattttagaaaataatttgtttatataagtatttgtataattttttatgattgtatttttaggtttgattattgatttatatagaaaatgaaattagtatgaaataatttatagattttagttataaatttattgaggagaagaaaatagattagaaattttggtttttagaatatttgttagttttttgtagtttatgatgaggatttatggatagtttgtaatagggttttttaattttaaagagtagaaaggttttggttattttgagttttgaatatttttatatttgtaatgttatttaaaggagtatattttagtgttatttaatatgggagatgttattggtaatttttaaattatgtttgtgtataaatagtatatttttaaaaggattagagtgatattagattttataattaggatatttataaaaaattttgttatataattttttttgaaaggtgtgtagtttttttttgattagatgatgggtgttttttaagttatttttatagttattgttattattattattattattattaaatatttattgagtgtttattatggtattgtgatattttttatttatagtgtaaatgtttttaagaatattaaggtaatttatatatttttagttttttttgagttttttttttaagttataatttattaaagttaaattttatggatatggaatagtgttttaatggttttattaaattattagtttttagaggtatttgaatattttaaagttttgtgaaagtgttttgaaaggattaaaaatgtaatgagtaattataaaggatttttgggttggggtatagttttttttataataattttttattttgtttttgtgggatttggtagaaattatatgtgtgtaaaattttaggttgtattaagtgttatatagatttaagttttttttggaaatatgtgaagatagtgtatggtttagaggtttatgttattaagaagtagtgaggggatatttatttttggttgttatttttgagagattttggtagttatttatagtttaggttgtttggttgattgatttagggagtttttggtgagtagtaggattttagtaatattattttaaagtgggaagaatgtttttaggtgaaaattgttaaggtagagaagttaatggtatgttatttattttttttttgattttatagtaggtttatttaaaagagttaggtagggtgtatagagggataggattttttggtttttattgtgttaggttgtttttgatttgaggaggtgatgagggtagtgatttgtattgtttatgtgaagttgattagtttagaaaaagagtttttaggttttttaattgatttttaaaattttttttagaattatattattgtgttatggaaggaagaaagatatgattgtttgtttttttagtgtgtttgtaatgttgaaaattatttattgattttttttgtaaatatgttttttgttttttttgttttggtgattttaaggtaaataggttatggtttatattttttaggagtttatagtttagtgggatagatagattgaaaaataaatattgtgtagtgtgatggaggtttatatataagtttgtgtaaagaggatttaggagagggatggattgttggttagttggggtagaggaagttatgggataggagtttagtgttttagagggaagagttgaggaggatgaggaggtagaggagtataggggtgggaggggaatagtatagtaggggtgagtttttttgtttgtttttttgtttttgttttttgaggaaattattttagtattagtttagaaattgggtaaattggagattatttttgtagttgggtttgaattagtaaggtagagtatgagagagggatttggaagatttagtaggtaatttttgtgtttggagattaataggatatgtgggttttgttatttttttagttttttttaaattttagtttgtgattttgttttatgaatgtgattttataaaatatttaaaaattttaaagataataagaaaaattaagagtagatagtatagtagaggagatttagtttatttggttatgtgtagaatggatttaattgtgtaaatatattgggttttgggttgttattttttaatttgtgaaggaagtgtattagagagaagttttatgtttagattgttggatgtatggaaataattaggtaaatagatttatatttaaagttagtatttttttaaaattagagtagtttattggatggagagtttatgaatttatgagtgatgttatagtatgtgtgggtgggaaataatgtataattttattattgagatggtgagaagttatgttttaatgatttattgagtttgtttttgaatttttaagagttttagagagtgatattaagtttagttaaaaataatataaattagttatgtagatttattatgatttattagtgggtagttgtattttgttttaaaaaagtattttaataagatgtttatatattatggttgattattgtattttaattagtttataaattgtgttttatatattttttttgaaggggagtatatgtttatttttaaaataaagtttatttgtataataattgtatagaatatttaatggtttatttttatgtgtttaataaaataaagaaagttaatttgtagttttagattatgttatgaaattgatgatttatatttttgggatattttaagaatttaaaattttttttatttttagtgtatatttttagtttaagaaaattgttattttttttttaaatatttattgtttaaaaagaaaattggtagaaataaaaattatagtgatttggtttagtaatattgagatgttttaatgtgtgaaatattttataaagtaatttagttatattaggttggtgttaatgtaattgtgggttttgttattatttttaatggtaaaatttatagttattttggtattaatttagaattataggattaaaagaaattatggagattaagattatgtttatattttgaggaagttgaggtttagtgaggttaataaattaattatatttttatagtagatattatgtgtgtatatgtttatatatatttaaaagtaggtatttttatagatatttattaataaatatgaaatttatatttttatttttttttaaaaaatatgtttttgatttgattattatgttataaattaaatttttttttttttttttttattaatgtaatattttttttgtttaatgtttttaaatgttttgtttttattttttaaggatagtgggtaataaggtgagggaattttggtttttttgttttttttgttttgtttttatttttttaatatttatttttttttgttaatttttttttagtttttgtggttttgtgatatttttggtagtgaatattatttagatatgttttaaatatagaagtaatgtgtttttaatatttagtatgtgaaaaatgtggagttagttggtgaaatttattgttttatttgtttaggtttttataataaattatattggggtttattaagtagatgttttgaaagatttattattgtattgattaatgtaaatttatttttagattagatgtgtattattttttttgaggaagatttggttttatttgttgttagtaatgtaatttttatttaaatgtggatgtttattgaagtaattttttaattgtgagtgtatttgtgttttatatgaagtgtgtttgtttgtgtgtttgtataaatgtataagtttatgtttgtatatattttgatttgatagtttaggagttaaagatatttaaaattttggaaataagtattttaggaaggagtaggtggtttggtattttagtattttgttgaggttaaaaattaagtaaggttttatatatttatgattaaatttgtataatttatttggttttgtttggttgtttgggataaagttagtgtattatgtagtatttatttagaaagtgtttatttgtttgggtgtatgtattatgatagtagaagaagtgaaagggttttattgtgaagagttttttttggtggtattgtgtattttatttgagattatagtattttgtaattgagtgagtgtagttatttttttttaaagtatttttttttttggttgttgtttgtgtttatagtaatattggtgaaggtgttgtagatgtatggaagtagttggtttaggagtttaggttagttgtattatttattttgtgattttgggtagttattaaatttttttgaatattattttttttatttgtataaaaaggatttgattgtttattaattaggatattgttggaatttgagatggaataattttgtgttgtgtgattgttttgtgtattgtaggttattttatatagtaatttttagatattgggtattttgaatttttaggagttttgggagtgagaggaggtagtattttttttgattgaggattatggtggattagattaagattttattgtttgtagtattgttttatagagtttatttggttggggttagggaattattttttaatttttttagtgaattattagggagtatattaaggagaatagtgaaattattttatagatttatgatggttgtgatttgtagttttttttttttttttttttttttttttttttttttttttttttttttttttttttttttttttttttttttttttttttttttttttttttttttttttttttttttttttttttttttttttttttttttttttttggtatagtataagttaagtgattgaagttttattttttttaattgtttttattgatattttggttgaggttttataaaagtaagaaaatgtggaaggagggaggagaggttataaagagtttggttaattagttttgaatagtttagaggggtttttgttggaggaggtaatgtgtgttgatggtgtatattttatatttatgttttagttgagtaaaatgaattttaagattaaaattatttgggattataataattgttaatattttgtgaattaattgttattatttaggtttttttatatttgtgtgttttttgggttttatatttaattttttataataatttttgaaataaatggtttttgttttatagataaggaaattgaggtttagagtggttaagtaatgtgtttaaagaataaagtggtggagatgggattggaattgaggaagtatgtttgtagagttggtgattggggtaggattttatggttgatattatgttagttatattgtagttagtattttttgttttttattgttttttgttgtttattagtttggtggtttatttgttattttggttaaaagtggttagtttttatttattagaatatagtttttttttttatttaattaattgatgattttgaagattttgatatgtatgagtttttattattggttttttttttttgattttttttggtgatattttttttttttttatttgattttaatagatattttagttaagttttggtggttagtttttatgtagtagttaatagttttttattagtaattattttaatagtgggtttgagttttttttgattgatggaggtagtataggagattttagtgttattgatgaaattttaattatggatttaattatttttattgtaattatagtttttgttttgtaagttaggagaaatttggtagggattaaatggatggagtatgtaaaattagaaaggttaaaataagtgaatggaatgtttttgtgattgaattttattttattttttaaagtttttgtggtttttttttttataggaaatggtgagttttatattagattatgtatttgtttagggtttttttttttgtttttttaaatgtaggtttttagttttatgtttgttagtttttttattagttttaaaatgatgttgtaattatttgttaatgtttagtttatttaagttgttttttgggattgtttatattttaaaaatagttaggaataggataatattgagaaaaaaatgtgattgtgtatgatttatattttgatggtgaaattataattgttagattagggtaagggaatgttagtagtggaggtatttgtggttggaattttgtttttggtttttaaaatttaaaattatgaggttagtagttatttttatttatatttatttagtttaaggaaagttagaaatttttttttattgttagtttttaggttagtttgtatttttgagattatatttttgagagtatttaaggggtgaagtttttgtttgtattaatataggtgttatttgttggtaggatgtggtatgaataggatgttttgagtgtgaatgtgaaatttgtggagtatttttgtttggggatttgtttggaatttaagtgttgtgtattattataagattttttttgtttttgtatagtgtttggggaggggttttagtgaattgagggagttgttattgttttgtttaagttaggtattagtaaattatagtttgtggttatttttagttgtttttgtttttgtaaaggaagttttatggatattttgttatgtttgtttgtttattgttttttgtggttgtgttggggttatattgtagagttgagtagttgtgaggtaggtaatgtggtttgggatattagaaatagtttttagttggttttttatagaaaagggttgtttatgtttggtgtaagttatgtttgaagggaatttatttttgtatggtttttttttttttttgtttttaggtatatagtttaataatatttgtagtttgggtgggtttatgatgttttttttgggtagaagtgatttttttggggtggatgttattatgttgaatatgtttaatagaagggatagtagtgttagtattattagtttggtttatttgagtagttgttgttttttagggattttgttttgtttttttagttgttgttttagtgaggtgttataggttgagggttggttgtagaatgtgagtgtggttgatttttatgattttatttttattgatgttttgtgttgttttagtgaagttagttagagtgatggtttgtttagtttgtttagttttatgtttgtttagtagtattgttttaaggttaagtatgtggttgttataggagggttgttgttgatgtttttgtttaatatggagaggatgagtttgaagatgtgtttggtgttgtttggggatgtttttgagtttggtgtggttttgtttttagtttatgttttgaggaggtgtagtgatgggggagtttatggttatgggtggtgttatttgtagttgtatgatgtgttgggttatggtgtgaggagggttagtgatttggtgtggataggttttgagggtttggttttgttttgtgtgttgtgttttagtagttttagtagttgtaattttttggtgatggttatgtttgtggagaagtgtagttttgtgttttagaattatatgtggtttgagggtggttagttttgaaatttttatttgtttttttgtttttttagtattattgagaatgttattttggagtttttgattatggatgttgatgttaatttgaatgatgaggattttttgttggatgatgtggtgtagtatttaaatttttagaattaagtagggtatgagtagtatttttttagtgtttttttggatgatagtaaagtgttttatgggtttggtgattttgatgtgtttgggttgttagatagttatgttggttagtagttttatgtttttgagtagttttgttttgagggtagtaaaattgatttgtttatttagtggaatgaagttagttttggaagtgttgatttgtttttttttaagtttaagtgtgggttgtggtttgttgtgttgtagatttgtgtttttgggttttgtaatggtatggttgtttatttgtagaattttttgaggagtgggtttgttgggggttattagatttttggggagaatagtaatttttatggtggtttagagtatttgatgttttataatagttttggaagtggtattagtggaaatgttttttatgaatagttttgtaaggttttgtagtatgggaattgttttaataggtagttagtggtttttggtgtatttgatggtgtttgtggtgttgggatttaagttttaaagttgaagagtatttttatgtaagggagtgggggttagttgaattttggtttgttggtagtgttaaatgagttagttggtagtatggtgaatggtatgtagaattaggatttagtgggataggggtatttggtttattagttttttggtgatagtatgtagtatttgggggtaggttgttttggttagtagatgtttgggtagattagtgttattttatatattaatatttattaagggttagagagttgtttgttaggggtttatggtatgggtagttagttgttaagtttggtagttgttaggggttattagttatgtgttagttttgggggtagtaggtgttaggttatgttgagggatagttttgttttgtagttaggatagtttagtgatataagttagatttgtagggtgaatggtattaagatggagatgaaagggtagttttatttgttgtgttttaatttgtagaattattttggttagttttatgattaaattgtgggttttagttagtaagatatgaaagttggtttattttttattttagatgttagttgtttgttataggggattagtgttaaaaattttgagttattttttttaggtgttaattaggtgataagtatagtggatagttttgatagttatgatttggaaggggtatagattgattttgatgttattatagatgatggggattattttagtttgatgttgggggttttgagtttaagtattatttagaattttttttatagttttttttgttttattatgttttgggtgttttttttatttttagtgttgtttatgagtattattaatatggttattggggatatgagttttttgttgatttttttagtggaagaaagtaaattttttgtagttatgtaataggttttaggaaaaaaagattgtaattaatggaaattaataggagttgaagagattaaattgattttgttttggttgtttttttagttttgtatgtattttagtaattttattttatttaattgagatgtgttttaattatattttttttatggaaaaggattttgaaaaattttaaagtattttagggagaaattgttttttattttagttttgaattagtattgttatatttaaattattttttttttaaaaaaaaaaaaaaaaattgtaagttttgttttttttttagtaaattgatgtaaatttgtgatgtgtatattttttttttttttagaagagtagttaaattaaaggatttgatatgttttgttgttgtttaaaggaaataggagttggtgtgtttgtgattaaggggttatatttttagtttttaaaatttttttttata

SEQ ID NO: 56 - DNA, 32411 bp, Homo sapiens
ttaggttaatttcggtttgtgttttagaggaagtttttaacgtagagttggatgggggaggggtggagggtagtcgttgtgaacgtttaggtgggagtttggggattaggtattgtagggaagggttaaaagataggtcggggtaattttttagatttggtttagttagtttgtttttaagatttaggattttgaatttttgtgggtttttttttgtttttatttttaaacgtttgacgcggtgttttttcgtttttcgttgtttttttttatcgttttttttttttttttttatgtttttttcgtttttggtttagggttttcggtttgcgtttttgtaaatatttttttttttttaatttcggtagaatttcgaggggaggggtcggaggttatttttttcgtttgtggttagaggggggtagcgtcgtagtttcgggtttggggggtaggggttatttttgcgtttcgttcgattaggttattcggcgtattaggggtggagggcgggaagcgtgatttttagagaggggggttcggtttgggtaggtgcgggtattggtagggtttaggcgggtttcgggggcgggcggtttaggttatagtttagcggggggtagggggcggttcgcggtttgggcgagttcgttagtttcgaaaggggtcgggcgtatataacgggcgtcgcggcggggagaagacgtagagcgttgttgggttgtcgggtttttcgttttttttttttgttttaagggttttttgtatgagggcgcggtagagattcggattcgcgtcgtgtttttgtcgtttcgttgcgtttcgttcgggttcggtttagttaggtttcgcggtgagttatgattcgtttcggggttttttagacgttggtgttgttgacgttgttcgtcgtcgttgtttttcggtgttagggttaggatgttcgtaagttttttttcgtttttgtttgtttgtttgttttttatgcgttttttagtattttttttttcggttcgttttagttttggagttcgcggtttcgggttaaaacggttttcggggtcgtagcgcgtcgatttaggtataggatacgtagaagtttattaagaagagttttgttaattaaggattttgttttagggttttcggtgtttatcgtagttgtaagtatttgtaggtttttacgttgcgttagaatattgaatttgtaaagtgttggttcggagaagtttgcgtatagatataaatgggtttttttttattagttttgataattaggcgtatatgtatatagttcgttttttcgaagtatttcgagtttagtaaaaatagattttaatttatcgaatttaggtgaagtaggaaagagagagcgcgagcgagggagtaagtaaacgttaaagggttgattttatagtttgtttaaggtttggtggttggtgggtttaaagtagagttagataaaggggattaatattttgatattggtgggttgaaattttaggttataaagaacggttttcgataggttttttgagattttagcgtttttttagggtatttttttttttttagttggttttggagtaaggtgtagttttagcgtttatttcgattttttttcgttcgtttgcgttttttttttgataaagggtatagaaatttttagtaggagaggttatttgaaagacgataatattttaattagatcgtgttttttaaatgttttcgaaaatagcgttttttttttcgcggttttattttatttttcgtcgtttcgaggtattataatgagttatttttttaaattttggaatttatcgagttaggttgcgtggtgtgtgtgtgtgtgcgtgtgtgtgtgtgtatgtgtgtgttagggaaggggagtaggttggtcgattgttacggttgttataattattttaatcggtatagttagagatggtttttgtagtcgggtttaaatgttgttcggattgtatttttttattttttttttggtaaggtttattgtttgggattatatttaggataaacgaagtttggaaagtgtattaggtagagaggatttttttttttacgtgtttgggtacgttttcgacggttgggattttagttttgtttttgtatgttatagattgtaaattaatcgtagagggaaatttttcggcggggggaataaaagttttttgttttcgaggttttgtgggtttttttttgttattaggttgtttttagggatagcgtggaaggcggcgggtttaggcgggtttttcggttattagcgtagcgggggtagggttggagtttgcggcgtagttgcgaggagtcgggagtaggagattttggtcgggttattcggtagtgcgttaagttggaggcgcgtttttgggtatttgaggaatatagcgtgattatacgtggtttggatttagattgattatatttttgtattatatttataagtatacgtttataaagttgtttttttgattgatttttgttttagtgcgtaatggaattagttgggtggttttaaaataatttttaaattttttattcggtattagggtcgtttgtttaattaggcggtagagtttttttatcgtcgtattttttttgggagggagtgattttatagttttttcggtttaaattttttagtcgtttttttttttagagggagtgtgattttgtattcgagaggttgattttgcgttttggagtattttattttttataatttttttcgtttggggttagcggatttaaaggtgtgacgtggggaaatgcgtagtttgcgtggacgttaggaatgttagatatttagagttcggttatattttttttttttatttttttacgagtttgagaaatttattggcggcggcgtttttgatttttatttgtattttagagttttcgttttcgaaagtgtttttggtttaggggagagattttaatttttttttgtgaggtttgtttgtattgggagattggtagcgatggtttttagatggggttgaaacgttgttcgtatttatttaaattggtttttcgcggagatttgtgaatcgggttttgtgtgcgttcgagaaaagttttatttatgagagacgaggtttagtgggttttttcgtatttttagatttttttttttataatgtttttttgtgttcgttcgtcgttatttttcggttttagttttgcgtagagcggcggtgaagtaaaatagtttttcgaaagaggtagttttttaattggtttgttataaagaattatttatacggttttgcggtaatgaggggaatcggattaggcgcgtcgggatgttatcggtagtcgttttggagtagtaattatggtggtgttgggttttttcgtttatatttaggggattcggttacggcgttggtttttttttggggtagttatttaattttattttttattttttcggtgtttgtgagcgagtcgtgtttagagtcgtagttatagagttatttagcggtttttatatttagcgtagtttggtttcgtttttgcgtcggcgtttttcgggtcgttttttttcgggaaatttgattcgtacggggagtggttttttttttagtattttttttttttttttttgggtttttatgggcgagggtgggtttttttgtagtttgggttggagcgtattaatcgatgtttttttttttatattttttttatcgtttgtattttattgttttagttattttaacggcgggtgtgttttcgtaatttttgtattttttttggaattttttatttttttgtgattattttgtttaaaggttaggcggattttttttagtgggaaagtaaaaaggaaagtttatttttggatttttattttttttaaagagtagtgggtaggttcgtttttttttcgttttttgggtttgtggtttttttttattatttattttttgttgttgttattgttttggggattttgatgagaaaaatagcgttgggcgttttttagtacgtggtgcgggttttatagtttttggttgttaaggagcgtttttgttagtataggttttatttgtagtatgaattttagacggtagggcgttggtggaggagattagtttttgttattttttttttgtagttttggaggaggttaggtttggattggttaattttagttttagttaggtatttaacgatttttgttttttaaattggggtgttgtttttagatggaggtagggtttttttaggtagggttataggtggaggttagtattgggggcgttttggttttattggttttttaagtagtttattagtttgtttaagttttaagtgtattgtttgaatgggtttatttttttttttaaattggttttaattttaatatggtttaaagaatgagataagattttaattttaatagttcgtttttttattttttttttttatatatttatttttggagttttattgtttatagattttaatttttgtaggtagaattttttatattttttttgaatgttagttgttagttgtatttagttaattttataatttttagaggaaggtagaagaaagaagatttttttgtttttgggttggtggaagggaggtttcgttatttttttgttttttttttttttatagttttagaatttttatttagaatattttgttttttttttttcgtttattttttaattttttttatttattttattatttggtttttttcgtattaggtgggtaaagagaatatagtatagtaattttttatttttattgttgggttaagatttttattggtgaatagataatatggtgtaaggtgtataataaatatttgttgaatatatggaaaaattaatgatgttttaggaaaataatttttaagttttatatgtttaggtggttttagtttatattttttagtatttgaattttgttaagttgattgtaatttttttttttttttttttggttttttatttttttttttttttggttttttgtttttttttttttatttttggtgtagaggaggttggtagttgtgtgtaggatgggtagaggtataatgataaggatgtgtggaagtcggagttttgtcggatttgtgtttgtgatattgggattgttttttgcgacgatataatttgtgaagacgtgaaagattgttttagttttgagatttttttcggagagtgttgttttatttgtttaattgatttcgttattgttagtggttgtaatttatttattttttgtttaatataaataaattatttgtaagtattgtaaatacgtttttatagatgttggtcgtttttgtaaagtagaggggttagttatttatgggatttggtagttggggtagaaaggaaaggttattttttatttgtaggttgaaattgagtgaacgagtttgagatattagaggggtttttttttgtttaatatttttaaaaatatttgtttttaagatatatgaaggatagatgtgattttataaaaaaaaaaaaaaaaaaattttttttgaaattatttttgtaaattattagagttattatggagattaaatgttttgtttggttaatttacgaattaattttttttttgttatcgatattttgttttttttttagaagatttttatgtatgtggtttttagtgtggagaaagttttgttagttagtggggagattgtaggggtagaggttttttttttgagttatggaatattggtggtagttttttttttgttattattttttttggagttgattattaatttagaagtaaaataataggagagggaagggttaggttttgggagttttcgtggggacgggtggagatagagttttatgtatttgtattgtagtgggtggttataaatttttagttagatttagtgttggtggatgatatatgtgtaggtgatttttttttagtatttatatagatgttttatttttttgtagagtgagtggggacgtttgtgtaggttttttgggtagtttttgttgttcgttttttgttgaagtagagaaggtcgtggtaagggaagtgagaagttgtttttttttaatattttattaatattggttttttaatgtgtagatttttagattttttttgaggggttcgtgtgagtgaagtgttgattgtttttattattttgttgttattgtgaaggagaggttattgattggggatggtataggttatgatgtttcgatgttttttataatttatatgttttgttgtttttgtgtttttatttgtgtttgttttaaggagatttagttttaatgtaagatttttttaagtatttaattttttttttgggagggtttggggttcgggaacggttttttattttgtggggggaagagagattgaatttgtgtttttttttttgtggttgattagattttgagttttttattgtttttttgtgttgtttttgttttttttttttgtatgttgtttgttttttgaataataaagtttgggttatttttattttttatgggattttagtaattttagggttatagtggttttaatattttaatagaggggtttagtggagttataggaagttgtcgttttttttgattgtgtttttttatttgtttgatttaatgagtgtttgagtgataagaataggtatttttttattttaagatttttattttttttttttttatatttttttttttgtagggtaattaggattaaaggtaagggtttttttttttttttttttttatatttttttggttttatattttttgttttaaaagtaatgttatgttaatttagtttgtgattttttagatattagaagatatttgttttagagggtattttaatataggggttgttggtagggttttagattaggggtttagtgggtttattcggtttaattttgtgaatgttttatgttttagggatagaaaggagaatttggagatattaaggatgtaagtgtaaattatttttattcggtattgtagttgttgttttaaatgggttatttttttgtgtttttttttaatttattattttgtggggtttttttttatagattgtaggatttaaaggattttttgggttttaggtaagagagggagaaattttttttttcgtttttttttcgttgcgcgtaagttattgatttgtaggtttttggttttgttgttattttattatgttttttatttttagggatttgtaggggaataaggatttagaggggatcgtggtgataaaggtgaaaaagtgagtaaaaagtaatgttgtttgattttggtggattttttaggttttttaaggttttattatgtgtttaagggtttggttattttttaaagagtagttaagggatagatggtttttggagaaatattgttttttattgatgtttttttttttttatgttaagggtgtttttggatttcgtggtagagatggagaatttgggatttttggaaattttggtttttttggttttttcggtttttttggtttttttggttttggtggagtaagtatttttattttttatttttttaggttgtttttttagaaatgtggtttttaaattgttgtttgtatttatttggttggtttttagggttgttagtagtgtgtatatagtttgtttatgggttttgtttttaggtttgtaatttagaagagttatatattaggtatgagattgtggtgttaagggttggttttttttattaattgggattttataaagaaagtttttagttatttggttttttggtatttgtattacgtagttgatgttggggggtgggtgtaagggataggaggaaggatgattgggtatttgtatttttttggaagacgagtgattattgtttttggaagatatttatttttggtttttgttaagtatattttaagtaattatttatttttatgaaagagttttattgagtgaaggtgtgtggttaaagttaattttggaattaaattaattaataaattatatgattgtttagtttttgtaggtttgttattttgatgtttgttgtattttaaatttttaaatttaaatgggattatagatgtttattatattttttgttgaaatattttaagattgttgattttagttttttgttgggtattaaagttttaaagaataaagaatatttttagaaggtttggttatgtttttttatatacgttaaataatatttgttatattttagagtataaaaataattttataaaatgaaatgtaaggaattgatatttttttaaataatatttttttttttagtgaaatgattttgttattgttatttaataatttatttttaaaattattttttaggtattagtggtaattttgattaatgataggttagtttttaataattagagtttattttagtagagttttttgtatttatatagagtttatttagttaagtagggaagatttagtgttttttaattttttaacgttgttgggtttttttgtagaattttgttgtttagatggttggaggatttgatgaaaaggttggtggcgtttagttgggagtaatgtaaggattaatggtaagaaaagatattagttttttgtagttaaaatggtaggaggtggtttttagtagagttagagagtttgataatttttgttttatagataattgtttagagtggttttttttcgtagttatgtaattttttatttagttagtttaaagtatttggtttttaatggtaatggatgttatttttaatgatgcgttggagtgattaagaagaatgaagatggggagatgtatataggttgatttgttagaagattagttgttattgtttttggaatgagaattgaagaatgtagatagtagttattgttttttagtatttatagatttttagtaggaaattttagttcgtagttttgatttggtatatgttaaatgaaatttagtttttagtaaatatggttgttgtttaggagaaagtaaggttagtttttttgtttaaatggtgtttataaataaaaatagagtgttgcgtggggagtgggaaatgagagggagtagttattttaggttttttgtttatagagtaattttttgttttttgttcgggttgttggttgggagaagatggtatattggaggttattgaggaagtatgtgtagtaaattttttattttttgtttcgatgtagggttttatgggatttcgaggatttttaggttttgtaggtgtttttgtaagtatttgtaattttttttgtttttatcgtgtcgtagatgatttttaagtattatgatgttttagtagtttatagggattgatttggtatttttattttattttttaggggttttaaggattttaaggtaattttggtgaatttggtgaatttggtgtttttgtgagtattagtacggttttgttttttttttgggggagtttttaatgatagattattaggatcgtagttgttgttttttttaggttttgtttagtttttttttatagtcggtggttttaaggaaattcggatgttattttttagttgtggaggaattttgatagatagtttaatgtggtaaggattattagggattttgttttaatagtttttttttcgggttattttagtttgtgttatttgttgcgttttattatgatttttgtatttttgttttgatttttttattttttttttttatagaagaattggtttttaaaattataatgttaaagttttgtttattgtttaggtgtttttttattataattattttttaaattatttttttttgtttgtagggttttatgggttttcgtggtttttttggtttttttggaaagtttggtgatgatgtgagtatatacgagtagataaatgaggagttgttttttttgaaagggtttggagagggtgtgtgtttggggagtgatagggaggtatttagggtggaggtattttgaggagtaagattgggtagttttaaattttgacgttattttttatttatatggttattgtgattgtgttggtaagttttttggggatcgttttggatttaaggggaagataaataattaaaatattattagttttaggaagggaaattgagaaatgagagaagggagagaaaaaatataaggtagaaagatgtagagaaggaaaaataaagaaagaagcgtttaataatttagtattattttaattgtaaatgagttagaaaaagtatagtttgagttaggatgtttataaaggatgtaaacgaaatgaagagataagaattggtatttttgtgttatttttatgaattgtattagatagtaaaagttttttgaggttagagagagtatatatagttagtagaatttaggagaggagagaaaaagttttttaggggaagttggaggttggtgaggatagaggagtttgtttatgggttatgtatgtgtttaaaagaataaatggtgatttatgaaaggtatttaggtacgtggagtttgaaggaggtgagggagatgagtgagtcggtaggtaaaggtatggagggttggaaggagggaagttttttggggtgtttttattatgttattgcgtttttgaggaagttgggatatttttttttttttttttagggtgaagttggaaaatttggaaaagttggtgaaaggggttcgtttggtttttaggtaaacgttatcgtttttagttttaggtattttttttagcgtttttttttttgtggttttaaatatagtgtatttagtttaatgaggttatttttgagatgaaacgttagtagtttttatatttattacgattatgtttgtaatttttatttaggtttttatgagggaggttgggtagttgttatttatattattttgtataaaatggggggtacggggaggggtggtttgggttttatagaaagagttgtttaagtgtggggattcgagataacgttttggtggtttaagggaattggaggtttttttgtagtttagggtagttttttattgttattttattttgtgttttgaatatttttattttggattgtagggtgttcgtggttttttaggaattttaggtttttttggtgttaaaggttatagagtaagtattacgggtgagaaggttggaaggaagagatgtttggtgggagagaaaagtattttggggtgcgtgtattttttttaatttgggttttttagaagtttgattgaatatttttttttgttttttagggttatttaggtttggacggtgttaagggagaggcgggtgtttttggtgtgaaggtgagaggttagaaagtataatgggatggggaggagggagataatgaggagtttttttttttagttagggagatattgtggagtttagtggaattagttttttagaatagttttggttgggaatattagttttatattttgatgggttaatagtaggtttggagagtttagggtattgttttttataggattgaagtttgtgttagtgcgagttgagatgattagggtttttggcgttttttttaggagtttgttggcggttaagaatggggttttagatattgattttgtgtattatttttttagggtgagagtggtttttcgggtgagaacggattttcgggtttaatggtaagtatggatattttttaggaaggtttattaaagattttttagattattagatggttgtaaagagttttttttgtgtaaagtttatattttgtgttgtagattttatttgattgtgagtaaaaagtaaaatgtattagatagatgatttgtttaagattttattaatatttttttaagatatttattttattatattaaagatgtttttatttaaaaaaattttgttgagttttaatattttgttaagtttatttattgtaaggagtaaggtgtgtttgtaataaaggtttttaataggtagtaataggaatattcgtgtgtttcgtttgtggagaaaattgttgggtgtgatttgaggtattttggttagttaaggagttagtattattaggaggtttttgtttttttgggtgtgggtatttttttttttttttggtattcgtaaagggtttgtaggtagaaatggttattttgagtatcgtaaagttaatttatgtttaggttgttttggtgtgtgttttagggttttcgtggtttgtttggtgaaagaggacggattggttttgttggcgttgcggtgagtaattgataaagttaaatattattatttgtcgagtattttagagtttataggtttgttttttttgattttcgaaataattttgtgaggtatagggagtattgttattttttaagaatttatttttagtgtgtttattaaaattttttaggttgagtttgtatagttgaaggaggaaggataggaatgggagggtcgatgggtgaaagtatgatttttttaattagtttagattattaggtaatttttttaataattattatttattttttgggtaatttagttggagtttatagatagatttagttggttatagtattatcgtgttattttttgttttttttggttgtttaaatgttttagaaaagtggaataggtgagtattaatttatagggttttatgttggttgttgttgtgagggatgttatgttatagtattaggggttattattttataggtattttttgtgtttaatattttatatgttttattttattttatttttttttatattttgagaggtggttttatttttttttttattttacggatgaaaaaatcgagatatagaaaggtgaaatagtttaagataaatagtgttttgtagttttagattttggtggtttttagttaatgtgggaaattaagggtgaggggattggtagttgatggagggtgtagggtgttagatagaggcgtttagttttgattttttagtaatagagagtttttgtaggtatttggttaggcgagtgatgcgatgaaagttgtgtttaagaaagattatgttttttgttgattttatatttttaatatttaagttttgaggtttttttttataggtttttgtagggttggttaaaataaagtagttttatttcgttgtgttgttttttagttaatgtgtttgtttggtagaagttttttttaaaggtagattagtgaaataagtagaagtttcgatttttttttgttagttagagttgttgaagtgttttgttttagggttattttgtgtgaggggattagagagtattggggttgttaagaaatattgtcgtttttatagattagtaggatgttggtttgtggttttttagcgaggtttagagttgcggtggttttagtttgtatgggttaaagataagttttattttttgtttttgtttttttttttttgggtatagtcgttttgttttttggttttttttgttggtttttgttcgtacggtagttaggttggtagcgtgtgtaggatttggtttagaagattgataatattgtttttgagtttttttttgttatttttttttttttttttttattagatttttttttggagtttgttttgcgaggtttttgttttgtggtattttagtagtttttttagttttgatttttagaagggggttgtgtagtgttcggggtgtgtaggttttagatacggggtaggtttatggagatttaagtgttgatttagtgttaaggttggtttggagattgggttgggttggtgtttgtttgttgtggttatgtgtttttttttgggtttgtattttttttttagatttgttgtagggagaggtggtagatgttagtttagttttggttttttagagtagtatggtagtttttttttatttaggtttaggttgggtttttttgttggttgatttttggggagagggtgttttagagttttttaaggaattgtttttcgaagtagttaggttagtttagaggggttgtggttaattttgaagttttatgtttttgttgatattttttttaagtttttttttgttttttttttaaatgttaatttggagagttttcgttaggagaaatggattttagttaggaagaagagttgagttgtatttaaaatacgagttttttttaaagtatttttttttagtttttaaggagaggtagagattgataggtaggatttagtaggaaaaggtatttttttgatttgtttagttaggttttaggtttagttttatttagtttgtggtttttagagtttcggtaaagagttttttgggttttaaggaattttgagagagtatttgaggggtgttattataaatttggtagaaaaaattttttttttttaagtttagttttagagaaggagttggtaattttgttttgttttgtaagtaaaagttttttagggtttgagtttagatgtagtgtttgagttgtggttggtgttttgttttattagggagttaatggtagatattttatgggtatttttgtttttcgtaagagtaggttgtttggggatgggttagaggaagaggtaatttggagttaattaagaggaggttttaattaagttttaattatagaggttaattaagttttgaaagcgtttttttttgagtaggtaggaagtattgagtttatatggttgtttcgttgttttatttttttatatttaatttttttagtttttaaatgattatttggttttgaagttacggatatttggggtttgaattgaagttgaagaaaagagaaaatgatttaagttttgtttaagattaggggttaggtgcggtggtttacgtttgtaattttagtattttgggagtttgaggcgggtggattatttgaggttaggagttttagattagtttggttaatatagtaaaatttagtttttattaaaaataataataaaaaaaatagttaggtgtggtgatatatgtttgtaattttagttatttaggaggttgaggtagaattgtttgaatttgagaggtggaggttgtagtgagttaagatcgtattattgtattttagtttggcgatagagttagatttcgttttaaaaataataataaaaaaagattagaagaagtttattattgttttttggttatttattcgtatagatattaaaattgtagtttatatttcgttattttcgtgttttgttttgggatattttaggtatagtgtgtttttcgttttttgtaagggtgggttgggagtagggacggatagggtttgtgggtattttttatggttattttttttttgtttatagggtgttcgaggtaacgatggttagttaggtttcgtagggttttcggtaagtttattttatttttagtaggttattgttgttgtgttttaagtttcgttaagtagtttaaggtagtttgtagggtgtattgggtgtaattatagtagtattttgatgtttattggaaagggggaggaaagagaagaagtttgtaaatattaattgagtatatcgataataagttttgaagtatgggtttattttttttagttatttttttagtagtttttttagaggagggaggttaaaggagtttttgttttttattatagatgtagttagaaatttgttttgttttttgaagttaggtaaagttttttggggacgttggtaatggggataatttttatttaaggttttttagttataatggatatggagtgaaattagtatagaggagggaaggagtgtgaggtgtcggggtggttcgttttggaggttagaattggtatttatttttttttttattcgtttattttttttagggttttgtcggttttgttggtggttttggtttttttggtgtttttggagttaaggtacgtgttttgttgtttagttaggaatttttgggtgtcgagaagttgtttttttttcgtaatttttgtttattgtttttttaataattatttgtttttttttgagaagtagttttttattattttatttattggtttttttatttaggtagggtaaaaagttagatattcgtagttttatttggagggaaagtaagatagaagataaaatgtgggagatttagttataattttggagtggggaaaggtggatagagaagaagacggggatatattataggtttggtaggggtagaaggttaggagtggtagtatagggaagtaaatttaggggagatttaatagttgagtaagttcggggttttgacgggtattggagggaattgggtagggaaaagggtataggtagggagtttttgtttttttttgggtttttgttttatttggggtgtttggtttttttaaattatgttaacggagttttttggaggattattagaggttagtgggaggttagttagtttagggataggtttcgtagtttaggaaggattttagtgtgaacgtttttgggaatgaataaggagtttttatgtgttattggtattaggttgtttttttttttttgggggtttttatggtaattagatagtgtttgaggtttcggagtcgggtgaaggagatttattgtgaagagggatagcggaaggtgaggggggttgattttttgaaaataataattattatagtgaagtaggaatgttttgagaagaaatttgaggaggttttgttttttttttaggttagtagttttttttagggattttgttatttagagtgggttgtaatttttaggaaaaaatgaaagtaaaagtataagttattttgtggggagggggtttgttagaggcgttcgttaaggggaattgggttgtattgagagtagggaggggtagagtttttatgtgtttttgttttggttttttggtttattgagaatagattggggtcggagttagggtgttattgtttattcgttagttagatgggagtgaggtggtgttttgagttgggatgtttagagatttagaagggattttagttttttaataaaatagaaaaataggaggtgggggagagagcggtgttcgtttattattttacggtgttaggatggtagggtttttagtttacgtttttttgatggtgtcgatggaatagtaggttgtttattgttgtagtatgtagttgtgtcgtggtatgtggaggtttattgtgtagagatgaggtaagtagtagaggaggtaggcgtgggaagttattaagttattagttcggttaggtagggagaaaaacggtagcgtgaattgtgtgtgaacgtatatgtttatgtgtagggttgggtgtatgtgtataatttagtgttgtgtttgtagttggttttgagttattgtttatttattagaggtttgtgttttttttttttttttttattttattttttttgtttttttttagggtgaagtcggttttattggtgttcgtggttttgaaggtgtttaaggttttcgcggtgaatttggtatttttgggttttttgggtttgttggtgttttcgtaagtgtagtttttttttggtttgggggggtttggggtttgtggttttggaatttttgattttgtattttgttttgatagttgtgggttttaattattaaatttttattttggtttaatgtttgtttttatttttagatgtatttttttttattttattttttttttgaaatatatagtgggaatgtttttgaaatggatagtatttatgttaggtttttggatttggattttggagggttggaggtggttggggtttattttttgttgtttatttgataatgtttttttttttagggtaattttggaatagatggaatttttggagttaaaggatttgttgtgagtgttgttcgtggattttgttattttaggagagtttagttttgtttttttttttttttgatattttttttttttttttatgtttatagggtgtttttggtattgttggtgtttttggtttttttgggttacggggtttttttggtttttaaggtgtaattggttttttgggttcgaaaggttagacggtaagagtttaaagtgatttttaagttttattgatatttttggagttaaattttattattttttttttttatgtttttttgttttggttttatagcggtttttattcgagggtattttgaataggggttttggggaggggtaggttttttggagagaatttggtgtgaggatttgtttttttttttaagggtgaatttggtattgttggttttaaaggtgaataaggttttaagggagaatttgtgagtatttgtttttaagtttttgttttttttgttgttgttttatgaggtataggttttagttttattgatttattattttttttttttagggttttattttttaatttgggtttttttagattatgtttggaggagatttaatagggttgagaaggtttagatatagttttagtttttatttttggtttggttagtgtgaatagttggatttttagttttttttatttttttttgttttgttatggttcgttttttatggtttttcgtttttaagtttttttttagttttgaaatagttgttaaggttattttttttatattttgagtcgaggtttgttttaaggttaggtgaaggtttattttgttttttttttttgttggtttttagggttttgttggtttttagggagtttttggattcgttggtgaagaaggtaagagaggtgttcgtggagagtttggtggcgttgggtttatcggtttttttggagaaagagttaagtgaatgtggaggttttattttatggggtttgtgatttcgagagggaagtggagtttttgtggttcgtgttttggttaagtttcgtgattttttcgtatgttatttttttttttttttatttatatcgcggggagagggagtttgattttgatttgtgtcgttaattattagattgatatgaaatagtttgagtttttttttaggaagcggggtaggttttagaagttaatttttgagaattttgtaggttatagttattgttttttagaaattggggttggtgggttagtgggatggatttattggagtttggttgggttggggttgtttttatttattgttttttttttttgtggttttttagggtgttttcggtaatcgcggttttttaggttaagatggtttggtaggttttaaggtgagtgggagaagaggggttggggtttttttttgtatcgttgaggttatatggtattttattgattttttgtgtatttttgtagggagtttttggagagcgagggtttagtggttttgttggttttaagggagttaacggtgattttggtcgttttggagaatttggtttttttggagttcgggtaagtagtagagttgttgttgtttttggttttagatttttaggttttttttggttggttttttttagttttgtattgttaggattgggaggttttggggtcggtttttgattttattttttttttttttttgaataaagggttttattggtcgttttggtgatgttggtttttaaggtaaagttggtttttttgtaagtttattttttgagggttgttaggagggtggggggatttttttggggaagtaagggaaaagagagatggagtttgggttagggaggtttgaagtattgtgaattttgagaattgtgatagggggtagatggtaggtattggggttagatgtaatttgtgtagtagttgtgagtattgaaaatgttattttagtatgtattcggggtttatttttgggggaatgatgatatcgtgtgtgtattttttggggtagttttttaagtttagcggtgttttgttgtagatgggtttatgggtgtgatgtggttaattttagatgttgagtatgtgtggttggtgtttagttttgggtttgttatgtaggtttttagtggatgttgggtggatggatgtggttagagtgtttatgttttgagaatggtgttttgttttttagggagtttttggtgaagatggtcgttttggatttttaggtttttagggggttcgtgggtagtttggtgttatgggtttttttggttttaaaggtgttaacgtaagtaataatttgtttttttatttttttttatgtggtgttatttatttttttgtttttttggggaaagggttgggttttgagtagagtttaattagggatagtgatgagtggggtttttgtgttatgggtggtagtgggggtttgtatgtgatttggggaaaatttatggttttatagagtttcggggtattgcggttataattgttttatgtggtagtgtttagtaggttggttgttattatggtttttgaatagaagagaagggttgatattttgttttattttggttgtttattaggatgtggttttaggttttagtttttgtagttcgttttgtttttaatttttttttaaattattcgttttatggttttgtttttttttttttttagggtgagtttggtaaagttggtgagaagggattgtttggtgtttttggtttgagggtaagtattttttttcgttgtttatgatttggtgttggtcgggtatttgtagggaggataggggaacggtttttttatggtatggtttcgggattttttagtattgagtgttgatttttgtggttgagttttatgttggttgggttttttgggtgtttatatagggagatttttgtttgttattggttagtaggtcggggagttggggaaggtttttatgttgagaatagttaagaaaagacggggtttgggaaggaagggaggggaaggtgtggaaatggagtttagttggggtatcgtggaggtttggaaattttgggttagaagtatttttgtttaattttagggggattgtaagtgggaagaaaagcgtgttattgattttttttttttttttttgtttagggtttttttggtaaagatggtgagataggtgttgtaggattttttggttttgttgtaagtatttgtttagtttttttaggtggttttgggggtaggggttgggaggggtgggggtgggagagtttatttattaatggagttgatagatgtgaatgtgggttgagttgatatattagatttattttgagttgaggtagggtgttttaggaggttgtgtggatttatattggtggagaggagtgtgggtggttgatgggagtgtagggaggtatgtatgtattgtttgagtggtgtaggaagacgtttgtgttgtttattttgttgattttttttgggttttattagttgtggtttttagggtttttggaatattggtttagtttatttttttttttttattgtagggatttgttggtgaacgaggcgagtagggtgtttttgggttatttgggttttaggtaggtggttggattaggttttttgtgtagttttttgttatatttagggttttttgggatagtagtaggtattatcggtggagggtttatattttttgtagggtgttaggtatcgagttttttttgtatttttggttgttattgttgttgttttttttttttgggtttgttttatattgtgtttttttgggggttagggtagtaaatttatttttttgttaacgtttgttatttcggtttttagggattttttggtttttttggttttttaggtgaaggtggaaaattaggtgattaggtgagtatggggttttttggatttgtaatttgtttagatgggaaggttttttttgatgtttaggaggtaagggtaagagggtatgaggagttttgtgaggtttgggaatgttttggatttatgttttagtttttatagatgatataattttttatgggaggagtgatatttagttttgttgtggagaattgtttaggggtttgtgatatgaagtttttatttttatatatttttttttgttttttagggtgttttcggtgaagttggagtttttggtttcgtgggttttagggtgagtattttgttggttaatgcgggttgtttttttgggtttgttttgggttttatgtttttgtttttttttttatttttttgtttttttttggatttttttttttattgttgttggttgattattttttggtgtttttgtcgtagggtgaacgaggttttttaggtgaacgtggttttttcggtgtttagggtttttagggttttcgtggttttttcggtatttttggtattgatggttttaaagtaagtgaggttgtattttgtaggggttttcgtggtagtttgggagttttattgagtagggagaagaggagcgggtttaggaggaatgaagaatagaagtggggggagttggaaaggaggtttatatgggaggaagggaaggaagaggggtttggggttttggttatttaggttttatgaatatgggtttagggagaggtgttgtttattatagatttttttttatttttttttttagggtgtatttggtttagtaggtttttttggggtttagggttttttaggtttttagggaatgtttggcgagaggggagtagttggtatcgttgggtttaaaggcgatagggtaagtattgaggttatagttttttattaaagttgtggttttgttatatttttgttttttgtgatcgttttcgtttttttatggtatttggtgatgaaggtttttgttagttttttttgaggagtttaaagatttttttttaaagttttttgttttttagtgatatttttttttttgtttttttattttatttttgttgttttttatttattttgagattatagtaaattttttttgggtagggattgggttttttttagtattttagtttgggtgggattgagtaaattatgggggttttggggtgtttggttgaggcggttggttttttttttttttagggtgacgttggtgagaaaggttttgagggagtttttggaaaggatggtggacgagtaagtgaatgcgggttgttggattgttgggtattaggattttagttttgtatttaggagagtaggagagagggttgggtagtttgttattggggtttttggttttgtttttgtcggggttgggtaattgtagggatttttttgttaaaatggggttagagggtaagtgggagttttggaggcggtgggagtacgtattaaggttggtttggtgtcgggtcgtacgtgttcggttggtttagtttgttttttttatttttatttgtttttttcgtagggtttgataggttttattggtttttttggtttagttggtgttaatggcgagaaggtgagtttcggttttttttttttttatattttgtttttttgttatattttttttttattttttgttaaaggcggttttgttttgtttttttttattattgttattttcggttaaggtcgtaggagtgaagagggggtttttttagaagtgaagtcgttggtagtgttttttgttgggtggggtaattgggttggggtaaatatatatttagtagaggttttcgagagggtgcgggtatgggttgtatagtaatataggttgtgttagggggatttggagttttttttttacgagtaaggttttttaaatgtattttgtttttttttattttgtttttttatttttttattttagtttttttttttttttttatttttagggagaagttggattttttggttttgtaggaagtgttggtgttcgtggcgtttcggtgagtgtttgtttttttgagtttggttttgttcgaggtttttgggaattagagagttagggagttagtgtaggtttttatgttgtttggtggttttgtgtgttgttaggtattggttttttttttattcgttgggtttagggtgggaggagagatgggaagggaagggggaaggtacgttatttttattatgtgtttagggtgagggtttttgggttaatagagtttttgtttgcgtttaggattaaggttgtttttagattttcgtttttggggaataggaggttgggtagggtttaaggggtttttggaggggagtagaagtaggttaggtagcggggtttgatttttcgttatgttttttttttttatagggtgaacgtggagagattgggtttttcggattagcgggatttgttgggttttttgtgagtatttttgtttatttttttgggtttttttatttaggttagttttatatttagtattttcgggtatcggagtttgttagggagggaaatggatgtttttttttttttttttttcgtttttatattaatagaattattatgtttagattaggatatatacgtagatatttatagagttttttgtttttttggaagagttttagggttttagtttgttttttatttatttgtttttttttttttattatagggtgttgatggttagtttggggttaagggtgagtaaggagaggtcggttagaaaggcgatgttggtgtttttggtttttagggtttttttggagtatttgggttttaggtgggtaacgttgtattttaagaattgtttttttaaggaagggtttttggcgtgtagatgggaaggttttagtaggttgcgtagaggatggttcgtaggtttgggaatatttttatgttggtagaaggagtttttatgtggtatgtgggttgtgtgggtggggtgtagggattgatagagtataggttggttatagttagttagaattaagttgttgattttttggggaggagggggcggtggtaggaagagtttttcgggaggttagattttagatcggttttgtggttgtttgataggttttttttagaatataagttttttgtggtagaggggatagagttgtttgtggtagtttttttaggttgggtttttagtgttaagaaagttgtattttcgaaaattttaggggtttattgttggggtttagatagaagtttatcgttttttttgggttattgggttttattgttttttttttttttttttagggttttattggagtgattggttttaaaggagttcgaggtgtttaaggtttttcggtgagtgaggtttttgatattttattttgtattttataaagaggtttggttttagaggtttttatggcgggggtgttttgggatgttttcgattgtttttttagttttgcgttggtttttagtttaagtttatttatagttaggtgggagagagggcgtttgtgggttgggtgtattgtggtttcggattttttagttcgaggtttgtttttcgtttagttttttgaagtgttgattgtggaaatcggaggtagggaaatagtttgtgtttgtttttatgattagattcgggggttttttttttttttttggattttttttgttgttttgtagtttttcgttttttttatattaggttttgagattattttcgtttttcgtttattttaattttaaattttttgagggtttgaggtttttaggggtttttttttttttatatagggagttattggattttttggagttgttggtcgcgttggatttttaggttttaatgtaagtgatgtttttggtatgagaggtataggtaggtatggaatagtttggtttagtatttaatagggtttggagagttttaggttggtttttatttttttgagttcgtttttgttttttggaggagtagttaattgattatggggatttattttttgagggtggttgggggtagggttgtggttttgttgttagtaatgggtggttgttttgttggtttggtgggtaggatagggttgttatgattatttttattttggatagatgttttttgagtatgttttgtgtatttgtttgtgtgttttaaagtaagttcgtatgttttgggtcgtttttagggagtttgtatggagggagtagtggtgatgaatttattgggtttattagcgttataggtagagggagagagtgttgggggtaagtttaggggttagaggggtagggttggagcggtttttgaggaagggggattgaggataaagggaggagggaggagagattttaggtagatgggagaaagtaaagtaagtaggagttggagaagttggggttgtttgtttagagttgttttatatggtgagaaggttgtagcggtagattggggttgggggggttaagttgtttgtttttagtgtggggaggtagagaagtttttagagaggaaattgttgttattgaggttatagtgattttggtagtttggatgaggaagggtgagatgagtttttatttttcgtattttttttttttagggtaattttggattttttggtttttttggtttttttggaaaagatggttttaaaggtgttcgaggagatagcggtttttttggtcgagttggtgaattcggtttttaaggttttgttggattttttggcgagaagggagagtttggagatgacggtttttttgtaagttttttattaggtttatgttaaggtttttgggagtagggtcgtgagtggtttttgagtttatagagtatggggtaggagggagtaggggtcgtggggatgttagggagcggggttgtatagatagagttgtgttgagaggatagaagaggttgggttattgttagtttttattttttgtttttttttttttagggtgtcgaaggtttattaggtttttagggtttggttggttagagaggtatcgtcggtttgtttgggtaacgtggtgagagaggattttttggtttgtttggttcgtcggtgagtgtggggtatttttttttttatttaagttgggttttgtttgttaaggtttttattttttttagtatttttaggattgttttttgtttgttttttttttgaagggttagtgggttttgggtaggggtgtttattatttgtatttattatttttgtttttgtttttttagggtgagttcggtaagtagggtgtttttggagtatttggagatagaggtttttttggtttcgtgggtttttttggtttgacgggttttgtaggtgaatttggacgagaggtgagtagtgagattttttggggtggttttgattggggagaggggttttgtgagtttttgtgttgggttagtaaggataagttttagttagggttttggagaagggggtggtagtgtcggtcgataggtttgaaagtttaggtataatgggaaggttgtcggggagagagacgggtatagagattaagggttgttttcggaaggaggagggaaatttggtgaggaaattttggttttaaagtgtgagtgagttgggtagaagaggagaggtttgggtttttgagaggggttgggggagtagagggggagatgggtaggaagtagttttaagtgtatttttgttttattttgtttagggaagtttcggtgttgatggtttttttggtagagatggcgttgttggagttaaggtgagtgtttggtgtttgtgtgtgtagtgggttggggaggatattgtttcgggtttgataggttagttgggggtggtaggttggaataagttttattttagtttagaaggattttttgtttttgttttttttggaatatttttttttgagtttgagattttttttttgatagggtgatcgtggtgagattggtgttgtgggagtttttggagtttttgggttttttggtttttttggtttcgttggtttaattggtaagtaaggagatagaggagaagttgtaagtattttgaatttagtaaaagtcgtttttttttgcgcggtggggttgaggtagtttttgggttttcgtagtttttggattaaggagtagtggttttagatgtagaggaggtttttatttgttttggtttttttttgacgttgcgtttattttttttttagggtgtataaggttttatgggatttttaggattagttggagttcggggaatttaggtgagtatttaagtgttttgtattgagtttttattagggataggttgggagggtagttagtttttaggtggtttttgggtttttagttttgtgttttcggggattttttagtttgggtgggataggagggggtttttgttttggttttgatttgatttaatcggtgtttgttttgtttttagggtttttaaggttttagaggtgataaaggagaggttggagagtttggcgagagaggtttgaagggatatcgtggttttattggtttgtagggtttgttcggtttttttgtgagtgttattgtttgcgtgggatttttcgaggttttttgttatatagagtttatttgagttttttgtgttgttaggatagtttgggattattttaagtagtttttaggatttttttagggttggagggaggaggaagtggaaagggaatggggttgggatataaagttgtttttttagtttttagaatatagatagatatgtttgtgttgatcgtggttttttgttttttttttttatatagggtttttttggagattaaggtgtttttggttttgttggtttttttggttttagagtaagtgatatggagttggaagatggagggggttttttagagagtgtgggtttgtgtttttatggggagggaaatgttgttgtttttggggaagttgtgggtttaggggtttttatttagtaatgggggtaggattggtttatgtgtttatggttagaaaagcgtttgaggttataatggttgtaagataaatatgaattagtttttcgttgttagatagaatagtattttataaagaggagtttaggagggtaggtaagttatggagttattttgttggtttttggttaaatagagattaatttagggttttatgattgagtatgtgaagaattgggggcggagtggttggtgttattaggatagttatttatttagttttagcgattttttagttttttttgtggtgattattttttttttacgattttttttttttgtagggtttttttggtttcgtcggtttttttggtaaagatggtgttaatggaatttttggttttattgggttttttggttttcgtggacgattaggcgaaatcggttttgttgtaagtgttttgattttttttttgttgtcgaggtgtttttattattcgggaggtttgagtttttttttgtttagggttttttttagggtattagtttgtagttaatagtgatggtattttttattttgaggtttttttagaggttatagggtttatgattagtgttgggaaattgaagagaagggttaaggaagaaatagatatggtgttgtggtttttttggttttcgtttgttatattttcgttttatttatggggttgggaagagggatattttagtatattttagtaaatggggatggatatggaggggtatttttatataattttggttgatttttttgttttttgttgtagggtttttttggaaattttggattttttggttttttaggtttttttggttttggtatcgatatgttcgtttttgttggtttaggttcgagagagaagggtttcgattttttgtagtatatgcgggtcgattaggtagtcggtggtttgagatagtatgacgtcgaggtggatgttatatttaagttttttaataattagattgagagtattcgtagtttcgagggttttcgtaagaattttgttcgtatttgtagagatttgaaattttgttattttgagtggaagagtggtaagtttggagaataggattttttgtttcgggaagtagggagttattttttaggtttagtagtaagggaggagatgttttttagtatagggtagagttgggtttggaagttttcgttagagggttttttttttattttatagtagagaagttgtagttttggtttttgttttgttatggttatttggtcgaggtgattttagggtggattttatttattagttgggtattgtttttgttttttttgtatgtgtttttttttagggttggatttagtttatgtagatttttttgtttttgtatttttttaggtttttttttttttaggttatatgtgaattttattttttgtttttgtaggtttttttgttttttttagttaggtttgggttttttaagtttttgtgtttgtgtttgtttgagtttttatgggtgttgttttttttttttgtaggagattattggattgattttaattaaggttgtattttggacgttatgaaggttttttgtaatatggagattggcgagatttgcgtttattttaatttagtaaacgtttttaagaagaattggtggagtagtaagagtaaggagaagaaatatatttggtttggagaaattattaatggtggtttttatgtgagtatttgggtgttttagatgatgagtagagatggttttttaaatttttttttttttttttttttggaagtttttagtattttttttatatttttttttagttttttgttgggtttgagaggagggaaagaggaggaaaagtattttttttttacgtggaggtgggaaaagaggttttttgagtttgttttatttttggaagtaaaaatgtttaattagttttttgttgttttagtatttttgaggtttttgaattatgaatttttggtagtttttatagtttttggttttattgaatgttagtttttaggttttatattgtcgttttttgttttaatagtttagttatggagatgataatttggtttttaatattgttaacgtttagatgatttttttacgtttgttgtttacggaaggtttttagaatattatttattattgtaagaatagtattgtttatttggacgaagtagttggtaattttaagaaggttttgtttatttagggttttaatgacgtggagattcgggtagagggtaatagtaggtttacgtatattgttttgaaggatggttgtacggtgagtggggttgttagagagaagagttgtttgtgtttaaatcgtttggagtagggttgagggttggttcgcggtagttgttaggttttaaagtgataggattattagaggtatgagtttgagggttatgtagagaagataggttgagtgataggtgagagagaggtatatattattttattttttttatttttttggtttaggggaataaaattttatttggaatttagtgattattgtagaagtgttttcgtaatgtgtatagggtgaagaagcggttataggttgggagtttattgtggggagtggggaaggaggggaagggtagggtggagaagggttttgtcgttaaggataggagttgaagtggagaggtttttggtaagttaagaagaggttttaggagtttttttagtgtggtttaattttgtgggttttgatgttcgttagtttgtttagttttgggtttttgggtagttggaattgggtagtaaggtatttattgaatagagtttttttttttttttttttttagaaatatatcggtaagtggggtaagattgttatcgagtatcggttatagaagattttacgtttttttattattgatattgtatttatggatataggagggttcgagtaggaattcggtgtggatatagggtcggtttgttttttgtaaaaatttgaatttagaaataatataattcgttgtaaatttaaaggatttaagtattttttaattttagttattttaggattttgtattgaatggttgatttgatttgatgtttatttattttatttttttatagttcggattttttttttttttttttttaagagatttgaattgggtagattgtaaaataaaatttcggtgttttatttatttattgtttttttgtaagattttcgggttaaggtagaggtaggaaattaattggtgtgagttaaatgttttttgagtgattgtttttagtttaggttagaagatttttttttaggtgtcgggcgtaggaattgtgtgtgttttatataatggtgttattttgtgttaaatatttttgtattttttaaaatattaattgatattaaaaatgaaaagattattggaaagtatatattgatttgtggtttgttttttagtttgttttttattaatttttcgttttgtaggtatgtttaaatagtagttttaaggattttttttgttgattttttaatcgagagtaaggatattgaagttatatcgttagggttagtagttttatataaatatgaatttgtttttttggtaaattttggtattatgtggaat

SEQ ID NO: 57 - DNA, 32411 bp, Homo sapiens
ttaggttaattttggtttgtgttttagaggaagtttttaatgtagagttggatgggggaggggtggagggtagttgttgtgaatgtttaggtgggagtttggggattaggtattgtagggaagggttaaaagataggttggggtaattttttagatttggtttagttagtttgtttttaagatttaggattttgaatttttgtgggtttttttttgtttttatttttaaatgtttgatgtggtgtttttttgttttttgttgtttttttttattgttttttttttttttttttatgttttttttgtttttggtttagggtttttggtttgtgtttttgtaaatatttttttttttttaattttggtagaattttgaggggaggggttggaggttattttttttgtttgtggttagaggggggtagtgttgtagttttgggtttggggggtaggggttatttttgtgttttgtttgattaggttatttggtgtattaggggtggagggtgggaagtgtgatttttagagaggggggtttggtttgggtaggtgtgggtattggtagggtttaggtgggttttgggggtgggtggtttaggttatagtttagtggggggtagggggtggtttgtggtttgggtgagtttgttagttttgaaaggggttgggtgtatataatgggtgttgtggtggggagaagatgtagagtgttgttgggttgttgggttttttgttttttttttttgttttaagggttttttgtatgagggtgtggtagagatttggatttgtgttgtgtttttgttgttttgttgtgttttgtttgggtttggtttagttaggttttgtggtgagttatgatttgttttggggttttttagatgttggtgttgttgatgttgtttgttgttgttgttttttggtgttagggttaggatgtttgtaagtttttttttgtttttgtttgtttgtttgttttttatgtgttttttagtatttttttttttggtttgttttagttttggagtttgtggttttgggttaaaatggtttttggggttgtagtgtgttgatttaggtataggatatgtagaagtttattaagaagagttttgttaattaaggattttgttttagggtttttggtgtttattgtagttgtaagtatttgtaggtttttatgttgtgttagaatattgaatttgtaaagtgttggtttggagaagtttgtgtatagatataaatgggtttttttttattagttttgataattaggtgtatatgtatatagtttgtttttttgaagtattttgagtttagtaaaaatagattttaatttattgaatttaggtgaagtaggaaagagagagtgtgagtgagggagtaagtaaatgttaaagggttgattttatagtttgtttaaggtttggtggttggtgggtttaaagtagagttagataaaggggattaatattttgatattggtgggttgaaattttaggttataaagaatggtttttgataggttttttgagattttagtgtttttttagggtatttttttttttttagttggttttggagtaaggtgtagttttagtgtttattttgatttttttttgtttgtttgtgttttttttttgataaagggtatagaaatttttagtaggagaggttatttgaaagatgataatattttaattagattgtgttttttaaatgtttttgaaaatagtgtttttttttttgtggttttattttattttttgttgttttgaggtattataatgagttatttttttaaattttggaatttattgagttaggttgtgtggtgtgtgtgtgtgtgtgtgtgtgtgtgtgtatgtgtgtgttagggaaggggagtaggttggttgattgttatggttgttataattattttaattggtatagttagagatggtttttgtagttgggtttaaatgttgtttggattgtatttttttattttttttttggtaaggtttattgtttgggattatatttaggataaatgaagtttggaaagtgtattaggtagagaggatttttttttttatgtgtttgggtatgtttttgatggttgggattttagttttgtttttgtatgttatagattgtaaattaattgtagagggaaattttttggtggggggaataaaagttttttgtttttgaggttttgtgggtttttttttgttattaggttgtttttagggatagtgtggaaggtggtgggtttaggtgggttttttggttattagtgtagtgggggtagggttggagtttgtggtgtagttgtgaggagttgggagtaggagattttggttgggttatttggtagtgtgttaagttggaggtgtgtttttgggtatttgaggaatatagtgtgattatatgtggtttggatttagattgattatatttttgtattatatttataagtatatgtttataaagttgtttttttgattgatttttgttttagtgtgtaatggaattagttgggtggttttaaaataatttttaaattttttatttggtattagggttgtttgtttaattaggtggtagagtttttttattgttgtattttttttgggagggagtgattttatagtttttttggtttaaattttttagttgtttttttttttagagggagtgtgattttgtatttgagaggttgattttgtgttttggagtattttattttttataattttttttgtttggggttagtggatttaaaggtgtgatgtggggaaatgtgtagtttgtgtggatgttaggaatgttagatatttagagtttggttatattttttttttttatttttttatgagtttgagaaatttattggtggtggtgtttttgatttttatttgtattttagagtttttgtttttgaaagtgtttttggtttaggggagagattttaatttttttttgtgaggtttgtttgtattgggagattggtagtgatggtttttagatggggttgaaatgttgtttgtatttatttaaattggttttttgtggagatttgtgaattgggttttgtgtgtgtttgagaaaagttttatttatgagagatgaggtttagtgggtttttttgtatttttagatttttttttttataatgtttttttgtgtttgtttgttgttattttttggttttagttttgtgtagagtggtggtgaagtaaaatagttttttgaaagaggtagttttttaattggtttgttataaagaattatttatatggttttgtggtaatgaggggaattggattaggtgtgttgggatgttattggtagttgttttggagtagtaattatggtggtgttgggtttttttgtttatatttaggggatttggttatggtgttggtttttttttggggtagttatttaattttattttttatttttttggtgtttgtgagtgagttgtgtttagagttgtagttatagagttatttagtggtttttatatttagtgtagtttggttttgtttttgtgttggtgttttttgggttgtttttttttgggaaatttgatttgtatggggagtggttttttttttagtattttttttttttttttttgggtttttatgggtgagggtgggtttttttgtagtttgggttggagtgtattaattgatgtttttttttttatattttttttattgtttgtattttattgttttagttattttaatggtgggtgtgtttttgtaatttttgtattttttttggaattttttatttttttgtgattattttgtttaaaggttaggtggattttttttagtgggaaagtaaaaaggaaagtttatttttggatttttattttttttaaagagtagtgggtaggtttgttttttttttgttttttgggtttgtggtttttttttattatttattttttgttgttgttattgttttggggattttgatgagaaaaatagtgttgggtgttttttagtatgtggtgtgggttttatagtttttggttgttaaggagtgtttttgttagtataggttttatttgtagtatgaattttagatggtagggtgttggtggaggagattagtttttgttattttttttttgtagttttggaggaggttaggtttggattggttaattttagttttagttaggtatttaatgatttttgttttttaaattggggtgttgtttttagatggaggtagggtttttttaggtagggttataggtggaggttagtattgggggtgttttggttttattggttttttaagtagtttattagtttgtttaagttttaagtgtattgtttgaatgggtttatttttttttttaaattggttttaattttaatatggtttaaagaatgagataagattttaattttaatagtttgtttttttattttttttttttatatatttatttttggagttttattgtttatagattttaatttttgtaggtagaattttttatattttttttgaatgttagttgttagttgtatttagttaattttataatttttagaggaaggtagaagaaagaagatttttttgtttttgggttggtggaagggaggttttgttatttttttgttttttttttttttatagttttagaatttttatttagaatattttgtttttttttttttgtttattttttaattttttttatttattttattatttggttttttttgtattaggtgggtaaagagaatatagtatagtaattttttatttttattgttgggttaagatttttattggtgaatagataatatggtgtaaggtgtataataaatatttgttgaatatatggaaaaattaatgatgttttaggaaaataatttttaagttttatatgtttaggtggttttagtttatattttttagtatttgaattttgttaagttgattgtaatttttttttttttttttttggttttttatttttttttttttttggttttttgtttttttttttttatttttggtgtagaggaggttggtagttgtgtgtaggatgggtagaggtataatgataaggatgtgtggaagttggagttttgttggatttgtgtttgtgatattgggattgttttttgtgatgatataatttgtgaagatgtgaaagattgttttagttttgagattttttttggagagtgttgttttatttgtttaattgattttgttattgttagtggttgtaatttatttattttttgtttaatataaataaattatttgtaagtattgtaaatatgtttttatagatgttggttgtttttgtaaagtagaggggttagttatttatgggatttggtagttggggtagaaaggaaaggttattttttatttgtaggttgaaattgagtgaatgagtttgagatattagaggggtttttttttgtttaatatttttaaaaatatttgtttttaagatatatgaaggatagatgtgattttataaaaaaaaaaaaaaaaaaattttttttgaaattatttttgtaaattattagagttattatggagattaaatgttttgtttggttaatttatgaattaattttttttttgttattgatattttgttttttttttagaagatttttatgtatgtggtttttagtgtggagaaagttttgttagttagtggggagattgtaggggtagaggttttttttttgagttatggaatattggtggtagttttttttttgttattattttttttggagttgattattaatttagaagtaaaataataggagagggaagggttaggttttgggagtttttgtggggatgggtggagatagagttttatgtatttgtattgtagtgggtggttataaatttttagttagatttagtgttggtggatgatatatgtgtaggtgatttttttttagtatttatatagatgttttatttttttgtagagtgagtggggatgtttgtgtaggttttttgggtagtttttgttgtttgttttttgttgaagtagagaaggttgtggtaagggaagtgagaagttgtttttttttaatattttattaatattggttttttaatgtgtagatttttagattttttttgaggggtttgtgtgagtgaagtgttgattgtttttattattttgttgttattgtgaaggagaggttattgattggggatggtataggttatgatgttttgatgttttttataatttatatgttttgttgtttttgtgtttttatttgtgtttgttttaaggagatttagttttaatgtaagatttttttaagtatttaattttttttttgggagggtttggggtttgggaatggttttttattttgtggggggaagagagattgaatttgtgtttttttttttgtggttgattagattttgagttttttattgtttttttgtgttgtttttgttttttttttttgtatgttgtttgttttttgaataataaagtttgggttatttttattttttatgggattttagtaattttagggttatagtggttttaatattttaatagaggggtttagtggagttataggaagttgttgttttttttgattgtgtttttttatttgtttgatttaatgagtgtttgagtgataagaataggtatttttttattttaagatttttattttttttttttttatatttttttttttgtagggtaattaggattaaaggtaagggtttttttttttttttttttttatatttttttggttttatattttttgttttaaaagtaatgttatgttaatttagtttgtgattttttagatattagaagatatttgttttagagggtattttaatataggggttgttggtagggttttagattaggggtttagtgggtttatttggtttaattttgtgaatgttttatgttttagggatagaaaggagaatttggagatattaaggatgtaagtgtaaattatttttatttggtattgtagttgttgttttaaatgggttatttttttgtgtttttttttaatttattattttgtggggtttttttttatagattgtaggatttaaaggattttttgggttttaggtaagagagggagaaatttttttttttgttttttttttgttgtgtgtaagttattgatttgtaggtttttggttttgttgttattttattatgttttttatttttagggatttgtaggggaataaggatttagaggggattgtggtgataaaggtgaaaaagtgagtaaaaagtaatgttgtttgattttggtggattttttaggttttttaaggttttattatgtgtttaagggtttggttattttttaaagagtagttaagggatagatggtttttggagaaatattgttttttattgatgtttttttttttttatgttaagggtgtttttggattttgtggtagagatggagaatttgggatttttggaaattttggtttttttggtttttttggtttttttggtttttttggttttggtggagtaagtatttttattttttatttttttaggttgtttttttagaaatgtggtttttaaattgttgtttgtatttatttggttggtttttagggttgttagtagtgtgtatatagtttgtttatgggttttgtttttaggtttgtaatttagaagagttatatattaggtatgagattgtggtgttaagggttggttttttttattaattgggattttataaagaaagtttttagttatttggttttttggtatttgtattatgtagttgatgttggggggtgggtgtaagggataggaggaaggatgattgggtatttgtatttttttggaagatgagtgattattgtttttggaagatatttatttttggtttttgttaagtatattttaagtaattatttatttttatgaaagagttttattgagtgaaggtgtgtggttaaagttaattttggaattaaattaattaataaattatatgattgtttagtttttgtaggtttgttattttgatgtttgttgtattttaaatttttaaatttaaatgggattatagatgtttattatattttttgttgaaatattttaagattgttgattttagttttttgttgggtattaaagttttaaagaataaagaatatttttagaaggtttggttatgtttttttatatatgttaaataatatttgttatattttagagtataaaaataattttataaaatgaaatgtaaggaattgatatttttttaaataatatttttttttttagtgaaatgattttgttattgttatttaataatttatttttaaaattattttttaggtattagtggtaattttgattaatgataggttagtttttaataattagagtttattttagtagagttttttgtatttatatagagtttatttagttaagtagggaagatttagtgttttttaattttttaatgttgttgggtttttttgtagaattttgttgtttagatggttggaggatttgatgaaaaggttggtggtgtttagttgggagtaatgtaaggattaatggtaagaaaagatattagttttttgtagttaaaatggtaggaggtggtttttagtagagttagagagtttgataatttttgttttatagataattgtttagagtggtttttttttgtagttatgtaattttttatttagttagtttaaagtatttggtttttaatggtaatggatgttatttttaatgatgtgttggagtgattaagaagaatgaagatggggagatgtatataggttgatttgttagaagattagttgttattgtttttggaatgagaattgaagaatgtagatagtagttattgttttttagtatttatagatttttagtaggaaattttagtttgtagttttgatttggtatatgttaaatgaaatttagtttttagtaaatatggttgttgtttaggagaaagtaaggttagtttttttgtttaaatggtgtttataaataaaaatagagtgttgtgtggggagtgggaaatgagagggagtagttattttaggttttttgtttatagagtaattttttgttttttgtttgggttgttggttgggagaagatggtatattggaggttattgaggaagtatgtgtagtaaattttttattttttgttttgatgtagggttttatgggattttgaggatttttaggttttgtaggtgtttttgtaagtatttgtaattttttttgtttttattgtgttgtagatgatttttaagtattatgatgttttagtagtttatagggattgatttggtatttttattttattttttaggggttttaaggattttaaggtaattttggtgaatttggtgaatttggtgtttttgtgagtattagtatggttttgttttttttttgggggagtttttaatgatagattattaggattgtagttgttgttttttttaggttttgtttagtttttttttatagttggtggttttaaggaaatttggatgttattttttagttgtggaggaattttgatagatagtttaatgtggtaaggattattagggattttgttttaatagttttttttttgggttattttagtttgtgttatttgttgtgttttattatgatttttgtatttttgttttgatttttttattttttttttttatagaagaattggtttttaaaattataatgttaaagttttgtttattgtttaggtgtttttttattataattattttttaaattatttttttttgtttgtagggttttatgggtttttgtggtttttttggtttttttggaaagtttggtgatgatgtgagtatatatgagtagataaatgaggagttgttttttttgaaagggtttggagagggtgtgtgtttggggagtgatagggaggtatttagggtggaggtattttgaggagtaagattgggtagttttaaattttgatgttattttttatttatatggttattgtgattgtgttggtaagttttttggggattgttttggatttaaggggaagataaataattaaaatattattagttttaggaagggaaattgagaaatgagagaagggagagaaaaaatataaggtagaaagatgtagagaaggaaaaataaagaaagaagtgtttaataatttagtattattttaattgtaaatgagttagaaaaagtatagtttgagttaggatgtttataaaggatgtaaatgaaatgaagagataagaattggtatttttgtgttatttttatgaattgtattagatagtaaaagttttttgaggttagagagagtatatatagttagtagaatttaggagaggagagaaaaagttttttaggggaagttggaggttggtgaggatagaggagtttgtttatgggttatgtatgtgtttaaaagaataaatggtgatttatgaaaggtatttaggtatgtggagtttgaaggaggtgagggagatgagtgagttggtaggtaaaggtatggagggttggaaggagggaagttttttggggtgtttttattatgttattgtgtttttgaggaagttgggatatttttttttttttttttagggtgaagttggaaaatttggaaaagttggtgaaaggggtttgtttggtttttaggtaaatgttattgtttttagttttaggtattttttttagtgtttttttttttgtggttttaaatatagtgtatttagtttaatgaggttatttttgagatgaaatgttagtagtttttatatttattatgattatgtttgtaatttttatttaggtttttatgagggaggttgggtagttgttatttatattattttgtataaaatggggggtatggggaggggtggtttgggttttatagaaagagttgtttaagtgtggggatttgagataatgttttggtggtttaagggaattggaggtttttttgtagtttagggtagttttttattgttattttattttgtgttttgaatatttttattttggattgtagggtgtttgtggttttttaggaattttaggtttttttggtgttaaaggttatagagtaagtattatgggtgagaaggttggaaggaagagatgtttggtgggagagaaaagtattttggggtgtgtgtattttttttaatttgggttttttagaagtttgattgaatatttttttttgttttttagggttatttaggtttggatggtgttaagggagaggtgggtgtttttggtgtgaaggtgagaggttagaaagtataatgggatggggaggagggagataatgaggagtttttttttttagttagggagatattgtggagtttagtggaattagttttttagaatagttttggttgggaatattagttttatattttgatgggttaatagtaggtttggagagtttagggtattgttttttataggattgaagtttgtgttagtgtgagttgagatgattagggtttttggtgttttttttaggagtttgttggtggttaagaatggggttttagatattgattttgtgtattatttttttagggtgagagtggttttttgggtgagaatggatttttgggtttaatggtaagtatggatattttttaggaaggtttattaaagattttttagattattagatggttgtaaagagttttttttgtgtaaagtttatattttgtgttgtagattttatttgattgtgagtaaaaagtaaaatgtattagatagatgatttgtttaagattttattaatatttttttaagatatttattttattatattaaagatgtttttatttaaaaaaattttgttgagttttaatattttgttaagtttatttattgtaaggagtaaggtgtgtttgtaataaaggtttttaataggtagtaataggaatatttgtgtgttttgtttgtggagaaaattgttgggtgtgatttgaggtattttggttagttaaggagttagtattattaggaggtttttgtttttttgggtgtgggtatttttttttttttttggtatttgtaaagggtttgtaggtagaaatggttattttgagtattgtaaagttaatttatgtttaggttgttttggtgtgtgttttagggtttttgtggtttgtttggtgaaagaggatggattggttttgttggtgttgtggtgagtaattgataaagttaaatattattatttgttgagtattttagagtttataggtttgttttttttgatttttgaaataattttgtgaggtatagggagtattgttattttttaagaatttatttttagtgtgtttattaaaattttttaggttgagtttgtatagttgaaggaggaaggataggaatgggagggttgatgggtgaaagtatgatttttttaattagtttagattattaggtaatttttttaataattattatttattttttgggtaatttagttggagtttatagatagatttagttggttatagtattattgtgttattttttgttttttttggttgtttaaatgttttagaaaagtggaataggtgagtattaatttatagggttttatgttggttgttgttgtgagggatgttatgttatagtattaggggttattattttataggtattttttgtgtttaatattttatatgttttattttattttatttttttttatattttgagaggtggttttatttttttttttattttatggatgaaaaaattgagatatagaaaggtgaaatagtttaagataaatagtgttttgtagttttagattttggtggtttttagttaatgtgggaaattaagggtgaggggattggtagttgatggagggtgtagggtgttagatagaggtgtttagttttgattttttagtaatagagagtttttgtaggtatttggttaggtgagtgatgtgatgaaagttgtgtttaagaaagattatgttttttgttgattttatatttttaatatttaagttttgaggtttttttttataggtttttgtagggttggttaaaataaagtagttttattttgttgtgttgttttttagttaatgtgtttgtttggtagaagttttttttaaaggtagattagtgaaataagtagaagttttgatttttttttgttagttagagttgttgaagtgttttgttttagggttattttgtgtgaggggattagagagtattggggttgttaagaaatattgttgtttttatagattagtaggatgttggtttgtggttttttagtgaggtttagagttgtggtggttttagtttgtatgggttaaagataagttttattttttgtttttgtttttttttttttgggtatagttgttttgttttttggttttttttgttggtttttgtttgtatggtagttaggttggtagtgtgtgtaggatttggtttagaagattgataatattgtttttgagtttttttttgttatttttttttttttttttttattagatttttttttggagtttgttttgtgaggtttttgttttgtggtattttagtagtttttttagttttgatttttagaagggggttgtgtagtgtttggggtgtgtaggttttagatatggggtaggtttatggagatttaagtgttgatttagtgttaaggttggtttggagattgggttgggttggtgtttgtttgttgtggttatgtgtttttttttgggtttgtattttttttttagatttgttgtagggagaggtggtagatgttagtttagttttggttttttagagtagtatggtagtttttttttatttaggtttaggttgggtttttttgttggttgatttttggggagagggtgttttagagttttttaaggaattgttttttgaagtagttaggttagtttagaggggttgtggttaattttgaagttttatgtttttgttgatattttttttaagtttttttttgttttttttttaaatgttaatttggagagtttttgttaggagaaatggattttagttaggaagaagagttgagttgtatttaaaatatgagttttttttaaagtatttttttttagtttttaaggagaggtagagattgataggtaggatttagtaggaaaaggtatttttttgatttgtttagttaggttttaggtttagttttatttagtttgtggtttttagagttttggtaaagagttttttgggttttaaggaattttgagagagtatttgaggggtgttattataaatttggtagaaaaaattttttttttttaagtttagttttagagaaggagttggtaattttgttttgttttgtaagtaaaagttttttagggtttgagtttagatgtagtgtttgagttgtggttggtgttttgttttattagggagttaatggtagatattttatgggtatttttgttttttgtaagagtaggttgtttggggatgggttagaggaagaggtaatttggagttaattaagaggaggttttaattaagttttaattatagaggttaattaagttttgaaagtgtttttttttgagtaggtaggaagtattgagtttatatggttgttttgttgttttatttttttatatttaatttttttagtttttaaatgattatttggttttgaagttatggatatttggggtttgaattgaagttgaagaaaagagaaaatgatttaagttttgtttaagattaggggttaggtgtggtggtttatgtttgtaattttagtattttgggagtttgaggtgggtggattatttgaggttaggagttttagattagtttggttaatatagtaaaatttagtttttattaaaaataataataaaaaaaatagttaggtgtggtgatatatgtttgtaattttagttatttaggaggttgaggtagaattgtttgaatttgagaggtggaggttgtagtgagttaagattgtattattgtattttagtttggtgatagagttagattttgttttaaaaataataataaaaaaagattagaagaagtttattattgttttttggttatttatttgtatagatattaaaattgtagtttatattttgttatttttgtgttttgttttgggatattttaggtatagtgtgttttttgttttttgtaagggtgggttgggagtagggatggatagggtttgtgggtattttttatggttattttttttttgtttatagggtgtttgaggtaatgatggttagttaggttttgtagggtttttggtaagtttattttatttttagtaggttattgttgttgtgttttaagttttgttaagtagtttaaggtagtttgtagggtgtattgggtgtaattatagtagtattttgatgtttattggaaagggggaggaaagagaagaagtttgtaaatattaattgagtatattgataataagttttgaagtatgggtttattttttttagttatttttttagtagtttttttagaggagggaggttaaaggagtttttgttttttattatagatgtagttagaaatttgttttgttttttgaagttaggtaaagttttttggggatgttggtaatggggataatttttatttaaggttttttagttataatggatatggagtgaaattagtatagaggagggaaggagtgtgaggtgttggggtggtttgttttggaggttagaattggtatttatttttttttttatttgtttattttttttagggttttgttggttttgttggtggttttggtttttttggtgtttttggagttaaggtatgtgttttgttgtttagttaggaatttttgggtgttgagaagttgttttttttttgtaatttttgtttattgtttttttaataattatttgtttttttttgagaagtagttttttattattttatttattggtttttttatttaggtagggtaaaaagttagatatttgtagttttatttggagggaaagtaagatagaagataaaatgtgggagatttagttataattttggagtggggaaaggtggatagagaagaagatggggatatattataggtttggtaggggtagaaggttaggagtggtagtatagggaagtaaatttaggggagatttaatagttgagtaagtttggggttttgatgggtattggagggaattgggtagggaaaagggtataggtagggagtttttgtttttttttgggtttttgttttatttggggtgtttggtttttttaaattatgttaatggagttttttggaggattattagaggttagtgggaggttagttagtttagggataggttttgtagtttaggaaggattttagtgtgaatgtttttgggaatgaataaggagtttttatgtgttattggtattaggttgtttttttttttttgggggtttttatggtaattagatagtgtttgaggttttggagttgggtgaaggagatttattgtgaagagggatagtggaaggtgaggggggttgattttttgaaaataataattattatagtgaagtaggaatgttttgagaagaaatttgaggaggttttgttttttttttaggttagtagttttttttagggattttgttatttagagtgggttgtaatttttaggaaaaaatgaaagtaaaagtataagttattttgtggggagggggtttgttagaggtgtttgttaaggggaattgggttgtattgagagtagggaggggtagagtttttatgtgtttttgttttggttttttggtttattgagaatagattggggttggagttagggtgttattgtttatttgttagttagatgggagtgaggtggtgttttgagttgggatgtttagagatttagaagggattttagttttttaataaaatagaaaaataggaggtgggggagagagtggtgtttgtttattattttatggtgttaggatggtagggtttttagtttatgtttttttgatggtgttgatggaatagtaggttgtttattgttgtagtatgtagttgtgttgtggtatgtggaggtttattgtgtagagatgaggtaagtagtagaggaggtaggtgtgggaagttattaagttattagtttggttaggtagggagaaaaatggtagtgtgaattgtgtgtgaatgtatatgtttatgtgtagggttgggtgtatgtgtataatttagtgttgtgtttgtagttggttttgagttattgtttatttattagaggtttgtgttttttttttttttttttattttattttttttgtttttttttagggtgaagttggttttattggtgtttgtggttttgaaggtgtttaaggtttttgtggtgaatttggtatttttgggttttttgggtttgttggtgtttttgtaagtgtagtttttttttggtttgggggggtttggggtttgtggttttggaatttttgattttgtattttgttttgatagttgtgggttttaattattaaatttttattttggtttaatgtttgtttttatttttagatgtatttttttttattttattttttttttgaaatatatagtgggaatgtttttgaaatggatagtatttatgttaggtttttggatttggattttggagggttggaggtggttggggtttattttttgttgtttatttgataatgtttttttttttagggtaattttggaatagatggaatttttggagttaaaggatttgttgtgagtgttgtttgtggattttgttattttaggagagtttagttttgtttttttttttttttgatattttttttttttttttatgtttatagggtgtttttggtattgttggtgtttttggtttttttgggttatggggtttttttggtttttaaggtgtaattggttttttgggtttgaaaggttagatggtaagagtttaaagtgatttttaagttttattgatatttttggagttaaattttattattttttttttttatgtttttttgttttggttttatagtggtttttatttgagggtattttgaataggggttttggggaggggtaggttttttggagagaatttggtgtgaggatttgtttttttttttaagggtgaatttggtattgttggttttaaaggtgaataaggttttaagggagaatttgtgagtatttgtttttaagtttttgttttttttgttgttgttttatgaggtataggttttagttttattgatttattattttttttttttagggttttattttttaatttgggtttttttagattatgtttggaggagatttaatagggttgagaaggtttagatatagttttagtttttatttttggtttggttagtgtgaatagttggatttttagttttttttatttttttttgttttgttatggtttgttttttatggttttttgtttttaagtttttttttagttttgaaatagttgttaaggttattttttttatattttgagttgaggtttgttttaaggttaggtgaaggtttattttgttttttttttttgttggtttttagggttttgttggtttttagggagtttttggatttgttggtgaagaaggtaagagaggtgtttgtggagagtttggtggtgttgggtttattggtttttttggagaaagagttaagtgaatgtggaggttttattttatggggtttgtgattttgagagggaagtggagtttttgtggtttgtgttttggttaagttttgtgatttttttgtatgttatttttttttttttttatttatattgtggggagagggagtttgattttgatttgtgttgttaattattagattgatatgaaatagtttgagtttttttttaggaagtggggtaggttttagaagttaatttttgagaattttgtaggttatagttattgttttttagaaattggggttggtgggttagtgggatggatttattggagtttggttgggttggggttgtttttatttattgttttttttttttgtggttttttagggtgtttttggtaattgtggttttttaggttaagatggtttggtaggttttaaggtgagtgggagaagaggggttggggtttttttttgtattgttgaggttatatggtattttattgattttttgtgtatttttgtagggagtttttggagagtgagggtttagtggttttgttggttttaagggagttaatggtgattttggttgttttggagaatttggtttttttggagtttgggtaagtagtagagttgttgttgtttttggttttagatttttaggttttttttggttggttttttttagttttgtattgttaggattgggaggttttggggttggtttttgattttattttttttttttttttgaataaagggttttattggttgttttggtgatgttggtttttaaggtaaagttggtttttttgtaagtttattttttgagggttgttaggagggtggggggatttttttggggaagtaagggaaaagagagatggagtttgggttagggaggtttgaagtattgtgaattttgagaattgtgatagggggtagatggtaggtattggggttagatgtaatttgtgtagtagttgtgagtattgaaaatgttattttagtatgtatttggggtttatttttgggggaatgatgatattgtgtgtgtattttttggggtagttttttaagtttagtggtgttttgttgtagatgggtttatgggtgtgatgtggttaattttagatgttgagtatgtgtggttggtgtttagttttgggtttgttatgtaggtttttagtggatgttgggtggatggatgtggttagagtgtttatgttttgagaatggtgttttgttttttagggagtttttggtgaagatggttgttttggatttttaggtttttagggggtttgtgggtagtttggtgttatgggtttttttggttttaaaggtgttaatgtaagtaataatttgtttttttatttttttttatgtggtgttatttatttttttgtttttttggggaaagggttgggttttgagtagagtttaattagggatagtgatgagtggggtttttgtgttatgggtggtagtgggggtttgtatgtgatttggggaaaatttatggttttatagagttttggggtattgtggttataattgttttatgtggtagtgtttagtaggttggttgttattatggtttttgaatagaagagaagggttgatattttgttttattttggttgtttattaggatgtggttttaggttttagtttttgtagtttgttttgtttttaatttttttttaaattatttgttttatggttttgtttttttttttttttagggtgagtttggtaaagttggtgagaagggattgtttggtgtttttggtttgagggtaagtatttttttttgttgtttatgatttggtgttggttgggtatttgtagggaggataggggaatggtttttttatggtatggttttgggattttttagtattgagtgttgatttttgtggttgagttttatgttggttgggttttttgggtgtttatatagggagatttttgtttgttattggttagtaggttggggagttggggaaggtttttatgttgagaatagttaagaaaagatggggtttgggaaggaagggaggggaaggtgtggaaatggagtttagttggggtattgtggaggtttggaaattttgggttagaagtatttttgtttaattttagggggattgtaagtgggaagaaaagtgtgttattgattttttttttttttttttgtttagggtttttttggtaaagatggtgagataggtgttgtaggattttttggttttgttgtaagtatttgtttagtttttttaggtggttttgggggtaggggttgggaggggtgggggtgggagagtttatttattaatggagttgatagatgtgaatgtgggttgagttgatatattagatttattttgagttgaggtagggtgttttaggaggttgtgtggatttatattggtggagaggagtgtgggtggttgatgggagtgtagggaggtatgtatgtattgtttgagtggtgtaggaagatgtttgtgttgtttattttgttgattttttttgggttttattagttgtggtttttagggtttttggaatattggtttagtttatttttttttttttattgtagggatttgttggtgaatgaggtgagtagggtgtttttgggttatttgggttttaggtaggtggttggattaggttttttgtgtagttttttgttatatttagggttttttgggatagtagtaggtattattggtggagggtttatattttttgtagggtgttaggtattgagttttttttgtatttttggttgttattgttgttgttttttttttttgggtttgttttatattgtgtttttttgggggttagggtagtaaatttatttttttgttaatgtttgttattttggtttttagggattttttggtttttttggttttttaggtgaaggtggaaaattaggtgattaggtgagtatggggttttttggatttgtaatttgtttagatgggaaggttttttttgatgtttaggaggtaagggtaagagggtatgaggagttttgtgaggtttgggaatgttttggatttatgttttagtttttatagatgatataattttttatgggaggagtgatatttagttttgttgtggagaattgtttaggggtttgtgatatgaagtttttatttttatatatttttttttgttttttagggtgtttttggtgaagttggagtttttggttttgtgggttttagggtgagtattttgttggttaatgtgggttgtttttttgggtttgttttgggttttatgtttttgtttttttttttatttttttgtttttttttggatttttttttttattgttgttggttgattattttttggtgtttttgttgtagggtgaatgaggttttttaggtgaatgtggtttttttggtgtttagggtttttagggtttttgtggtttttttggtatttttggtattgatggttttaaagtaagtgaggttgtattttgtaggggtttttgtggtagtttgggagttttattgagtagggagaagaggagtgggtttaggaggaatgaagaatagaagtggggggagttggaaaggaggtttatatgggaggaagggaaggaagaggggtttggggttttggttatttaggttttatgaatatgggtttagggagaggtgttgtttattatagatttttttttatttttttttttagggtgtatttggtttagtaggtttttttggggtttagggttttttaggtttttagggaatgtttggtgagaggggagtagttggtattgttgggtttaaaggtgatagggtaagtattgaggttatagttttttattaaagttgtggttttgttatatttttgttttttgtgattgtttttgtttttttatggtatttggtgatgaaggtttttgttagttttttttgaggagtttaaagatttttttttaaagttttttgttttttagtgatatttttttttttgtttttttattttatttttgttgttttttatttattttgagattatagtaaattttttttgggtagggattgggttttttttagtattttagtttgggtgggattgagtaaattatgggggttttggggtgtttggttgaggtggttggttttttttttttttagggtgatgttggtgagaaaggttttgagggagtttttggaaaggatggtggatgagtaagtgaatgtgggttgttggattgttgggtattaggattttagttttgtatttaggagagtaggagagagggttgggtagtttgttattggggtttttggttttgtttttgttggggttgggtaattgtagggatttttttgttaaaatggggttagagggtaagtgggagttttggaggtggtgggagtatgtattaaggttggtttggtgttgggttgtatgtgtttggttggtttagtttgttttttttatttttatttgttttttttgtagggtttgataggttttattggtttttttggtttagttggtgttaatggtgagaaggtgagttttggttttttttttttttatattttgtttttttgttatattttttttttattttttgttaaaggtggttttgttttgtttttttttattattgttatttttggttaaggttgtaggagtgaagagggggtttttttagaagtgaagttgttggtagtgttttttgttgggtggggtaattgggttggggtaaatatatatttagtagaggtttttgagagggtgtgggtatgggttgtatagtaatataggttgtgttagggggatttggagttttttttttatgagtaaggttttttaaatgtattttgtttttttttattttgtttttttatttttttattttagtttttttttttttttttatttttagggagaagttggattttttggttttgtaggaagtgttggtgtttgtggtgttttggtgagtgtttgtttttttgagtttggttttgtttgaggtttttgggaattagagagttagggagttagtgtaggtttttatgttgtttggtggttttgtgtgttgttaggtattggttttttttttatttgttgggtttagggtgggaggagagatgggaagggaagggggaaggtatgttatttttattatgtgtttagggtgagggtttttgggttaatagagtttttgtttgtgtttaggattaaggttgtttttagatttttgtttttggggaataggaggttgggtagggtttaaggggtttttggaggggagtagaagtaggttaggtagtggggtttgattttttgttatgttttttttttttatagggtgaatgtggagagattgggttttttggattagtgggatttgttgggttttttgtgagtatttttgtttatttttttgggtttttttatttaggttagttttatatttagtatttttgggtattggagtttgttagggagggaaatggatgttttttttttttttttttttgtttttatattaatagaattattatgtttagattaggatatatatgtagatatttatagagttttttgtttttttggaagagttttagggttttagtttgttttttatttatttgtttttttttttttattatagggtgttgatggttagtttggggttaagggtgagtaaggagaggttggttagaaaggtgatgttggtgtttttggtttttagggtttttttggagtatttgggttttaggtgggtaatgttgtattttaagaattgtttttttaaggaagggtttttggtgtgtagatgggaaggttttagtaggttgtgtagaggatggtttgtaggtttgggaatatttttatgttggtagaaggagtttttatgtggtatgtgggttgtgtgggtggggtgtagggattgatagagtataggttggttatagttagttagaattaagttgttgattttttggggaggagggggtggtggtaggaagagttttttgggaggttagattttagattggttttgtggttgtttgataggttttttttagaatataagttttttgtggtagaggggatagagttgtttgtggtagtttttttaggttgggtttttagtgttaagaaagttgtatttttgaaaattttaggggtttattgttggggtttagatagaagtttattgttttttttgggttattgggttttattgttttttttttttttttttagggttttattggagtgattggttttaaaggagtttgaggtgtttaaggttttttggtgagtgaggtttttgatattttattttgtattttataaagaggtttggttttagaggtttttatggtgggggtgttttgggatgtttttgattgtttttttagttttgtgttggtttttagtttaagtttatttatagttaggtgggagagagggtgtttgtgggttgggtgtattgtggttttggattttttagtttgaggtttgttttttgtttagttttttgaagtgttgattgtggaaattggaggtagggaaatagtttgtgtttgtttttatgattagatttgggggttttttttttttttttggattttttttgttgttttgtagttttttgttttttttatattaggttttgagattatttttgttttttgtttattttaattttaaattttttgagggtttgaggtttttaggggtttttttttttttatatagggagttattggattttttggagttgttggttgtgttggatttttaggttttaatgtaagtgatgtttttggtatgagaggtataggtaggtatggaatagtttggtttagtatttaatagggtttggagagttttaggttggtttttatttttttgagtttgtttttgttttttggaggagtagttaattgattatggggatttattttttgagggtggttgggggtagggttgtggttttgttgttagtaatgggtggttgttttgttggtttggtgggtaggatagggttgttatgattatttttattttggatagatgttttttgagtatgttttgtgtatttgtttgtgtgttttaaagtaagtttgtatgttttgggttgtttttagggagtttgtatggagggagtagtggtgatgaatttattgggtttattagtgttataggtagagggagagagtgttgggggtaagtttaggggttagaggggtagggttggagtggtttttgaggaagggggattgaggataaagggaggagggaggagagattttaggtagatgggagaaagtaaagtaagtaggagttggagaagttggggttgtttgtttagagttgttttatatggtgagaaggttgtagtggtagattggggttgggggggttaagttgtttgtttttagtgtggggaggtagagaagtttttagagaggaaattgttgttattgaggttatagtgattttggtagtttggatgaggaagggtgagatgagtttttattttttgtattttttttttttagggtaattttggattttttggtttttttggtttttttggaaaagatggttttaaaggtgtttgaggagatagtggtttttttggttgagttggtgaatttggtttttaaggttttgttggattttttggtgagaagggagagtttggagatgatggtttttttgtaagttttttattaggtttatgttaaggtttttgggagtagggttgtgagtggtttttgagtttatagagtatggggtaggagggagtaggggttgtggggatgttagggagtggggttgtatagatagagttgtgttgagaggatagaagaggttgggttattgttagtttttattttttgtttttttttttttagggtgttgaaggtttattaggtttttagggtttggttggttagagaggtattgttggtttgtttgggtaatgtggtgagagaggattttttggtttgtttggtttgttggtgagtgtggggtatttttttttttatttaagttgggttttgtttgttaaggtttttattttttttagtatttttaggattgttttttgtttgttttttttttgaagggttagtgggttttgggtaggggtgtttattatttgtatttattatttttgtttttgtttttttagggtgagtttggtaagtagggtgtttttggagtatttggagatagaggtttttttggttttgtgggtttttttggtttgatgggttttgtaggtgaatttggatgagaggtgagtagtgagattttttggggtggttttgattggggagaggggttttgtgagtttttgtgttgggttagtaaggataagttttagttagggttttggagaagggggtggtagtgttggttgataggtttgaaagtttaggtataatgggaaggttgttggggagagagatgggtatagagattaagggttgtttttggaaggaggagggaaatttggtgaggaaattttggttttaaagtgtgagtgagttgggtagaagaggagaggtttgggtttttgagaggggttgggggagtagagggggagatgggtaggaagtagttttaagtgtatttttgttttattttgtttagggaagttttggtgttgatggtttttttggtagagatggtgttgttggagttaaggtgagtgtttggtgtttgtgtgtgtagtgggttggggaggatattgttttgggtttgataggttagttgggggtggtaggttggaataagttttattttagtttagaaggattttttgtttttgttttttttggaatatttttttttgagtttgagattttttttttgatagggtgattgtggtgagattggtgttgtgggagtttttggagtttttgggttttttggtttttttggttttgttggtttaattggtaagtaaggagatagaggagaagttgtaagtattttgaatttagtaaaagttgtttttttttgtgtggtggggttgaggtagtttttgggtttttgtagtttttggattaaggagtagtggttttagatgtagaggaggtttttatttgttttggtttttttttgatgttgtgtttattttttttttagggtgtataaggttttatgggatttttaggattagttggagtttggggaatttaggtgagtatttaagtgttttgtattgagtttttattagggataggttgggagggtagttagtttttaggtggtttttgggtttttagttttgtgtttttggggattttttagtttgggtgggataggagggggtttttgttttggttttgatttgatttaattggtgtttgttttgtttttagggtttttaaggttttagaggtgataaaggagaggttggagagtttggtgagagaggtttgaagggatattgtggttttattggtttgtagggtttgtttggtttttttgtgagtgttattgtttgtgtgggattttttgaggttttttgttatatagagtttatttgagttttttgtgttgttaggatagtttgggattattttaagtagtttttaggatttttttagggttggagggaggaggaagtggaaagggaatggggttgggatataaagttgtttttttagtttttagaatatagatagatatgtttgtgttgattgtggttttttgttttttttttttatatagggtttttttggagattaaggtgtttttggttttgttggtttttttggttttagagtaagtgatatggagttggaagatggagggggttttttagagagtgtgggtttgtgtttttatggggagggaaatgttgttgtttttggggaagttgtgggtttaggggtttttatttagtaatgggggtaggattggtttatgtgtttatggttagaaaagtgtttgaggttataatggttgtaagataaatatgaattagttttttgttgttagatagaatagtattttataaagaggagtttaggagggtaggtaagttatggagttattttgttggtttttggttaaatagagattaatttagggttttatgattgagtatgtgaagaattgggggtggagtggttggtgttattaggatagttatttatttagttttagtgattttttagttttttttgtggtgattattttttttttatgattttttttttttgtagggtttttttggttttgttggtttttttggtaaagatggtgttaatggaatttttggttttattgggttttttggtttttgtggatgattaggtgaaattggttttgttgtaagtgttttgattttttttttgttgttgaggtgtttttattatttgggaggtttgagtttttttttgtttagggttttttttagggtattagtttgtagttaatagtgatggtattttttattttgaggtttttttagaggttatagggtttatgattagtgttgggaaattgaagagaagggttaaggaagaaatagatatggtgttgtggtttttttggtttttgtttgttatatttttgttttatttatggggttgggaagagggatattttagtatattttagtaaatggggatggatatggaggggtatttttatataattttggttgatttttttgttttttgttgtagggtttttttggaaattttggattttttggttttttaggtttttttggttttggtattgatatgtttgtttttgttggtttaggtttgagagagaagggttttgattttttgtagtatatgtgggttgattaggtagttggtggtttgagatagtatgatgttgaggtggatgttatatttaagttttttaataattagattgagagtatttgtagttttgagggtttttgtaagaattttgtttgtatttgtagagatttgaaattttgttattttgagtggaagagtggtaagtttggagaataggattttttgttttgggaagtagggagttattttttaggtttagtagtaagggaggagatgttttttagtatagggtagagttgggtttggaagtttttgttagagggttttttttttattttatagtagagaagttgtagttttggtttttgttttgttatggttatttggttgaggtgattttagggtggattttatttattagttgggtattgtttttgttttttttgtatgtgtttttttttagggttggatttagtttatgtagatttttttgtttttgtatttttttaggtttttttttttttaggttatatgtgaattttattttttgtttttgtaggtttttttgttttttttagttaggtttgggttttttaagtttttgtgtttgtgtttgtttgagtttttatgggtgttgttttttttttttgtaggagattattggattgattttaattaaggttgtattttggatgttatgaaggttttttgtaatatggagattggtgagatttgtgtttattttaatttagtaaatgtttttaagaagaattggtggagtagtaagagtaaggagaagaaatatatttggtttggagaaattattaatggtggtttttatgtgagtatttgggtgttttagatgatgagtagagatggttttttaaatttttttttttttttttttttggaagtttttagtattttttttatatttttttttagttttttgttgggtttgagaggagggaaagaggaggaaaagtattttttttttatgtggaggtgggaaaagaggttttttgagtttgttttatttttggaagtaaaaatgtttaattagttttttgttgttttagtatttttgaggtttttgaattatgaatttttggtagtttttatagtttttggttttattgaatgttagtttttaggttttatattgttgttttttgttttaatagtttagttatggagatgataatttggtttttaatattgttaatgtttagatgatttttttatgtttgttgtttatggaaggtttttagaatattatttattattgtaagaatagtattgtttatttggatgaagtagttggtaattttaagaaggttttgtttatttagggttttaatgatgtggagatttgggtagagggtaatagtaggtttatgtatattgttttgaaggatggttgtatggtgagtggggttgttagagagaagagttgtttgtgtttaaattgtttggagtagggttgagggttggtttgtggtagttgttaggttttaaagtgataggattattagaggtatgagtttgagggttatgtagagaagataggttgagtgataggtgagagagaggtatatattattttattttttttatttttttggtttaggggaataaaattttatttggaatttagtgattattgtagaagtgtttttgtaatgtgtatagggtgaagaagtggttataggttgggagtttattgtggggagtggggaaggaggggaagggtagggtggagaagggttttgttgttaaggataggagttgaagtggagaggtttttggtaagttaagaagaggttttaggagtttttttagtgtggtttaattttgtgggttttgatgtttgttagtttgtttagttttgggtttttgggtagttggaattgggtagtaaggtatttattgaatagagtttttttttttttttttttttagaaatatattggtaagtggggtaagattgttattgagtattggttatagaagattttatgtttttttattattgatattgtatttatggatataggagggtttgagtaggaatttggtgtggatatagggttggtttgttttttgtaaaaatttgaatttagaaataatataatttgttgtaaatttaaaggatttaagtattttttaattttagttattttaggattttgtattgaatggttgatttgatttgatgtttatttattttatttttttatagtttggattttttttttttttttttttaagagatttgaattgggtagattgtaaaataaaattttggtgttttatttatttattgtttttttgtaagatttttgggttaaggtagaggtaggaaattaattggtgtgagttaaatgttttttgagtgattgtttttagtttaggttagaagatttttttttaggtgttgggtgtaggaattgtgtgtgttttatataatggtgttattttgtgttaaatatttttgtattttttaaaatattaattgatattaaaaatgaaaagattattggaaagtatatattgatttgtggtttgttttttagtttgttttttattaattttttgttttgtaggtatgtttaaatagtagttttaaggattttttttgttgattttttaattgagagtaaggatattgaagttatattgttagggttagtagttttatataaatatgaatttgtttttttggtaaattttggtattatgtggaat

SEQ ID NO: 58 - DNA, 16153 bp, Homo sapiens
ttttaggtttagtttttttttttttgatggcgtatttggttttttttgttgtttttttagtttttttggtatagagaggcgttttggggttaaggtagtttttttgggaatgtttatttatgtatgaagtttttttttgttgtattttggatttagatttttcgatttatttagggtggtgtttgtggggagggggtttatttttttaggaagtatagttacgtcgttttttattggtttcgttaagtagagttgtgtgtttagtggtttttgttggggttttttttttatttttttttaaggtgggggtgtttggaggtggaggaggtttttatatttcgtgttatgattttttaaggcgggttattcgtgtgtattttttatttttagtgttaggtagaagtttatttttatttaggaatagggtagtttgtttaatagaagggtttcggtttttttattagtatcgggaagttttttttaggtaaattttttattatttttttttttttttatattttgaaagagggagttttaggtaggggaggggttagagggggaagtcgttgtttagattttgataaggtgatttgaaggaattcggggagggggatgggatagggtttaggtttggggtgtatggggaggggggttttgtttttaaaagaggttattttagtaatatttttttgtttttttttaggggtcgaagagttattatcgagtttgtgtgggaggaggtggattttagtttttagttttagggttttgaatcgttgttagtttagttttttgtttagtttgttttatagtttgagttttagtaggttagagagtttagttttgaggtgagttgttgtggtttgtggtttaggcgattttagcgtttttagaattgaggttggtagttagttttagttttagttttaattgcgaggtagagaggtgagtgttttaggtattttgaggtttggtagagagggttataggttttgcgcgggagttttcgaattgggattttttttttttgtaagtagttttggtttagagaggttggcgtggatttagttatatagttgggatttggagtttcgtggttggttttaggtgttttcgtttaggggttagagtaggtgtgggtagagtaggtttttcgtagtttttacggtatcgaggttttggtaggggagtttttgggagacgaaagagggtaaagaaggggagaggggtagggagagagcgggtagttaaaggggagaagatggggggtagaaagtgggtagagagggaaaaagggaaaatattattggggaagaatttaaaaatttaaggaaagttgggttttgttgggggttgtgagattttcgggtttttttcgttttaggttgttggttatggggttttgtattaatggtttgatttttttgtcggtttgtatttattaaagtgggtgatagttttaggttttttggttgtttagaattgaggtaataattagaggttttttgagtaaagggtttaaggggtttcggcgttaggattttattgtggttaggagtttgcggggtttttcgtgtgtaagaggggtgaaaggtggttagaaaggtttagttagtggtttttgttttagttagagggagttttgtagtgggggtagtatttatttattggttaggtattggggtgataggggaggttttaggatttggggagcgttggagttggaggtatatggattggagtttttgtatttgttttacgatagggtttgtagggagggatttagtaggtgattttttaggttgatttgtttattttagatagaagtcgggagtgtttttttaaaggtgtttttattttagatatttaataaaatggtaatatagtggcgtcgttttagttttttggagtgtgtatcgtttgaattttttttttagggtttttttttaagtattttaatttggatttatattttttacgtatttttggttttgggtagattgagtagttttggggtggtttgtgttgtttggtgtggagggttgtagttcgggtttttagttttattttttaggtcggtcgggttgacgttagcgagtgtgtttttttttagcgaggggagtgagcgtaaggttagcgtttcgtttgcggcgttttgtagggggtgacggaggggcgttttgaggatttttggagaaaggagttgggtttgtaaaatgttgggtttggttttacggacggcggagcggtgagtttagagttagagttggggaggaaatgggaatgagaaaggtttattttagggttggtgagcgaggggatggggagtagttataggtcgaggttggggtatgggttaggttttatggggtgagtttgagtttttgaggggatgtttattttttgtggaatgtgggtttgttagtggagaggagattagcgttgttttggtgaggtgttggtttagggttggggggcggacgttgtttggggttaaagtttttgtcggttaagttttgggtgggaggagattttggtttttttttaatatttttggattgttggcgggattttttttattttcgggggttggaagtagtgggggaggagttagttttgaggaagaatttcgatgttggttttgattagaggggagtcggtgtgtttttcgagttttagggtgattcgcgtttgttttagtttttagtttgttttggttatttttgattaaataaggagagtatttagtaggtagttttacgagggagggggaatatgtgtgtatttttatttttttatttgtttttttttttttatagggttattatattttgttgtgggtattttaaggtgatttttagttttttttttattttaaaaagtttaggtatgtatttttaagtatgagcggtggttttttgggggaaggtatttcggtagggtagaataaagggaagggatttttaaataggttattggtgtaattgtttttagtatttttaaagaggaggagaatttataattcggaattggggtttattttcgatgtttaatttgtttttagtttgggaagtaggcgtggaggagaaggtggggggagtttagagttggttttgggggttttggttttgtttatgacgggagtttcggtaatttagttcgttttttcggggattaggtttgtagataggtattttttaaatgttttttatttttaaatttataagttattttgtagaggaaaatattaatatagttaggggttttttgttggaggtttttttttttataggtatagtcggagaggttagagagttggggatacggggaggttgtagaaggttggtgggaaggggggtagtgatgggtggggagagatgggttagatgtttttggaatgggatatgggggtgattgatgtagatagaaatttgaaggggatatttttacgtgttttgttttgtgggtggaaaatgggttgttttttatggtgggggcgggttttttttgttttgttaagttaatgtgaaagagatgttttattttgtttagttttttatatttgtttaaggttattaatttttgtttttttagtgttaggttttgagatgttttttttttagtcggggtttttttatggggtgataatggggataagtaatgtttattgtagttgttttaggattttttattattttgttggtttttagcggtgttttttttttggtagtatttttatttattttataggtttttttagggttattgttttatcgttcgatattgtttaacgttaaggggtgattttgtttttgtcgatagggtcgttgggcgtttgtatgcgggtttaatatttgtttataaggaattgggttttttttagtcggagtggatagattttttttgaaaattcgtttggagagaacgaaaagagatttttggtattttagcggcgtgtagttttgtattttttttttttcgggtttcgtgttttttatttttttttttattttttttgttttttagtgttatttaaataaaattggttttatttttgtttggtgttggcgaaggttcgaacggcgcgcgtaaagtttcggggtaggtcggaggtggttatcgggggtgtttcgggtttttaagttaagtcggggattagtttgttttcggtggcggttcggtcgcggtttcgtttaggttcgtagcgcggaggcgagtggggcgtagtggcgagggggagtttgcggattttttacgcggggatcgagtaggtatttgggagtttcgggagcgttcgggaagtagcgttttggtcgttttttcgcggtttttgggttttttttttatattcggacgttcgttaagttcgggttgtcgttataaacgcgtttttcgtgtggagaaggtaaagaaaaaaaaaaataaaagtaaaaggaagaaaaattttaaagaacgaaaagtagaattttagtcggtcgtgcgcgttagggcgtttcgcgttatttgttcgcgtcgttcgcgttcgggttttcggggagggcgttagtgtttcgcgcgcgttttagttaaggtgaattttcggtagcgtttttttttcgttgttcgggaagtttgagtttaataattagtttttgattttcgggggattttaatttacggaataatttttttgtttttttcgaattcggatattttattttttttgggattttttaaatttaagtattgttttttaagttttttaaatatatttattatttcgacgggttataataatttttttggacgttaattttcggggacgttaaaatatattagtttcggcgggtttttttagatttatattatgtggtttggggttttagatgtgtttttttttaggttttggatagttttatatattttttttaggttttatagatttataggttattaattcggtttttttaattttaaagacgaagtttttggttcgtggtggtcgcgttgattaatttgtttggttttttaggatgtggatagtgttttttttatatttaggtattgtttttaaaataagtggaattttttcgtataattttgaatattaattttagggttttttaagtttattgttttcggtatacgttcgttttatttcgcgtttttttattttattttcgcgttttttttcgtttattttagtatgggatatttgttgttgggtttcgtaaatttatttatattaatttgggttttttaaattttatacgttgaattttaagttttttatgatatttagtagggttggaaggttggaatttttagagtatgaaaattgttttttatatttttttttaaattcggttattatatttagagtatgttgaatttttttttgaattataaacgatttgttttttgattgtttgagttttataaaatggagggatttttttagtgattttttaaagttattgagaatgttgtgggtgtgtgagttataaagttttggggtattaacgtttatggttttatatgttgtttggttacgaattaggttttttaagatgtagatagtgttatttaggtttttggagtatattgagtagttattaggaggtgtttaagtgtgatttaggattttttaggtttttttaaattatatagggtttttcgggtttttttgggttatattaagtataaaaggattttttgggtagagtttatttttatttttgttatgttaggtgttgttaacggttttagtttttaaatatttcgagtattttttttgtattataatatattgattattaaataattttttgggttttaggagttttataataagaattttgtttttttaaaatttaggtattggtttgaaattttaacggttaggattatattggattttttttttggttttttatatttggatgttttggacgttgttttttaggttttttaggaatatttagtattgttttcggattataggatagtattgattttttgggttttaaataatttattgagttattttaaagttaagtaatattttttttaagtatattgtatattttttattataaaatttgaaaatttttaagttttaagatttaggaattttgaattttttttttttaaaatgtatatatggatttttaagttttttaaggattttgagtaatttttttagatttttagatttaaaaacgatttttttggagtttttaaattgcggtattgttttttagttttttaaagtaaattgagatttttttttttttataaaataattgaggtttttttttttttaatattgatttatgagttttttgattttatggtttttgttttgggtttttttatatttagaaaatgttttatggatttttaaagtatattaaaaaatgtttttgggttttaagaaattttaggtatggaaaaatttgcgatttataagttttttagttattaattaggtttttagaaatttagatattaaatttttattgggtaatttttatgtgttttaaaaatttgaaatgtgttttattggggtttttttaaatgtagacgatatttaggaaaatatatagttttttttttatttattaaaaataagttaatggaaattatttaaaaattagtatagaaaaataatattgattttttatttttttattttttattttgttttttttaaatgtattgattatattttaggtttttttaaaatttagatagtgtttttttttatttttgaagggtgttaaaatttttttttgaagttatagtaattatgaaggttatttttttttcggttgttgttagcgtttaggttattaatttatatttttaagatgtgaaaattaattttagtttttttttaatatattaagaatgtgtttggatttttaaaatgtgttttttgtttttatttgttaattttacgtaatatggttttacggtaaaatttttaattttatatggagaattttttttaattatttttttttataaattggttttttaagttagttggtttttatttgagatttttttttttatgtttttaattgtatggagtaattttttttattttttaaatttgtaatttatttttttggagtttcgagtttagttattaattacggtttttatattaacggagttttcggggtttttttttttaggatatttattcgttaagttcgtaaggtagaaagaattttgttttgcgttttttaaaatttgggtattgttttcggttcgtcggttatttattgtagtttttttaatttcgcgtatagcgggtattggtttcgggtttttttgttttttacgaagtttttagagtaattcggatttgggaaatttttttttagcgttgtttaaatatatttgggtcggtcgcgcgtttttaggacgtggatagggagggttttttcgtgtttaggaaagcgatcgggtattgtttttagttttttttaaatttgggtattgttttcgggttttttaacggattgggcgttgttttcggatattgaggattggtttcggggtttcgtttatttttagtagcgtttatcgtttgttatagagcgttcgatcgttcgttgtttgagtttttggtgcgttcgcggacgtagtttttagtttcgcggtgagtttttcgtcgcgtcgatttttttcgtttttgcgtttttgatcggttttcggttcgtatttgttgttgtttcgtcggtgttggcgttcgttttcggttgtcgtcggggaggtcggcgtggggcgcgggatacggttgcggatttgcggttggcggttgcgttcgtttttgttgggcgtttcgaaattcgcgttattttcgtttgtttattgtaaagattttatttgtggggaaagcggttggagggttttaaagtggggcgggtagggggttggggcgagggacgcggaggagaggcgttttcgtcgggcggtaaagtgtttttagttcgcgggtttaggatttcgtcgggaggcgcgcgcggagcgcgggcgaagtgattgatggcggagcgaggggggcgaggggggttaggggggcgcgagatttcgtcggcggttttttttttttggttaggtttaggcggcggggggttggcggggtgcgggattttgtgcgtggtttttgatttggtaaaaattatagtgtttttttatatcgtttaaattttttaggagatggtttttttagatttttaaattatcgtggtggttttcgagatcgaattcgcgtttatgtaagtttaacgtattgaggacggggtaattattatttagatattttgggtgggtcgtaaaggcgagttatttagacgtatttcggtgagttcggttatgtaggtaggatttgagttgtgtttttcgttttgatttttttttttttggcggtcggagttttcgtaggttttaagtttggtttagattcggttcggcgtagtcggtttttcgcgcgtttcgtatttggcgggggtttcggggtttcggcgcggtatcggggggcgttcgggatttggttgaggttttaagcgtcgcgtggtcggttttttttgttggggtaggtggcggttgcgcgtttcgttcgagtttaggggtttttttagtcgtaataattagtaaggatttttcgatttagttttaagttatttgtatttgtatttagacggggcgtattcgtagtgtagttttttggtggggcgttgggagttcgtttgtttttgtttgttcggagattttagtttacgagtataggtcgttcgggtattttagaaattcgggatggggtttttgaattttttagaacgggtatttagtatggttttggcgttttgcggttttttgttttttatttagtttcgttttcgcgtattttttagtttttgcgatcgtcgtttttttttcggggttttagggtttttagttcgtatttttcgtttcgtttttggttcgggttgcgggggcgggtcgggggcggggcgagggtttcgcgggcgtttattggcgcgggcgcgaggttagcgaggttcgcgcgggttttgggtcgcgggttggcgcgattataagagtcgggcgtgggcgttcgtagttcgtttgtttttcggcggagttgcgtgaggttcggtcggtttcggtttttttttttcggtcgttttcgttttttggtttacgtttgttcgcgttttgtttattagcgtttttatcgggtaaggcggtttcgcgtcgacgtcgttcgttgtttcgttgttgattttcgtttcgggcgtcgttcgcggggtcgcgtttcgtcgggtttgcggatttttcgtcgttttttttttatttattttaattttttttattttcgtttcgttcgaggaggcggtttttttcgtaggtagttcggttcgtaggtcgtcggcgttgttattttttttcgcgttttttttttagtttttttttcggcgcgtagtttcgggtcgttttttttttcgcgttgcgtttcggagcggtttcggtgtcgttatcgtttgtttttttttcgaggttcgggttcgcgacggtagagggtttcgtcggtttaaatcgagttgggcgttcgcggttcgggtgtagtttttatttcgttttttagttatcgtttttttcggtttttcgacgtggcgttttttttttcgtttttttgtgtttttcgcgttttttttggcgtttggtttcggttttcgttttttttttcgtaatttttttttcgttttttttcgttttttttagtttttagttttcgatttttttttttttttacgttcgttttttcgttttcgtcgaattaaagtggattaattatacgttttttgttttttttcgtgttgttttttttcgttgtgcgtttgttcgtttttcgttgttttttttttttttcgtttttttttcggttttttttttttacgtttattttgttttttttattatttttgtttttttttatttttgatataatagttgattttatttttcgatattttttttttttcgaaaagtataatatttggttcgttttagttcgaagatagttcgttttttttggataattagacgaattttttttttttttttaaaaaaaagttattttttcgttttgtttcgtcgtatattcggttttcgcgattcggttagagcggcgttggtagaggagtgttcggtaggagggttaacgttcgttgttcggtttgcgatacgtagtagggaggtgggcggtagcgtcgtcggtttttaggtaagcggcgtgtgcgggtcgggtcggggtcggggttggggcggcgcgggtttgcgtcggacgttcggtttttttttcgttcgttttcggttcggggtttgcggggttcggcggggcggttgagttcgggggggaggaggaggaggaggaggaggacggacggttgcgggtttcgttttttgcgcggagtttcgcgtttattttggcggcggagttgggggtggggtgggggcgtcgggaagggtcgagggaggtgtgaggtgtttgtaggggcgatttttcggtcggtttgtgggtgtagggggtgtcgttttatatgtgtgattcgtgttttgcgggttttggttttcggggtgttgggtaacgaggaggggcgcggagtcgtagaagtttattttggtatgttgacgcggtgttagcgagatcgcgagaggaagacgggggtgggcggggttaggatggagaggggtcgagttggtaggagttatggtagacgttatattcgcgatattttttttatattttttttggttttgttcgtaatatttttaaataggagtttcgggagagggggagaggggttgttggtttgaggttaagaagggtagagttttcgattcggagagaggtcgcggtttttgtttagtgggtagcgtggaagtttttatataaggaggtgggaaggagattttttttttttttattgttttgtgtagagatgagtcgggggtgtaggatgggagtttatggtatttcgttacgggatggtttagggttttcggttgggggtgtaggagagaagagattggttgggaggagggagagggcgggagtaaaggcgcgggggagtggttagtagggagaggggtggggggtagggtggagttcgggttgggaggagtcggtttatatataaaagttgaggtattgattagtttgtaaattggatattagttttttttgtgaaagagatttttagtttttttttttttttttttttttttttttttttgttttagcgagttttttgttgagttgtaggtaattagggttgtggagtgaggattttcgttgttattttattttagtttgaggtagggtagtagggggtacggtttacgtttgggtttcgggttttgtagtcgttagttcgttgtttttcggatagtattttttttttttttttttttttgtttttgtttttatttggtttttgtttttttatttgttttttttttttttgtttttttttttcggttttttttttgtttagtttaggattttttttgggtttttatttgtttcgtatcgttgtatgttttttgttttgttttttgtcggttttttgattcggatttttaagtttagagtggtggggtttgttgcggaagcgcggcgagggttagagtggttagttggcggagtgtgtttttagaatttggaagggggtggtagagggggcggtgagaggattggttagggtttagttaaggagatgattaaggaggtttttagattttcggcgtagttgtttattagtttttagagagggtatgtaaagttgtgtttttgttttattgtttgtttagtcgtttatataatttattgtattaaaaatttttttgggtttgcggagcgaaggttggggttgttcgtttggagggttttattttttgtaggggtagggttaatttgttgtggtggttttcggttttttattttcgagtgggttaattcggttttgtggttttgtagtttgtggagggggtgtgttttaagattggtttttttttttagattgtagtttggggaatttggtgtcggattttttaggtggtttgagttggtttttttagtttttacggggagagtttggtagcgtaaatagggagatgttttggaggtttttggttttattggttcgatttgaggtttggaaaggaggttttgggcgtgtgtgtgtgtgtttgggggtatttaaggtagattggagttggagaattgggtgattgggaaaataaggtttttagagtatgggtggcgtggttgtgttaattattggagtttttgatttaggtttggtttagttgtagattggaaaggtggaaaagttagggggaggggcggggttggtttagtaggattggtttgttgttttgagggcgatggtttttttggattttttttgtttagttgggggttgtggggaggaagggattggtttttttggatgtatatgttttgtaggggtggggttgtttgttattttggttggcgttggaggtttgagaagtggcgatgtgacgttgggttggttttgtttttatggtgttataggacggaggttaggtcgggtgtttagtttgggtttttgtagttgtggatgtcgttgagtttttgtaataatgatcgtggagatggttatttttcgtgtaaaattattagtgttttttgtaaatggaaggaattgggttttttttgtgtgtttttggacgttttattttgtatatggttttgcgtttttatttcggtattatgatttgtgtgttatttttgtaataaaaataatgtttataggaaagtcgtgtttttaatttttaattgaatttgtaggttggtaaatttggtttgggaggggtatttttggtttggggtttggtttggttgtttcgtttacgttatttttttttcgtttttagatattaatgggaattttaatggggaagtcgatgttggtgttttttatttttttggttttcgtttcgtgttgtattgttgtttatcgttttagtgagattttgtgcggcggggagttggtggatattttttagttcgtttgtggggatcgcggtttttattttagtaagtagttgggaggggtttttttagatttggttaggtttttagagtgatcggtgaggacgtttaattttaagttaggggagtatatttttaggttagtagtttagtcgtttgttttgagattttgattttttcgtcgcgtttttgagtacgtgcggtgttttagggtatttatattagttgttttttttattatacgtttttttcgaagggtgggttagaggtgttttttagacgttaggggtatttataggggtttttttgggtattagaatttttgttgggggtcgtgaggtttttgtttttgaggtatcgtacgtttagtgtagggttttaggttttggaggaagagtttgtttttttttttgtattttttggatattttgataagggacgtgcgttcggtgaatgattagaattaaaattaataaagtgatttatataattaaaattaataagataagtgtagttggtgggtggtaggggtgagcggtgtatgcgtttttttgggttttaaggttgtcgtggggggtgtttatttgttgattttaaggacgttttagtttttttttatgttttttttttggttttttagtttgggggttggtaggtgggtgtatggtttattgtttttgagattttatttttagataggggggttgggtggatgtagaggtaggtatggtgtttgggtatgtttgatggggtaggggaggggtcgttttttattggtagaggtcgtacggtttattttatttgatatttattacgtgatatttttattattattgtttatttacgttgtgaaatgggtttataggatgtaaatgtattttaaagtttttttttgaaaagtttttgttgtttgattttggaagtttttgttcgttttggttttttttgtgtttttttttttgtttgttttatttgggggtaggaagtggtattgtagggtttggtgttagttagtttttgtttagggagaagtttttttgtattaggtttttttgagaggaggggagggttaagtttttatttgggggattttcgtgatggggtttttgttttttttttcggttgatggtatttgttttttggtattttaaggtggagtttttagcgattttttttttttagttgagtattgttgtgggggagagggggaagacgggaggaaagaagggagtggttttattacgtttttttattttttttttttcgttttttttttttttgtttttgtttttttgttttagtagttttaggggtggtgtgggtttttttagttttttaggtggtgttaggttagagtttaagtttagggatagtagttttttttgtgggggtttttgaattgggtttatattttatatattttttaaattatttttattgtgagtttttggttttggtggtgtttttttggttgtgggattaagagtttgtgtttattttttatttgaggaaggaggtagtagaggttacgggttggtttgggttttatttatttttttttttattttttttttttttgggacgtttttgtttgttagtttttattttttttttttgattcgtagggtggttgcgtttttttagggtttggtttgagggtaggggtggtttgttttttttttagttttcgggggttggggttagtgcggtgttaatacggttttttttgtgttgtgggatttttaggtaggttcgtaagtcgtgtgagtcgtcgtagtcgtggtatcgttgaggagtgttgttttcgtagttgtgatttggtttttttggagacgtattgtgttattttcgttaagttcgagagggacgtgtcgattttttcgatcgtgttttcggtgagggttttgggttttttttttattttttagagatagagaaatagggtttcgggcgtttagcgttttttgtggtttttgggattttttggttagggataaggattcgtgatttttttgtttgttgtgtggttcgggagtagtttagacgttggttttttttgtttttttgttcgtggatattagtttaagttattgattagttataggggtggtttgttaggttaggcgggcggtttaggcggaagagcgtggagagtaggtatttgttgattagttttttttttttttaggataatttttttagatatttcgtgggtaagtttttttaatatgatatttggaagtagtttatttagcgtttgcgtaggggtttgtttgtttttttgcgtgttcgtcggggttacgtgttcgttaaggagttcgaggcgtttagggaggttaaacgttatcgttttttgattgttttatttatttaagatttcgtttacgggggcgtttttttagagatggttagtaatcggaagtgagtaaaattgtcgtaagtttgtagttcggcgttattattttgtagtttttttttgattacggacgtttttattaggttttatttcgaaaatttttcggttttacgtttttttggggttttttttgatttagttttcgtgtttcgttttttcgaaataggttatttttttcggttttttttatcgggttgaggaagtatagtagtatttttaaatatgtataaaatcgattggttttaaatattttttatatattttttttttaaattatttttaattatttttatatataaaaaattaaaatattaaattaattttttttttttttttttataataatttttttaaaattaattggttttttagaaatattttataaaagtttagaaattggttttaaaaaaaataattattaaaaaaaattaattggttaaaaaaaaaaagtattaaaaacgaattggttgagaaataattggtaaaataaaggaatttggtattttttatttttttttttttttttttttttggattttgagttaaattggtttggatttgagtttttgaattagtaaagagaaaagaaggattttagaaattataggtgggtacgtcgttgttatcgttattttttt

SEQ ID NO: 59 - DNA, 16153 bp, Homo sapiens
ttttaggtttagtttttttttttttgatggtgtatttggttttttttgttgtttttttagtttttttggtatagagaggtgttttggggttaaggtagtttttttgggaatgtttatttatgtatgaagtttttttttgttgtattttggatttagattttttgatttatttagggtggtgtttgtggggagggggtttatttttttaggaagtatagttatgttgttttttattggttttgttaagtagagttgtgtgtttagtggtttttgttggggttttttttttatttttttttaaggtgggggtgtttggaggtggaggaggtttttatattttgtgttatgattttttaaggtgggttatttgtgtgtattttttatttttagtgttaggtagaagtttatttttatttaggaatagggtagtttgtttaatagaagggttttggtttttttattagtattgggaagttttttttaggtaaattttttattatttttttttttttttatattttgaaagagggagttttaggtaggggaggggttagagggggaagttgttgtttagattttgataaggtgatttgaaggaatttggggagggggatgggatagggtttaggtttggggtgtatggggaggggggttttgtttttaaaagaggttattttagtaatatttttttgtttttttttaggggttgaagagttattattgagtttgtgtgggaggaggtggattttagtttttagttttagggttttgaattgttgttagtttagttttttgtttagtttgttttatagtttgagttttagtaggttagagagtttagttttgaggtgagttgttgtggtttgtggtttaggtgattttagtgtttttagaattgaggttggtagttagttttagttttagttttaattgtgaggtagagaggtgagtgttttaggtattttgaggtttggtagagagggttataggttttgtgtgggagtttttgaattgggattttttttttttgtaagtagttttggtttagagaggttggtgtggatttagttatatagttgggatttggagttttgtggttggttttaggtgtttttgtttaggggttagagtaggtgtgggtagagtaggttttttgtagtttttatggtattgaggttttggtaggggagtttttgggagatgaaagagggtaaagaaggggagaggggtagggagagagtgggtagttaaaggggagaagatggggggtagaaagtgggtagagagggaaaaagggaaaatattattggggaagaatttaaaaatttaaggaaagttgggttttgttgggggttgtgagatttttgggttttttttgttttaggttgttggttatggggttttgtattaatggtttgatttttttgttggtttgtatttattaaagtgggtgatagttttaggttttttggttgtttagaattgaggtaataattagaggttttttgagtaaagggtttaaggggttttggtgttaggattttattgtggttaggagtttgtggggttttttgtgtgtaagaggggtgaaaggtggttagaaaggtttagttagtggtttttgttttagttagagggagttttgtagtgggggtagtatttatttattggttaggtattggggtgataggggaggttttaggatttggggagtgttggagttggaggtatatggattggagtttttgtatttgttttatgatagggtttgtagggagggatttagtaggtgattttttaggttgatttgtttattttagatagaagttgggagtgtttttttaaaggtgtttttattttagatatttaataaaatggtaatatagtggtgttgttttagttttttggagtgtgtattgtttgaattttttttttagggtttttttttaagtattttaatttggatttatattttttatgtatttttggttttgggtagattgagtagttttggggtggtttgtgttgtttggtgtggagggttgtagtttgggtttttagttttattttttaggttggttgggttgatgttagtgagtgtgtttttttttagtgaggggagtgagtgtaaggttagtgttttgtttgtggtgttttgtagggggtgatggaggggtgttttgaggatttttggagaaaggagttgggtttgtaaaatgttgggtttggttttatggatggtggagtggtgagtttagagttagagttggggaggaaatgggaatgagaaaggtttattttagggttggtgagtgaggggatggggagtagttataggttgaggttggggtatgggttaggttttatggggtgagtttgagtttttgaggggatgtttattttttgtggaatgtgggtttgttagtggagaggagattagtgttgttttggtgaggtgttggtttagggttggggggtggatgttgtttggggttaaagtttttgttggttaagttttgggtgggaggagattttggtttttttttaatatttttggattgttggtgggattttttttatttttgggggttggaagtagtgggggaggagttagttttgaggaagaattttgatgttggttttgattagaggggagttggtgtgttttttgagttttagggtgatttgtgtttgttttagtttttagtttgttttggttatttttgattaaataaggagagtatttagtaggtagttttatgagggagggggaatatgtgtgtatttttatttttttatttgtttttttttttttatagggttattatattttgttgtgggtattttaaggtgatttttagttttttttttattttaaaaagtttaggtatgtatttttaagtatgagtggtggttttttgggggaaggtattttggtagggtagaataaagggaagggatttttaaataggttattggtgtaattgtttttagtatttttaaagaggaggagaatttataatttggaattggggtttatttttgatgtttaatttgtttttagtttgggaagtaggtgtggaggagaaggtggggggagtttagagttggttttgggggttttggttttgtttatgatgggagttttggtaatttagtttgtttttttggggattaggtttgtagataggtattttttaaatgttttttatttttaaatttataagttattttgtagaggaaaatattaatatagttaggggttttttgttggaggtttttttttttataggtatagttggagaggttagagagttggggatatggggaggttgtagaaggttggtgggaaggggggtagtgatgggtggggagagatgggttagatgtttttggaatgggatatgggggtgattgatgtagatagaaatttgaaggggatatttttatgtgttttgttttgtgggtggaaaatgggttgttttttatggtgggggtgggttttttttgttttgttaagttaatgtgaaagagatgttttattttgtttagttttttatatttgtttaaggttattaatttttgtttttttagtgttaggttttgagatgttttttttttagttggggtttttttatggggtgataatggggataagtaatgtttattgtagttgttttaggattttttattattttgttggtttttagtggtgttttttttttggtagtatttttatttattttataggtttttttagggttattgttttattgtttgatattgtttaatgttaaggggtgattttgtttttgttgatagggttgttgggtgtttgtatgtgggtttaatatttgtttataaggaattgggttttttttagttggagtggatagattttttttgaaaatttgtttggagagaatgaaaagagatttttggtattttagtggtgtgtagttttgtatttttttttttttgggttttgtgttttttatttttttttttattttttttgttttttagtgttatttaaataaaattggttttatttttgtttggtgttggtgaaggtttgaatggtgtgtgtaaagttttggggtaggttggaggtggttattgggggtgttttgggtttttaagttaagttggggattagtttgtttttggtggtggtttggttgtggttttgtttaggtttgtagtgtggaggtgagtggggtgtagtggtgagggggagtttgtggattttttatgtggggattgagtaggtatttgggagttttgggagtgtttgggaagtagtgttttggttgtttttttgtggtttttgggttttttttttatatttggatgtttgttaagtttgggttgttgttataaatgtgttttttgtgtggagaaggtaaagaaaaaaaaaaataaaagtaaaaggaagaaaaattttaaagaatgaaaagtagaattttagttggttgtgtgtgttagggtgttttgtgttatttgtttgtgttgtttgtgtttgggtttttggggagggtgttagtgttttgtgtgtgttttagttaaggtgaatttttggtagtgttttttttttgttgtttgggaagtttgagtttaataattagtttttgatttttgggggattttaatttatggaataatttttttgttttttttgaatttggatattttattttttttgggattttttaaatttaagtattgttttttaagttttttaaatatatttattattttgatgggttataataatttttttggatgttaatttttggggatgttaaaatatattagttttggtgggtttttttagatttatattatgtggtttggggttttagatgtgtttttttttaggttttggatagttttatatattttttttaggttttatagatttataggttattaatttggtttttttaattttaaagatgaagtttttggtttgtggtggttgtgttgattaatttgtttggttttttaggatgtggatagtgttttttttatatttaggtattgtttttaaaataagtggaatttttttgtataattttgaatattaattttagggttttttaagtttattgtttttggtatatgtttgttttattttgtgtttttttattttatttttgtgtttttttttgtttattttagtatgggatatttgttgttgggttttgtaaatttatttatattaatttgggttttttaaattttatatgttgaattttaagttttttatgatatttagtagggttggaaggttggaatttttagagtatgaaaattgttttttatatttttttttaaatttggttattatatttagagtatgttgaatttttttttgaattataaatgatttgttttttgattgtttgagttttataaaatggagggatttttttagtgattttttaaagttattgagaatgttgtgggtgtgtgagttataaagttttggggtattaatgtttatggttttatatgttgtttggttatgaattaggttttttaagatgtagatagtgttatttaggtttttggagtatattgagtagttattaggaggtgtttaagtgtgatttaggattttttaggtttttttaaattatatagggttttttgggtttttttgggttatattaagtataaaaggattttttgggtagagtttatttttatttttgttatgttaggtgttgttaatggttttagtttttaaatattttgagtattttttttgtattataatatattgattattaaataattttttgggttttaggagttttataataagaattttgtttttttaaaatttaggtattggtttgaaattttaatggttaggattatattggattttttttttggttttttatatttggatgttttggatgttgttttttaggttttttaggaatatttagtattgtttttggattataggatagtattgattttttgggttttaaataatttattgagttattttaaagttaagtaatattttttttaagtatattgtatattttttattataaaatttgaaaatttttaagttttaagatttaggaattttgaattttttttttttaaaatgtatatatggatttttaagttttttaaggattttgagtaatttttttagatttttagatttaaaaatgatttttttggagtttttaaattgtggtattgttttttagttttttaaagtaaattgagatttttttttttttataaaataattgaggtttttttttttttaatattgatttatgagttttttgattttatggtttttgttttgggtttttttatatttagaaaatgttttatggatttttaaagtatattaaaaaatgtttttgggttttaagaaattttaggtatggaaaaatttgtgatttataagttttttagttattaattaggtttttagaaatttagatattaaatttttattgggtaatttttatgtgttttaaaaatttgaaatgtgttttattggggtttttttaaatgtagatgatatttaggaaaatatatagttttttttttatttattaaaaataagttaatggaaattatttaaaaattagtatagaaaaataatattgattttttatttttttattttttattttgttttttttaaatgtattgattatattttaggtttttttaaaatttagatagtgtttttttttatttttgaagggtgttaaaatttttttttgaagttatagtaattatgaaggttattttttttttggttgttgttagtgtttaggttattaatttatatttttaagatgtgaaaattaattttagtttttttttaatatattaagaatgtgtttggatttttaaaatgtgttttttgtttttatttgttaattttatgtaatatggttttatggtaaaatttttaattttatatggagaattttttttaattatttttttttataaattggttttttaagttagttggtttttatttgagatttttttttttatgtttttaattgtatggagtaattttttttattttttaaatttgtaatttatttttttggagttttgagtttagttattaattatggtttttatattaatggagtttttggggtttttttttttaggatatttatttgttaagtttgtaaggtagaaagaattttgttttgtgttttttaaaatttgggtattgtttttggtttgttggttatttattgtagtttttttaattttgtgtatagtgggtattggttttgggtttttttgttttttatgaagtttttagagtaatttggatttgggaaatttttttttagtgttgtttaaatatatttgggttggttgtgtgtttttaggatgtggatagggagggtttttttgtgtttaggaaagtgattgggtattgtttttagttttttttaaatttgggtattgtttttgggttttttaatggattgggtgttgtttttggatattgaggattggttttggggttttgtttatttttagtagtgtttattgtttgttatagagtgtttgattgtttgttgtttgagtttttggtgtgtttgtggatgtagtttttagttttgtggtgagttttttgttgtgttgattttttttgtttttgtgtttttgattggtttttggtttgtatttgttgttgttttgttggtgttggtgtttgtttttggttgttgttggggaggttggtgtggggtgtgggatatggttgtggatttgtggttggtggttgtgtttgtttttgttgggtgttttgaaatttgtgttatttttgtttgtttattgtaaagattttatttgtggggaaagtggttggagggttttaaagtggggtgggtagggggttggggtgagggatgtggaggagaggtgtttttgttgggtggtaaagtgtttttagtttgtgggtttaggattttgttgggaggtgtgtgtggagtgtgggtgaagtgattgatggtggagtgaggggggtgaggggggttaggggggtgtgagattttgttggtggttttttttttttggttaggtttaggtggtggggggttggtggggtgtgggattttgtgtgtggtttttgatttggtaaaaattatagtgtttttttatattgtttaaattttttaggagatggtttttttagatttttaaattattgtggtggtttttgagattgaatttgtgtttatgtaagtttaatgtattgaggatggggtaattattatttagatattttgggtgggttgtaaaggtgagttatttagatgtattttggtgagtttggttatgtaggtaggatttgagttgtgttttttgttttgatttttttttttttggtggttggagtttttgtaggttttaagtttggtttagatttggtttggtgtagttggttttttgtgtgttttgtatttggtgggggttttggggttttggtgtggtattggggggtgtttgggatttggttgaggttttaagtgttgtgtggttggttttttttgttggggtaggtggtggttgtgtgttttgtttgagtttaggggtttttttagttgtaataattagtaaggattttttgatttagttttaagttatttgtatttgtatttagatggggtgtatttgtagtgtagttttttggtggggtgttgggagtttgtttgtttttgtttgtttggagattttagtttatgagtataggttgtttgggtattttagaaatttgggatggggtttttgaattttttagaatgggtatttagtatggttttggtgttttgtggttttttgttttttatttagttttgtttttgtgtattttttagtttttgtgattgttgttttttttttggggttttagggtttttagtttgtattttttgttttgtttttggtttgggttgtgggggtgggttgggggtggggtgagggttttgtgggtgtttattggtgtgggtgtgaggttagtgaggtttgtgtgggttttgggttgtgggttggtgtgattataagagttgggtgtgggtgtttgtagtttgtttgttttttggtggagttgtgtgaggtttggttggttttggttttttttttttggttgtttttgttttttggtttatgtttgtttgtgttttgtttattagtgtttttattgggtaaggtggttttgtgttgatgttgtttgttgttttgttgttgatttttgttttgggtgttgtttgtggggttgtgttttgttgggtttgtggattttttgttgttttttttttatttattttaattttttttatttttgttttgtttgaggaggtggttttttttgtaggtagtttggtttgtaggttgttggtgttgttatttttttttgtgttttttttttagttttttttttggtgtgtagttttgggttgtttttttttttgtgttgtgttttggagtggttttggtgttgttattgtttgttttttttttgaggtttgggtttgtgatggtagagggttttgttggtttaaattgagttgggtgtttgtggtttgggtgtagtttttattttgttttttagttattgttttttttggttttttgatgtggtgtttttttttttgtttttttgtgttttttgtgttttttttggtgtttggttttggtttttgtttttttttttgtaattttttttttgtttttttttgttttttttagtttttagtttttgatttttttttttttttatgtttgtttttttgtttttgttgaattaaagtggattaattatatgttttttgtttttttttgtgttgtttttttttgttgtgtgtttgtttgttttttgttgtttttttttttttttgttttttttttggttttttttttttatgtttattttgttttttttattatttttgtttttttttatttttgatataatagttgattttattttttgatatttttttttttttgaaaagtataatatttggtttgttttagtttgaagatagtttgttttttttggataattagatgaattttttttttttttttaaaaaaaagttatttttttgttttgttttgttgtatatttggtttttgtgatttggttagagtggtgttggtagaggagtgtttggtaggagggttaatgtttgttgtttggtttgtgatatgtagtagggaggtgggtggtagtgttgttggtttttaggtaagtggtgtgtgtgggttgggttggggttggggttggggtggtgtgggtttgtgttggatgtttggttttttttttgtttgtttttggtttggggtttgtggggtttggtggggtggttgagtttgggggggaggaggaggaggaggaggaggatggatggttgtgggttttgttttttgtgtggagttttgtgtttattttggtggtggagttgggggtggggtgggggtgttgggaagggttgagggaggtgtgaggtgtttgtaggggtgattttttggttggtttgtgggtgtagggggtgttgttttatatgtgtgatttgtgttttgtgggttttggtttttggggtgttgggtaatgaggaggggtgtggagttgtagaagtttattttggtatgttgatgtggtgttagtgagattgtgagaggaagatgggggtgggtggggttaggatggagaggggttgagttggtaggagttatggtagatgttatatttgtgatattttttttatattttttttggttttgtttgtaatatttttaaataggagttttgggagagggggagaggggttgttggtttgaggttaagaagggtagagtttttgatttggagagaggttgtggtttttgtttagtgggtagtgtggaagtttttatataaggaggtgggaaggagattttttttttttttattgttttgtgtagagatgagttgggggtgtaggatgggagtttatggtattttgttatgggatggtttagggtttttggttgggggtgtaggagagaagagattggttgggaggagggagagggtgggagtaaaggtgtgggggagtggttagtagggagaggggtggggggtagggtggagtttgggttgggaggagttggtttatatataaaagttgaggtattgattagtttgtaaattggatattagttttttttgtgaaagagatttttagtttttttttttttttttttttttttttttttttgttttagtgagttttttgttgagttgtaggtaattagggttgtggagtgaggatttttgttgttattttattttagtttgaggtagggtagtagggggtatggtttatgtttgggttttgggttttgtagttgttagtttgttgttttttggatagtattttttttttttttttttttttgtttttgtttttatttggtttttgtttttttatttgttttttttttttttgttttttttttttggttttttttttgtttagtttaggattttttttgggtttttatttgttttgtattgttgtatgttttttgttttgttttttgttggttttttgatttggatttttaagtttagagtggtggggtttgttgtggaagtgtggtgagggttagagtggttagttggtggagtgtgtttttagaatttggaagggggtggtagagggggtggtgagaggattggttagggtttagttaaggagatgattaaggaggtttttagatttttggtgtagttgtttattagtttttagagagggtatgtaaagttgtgtttttgttttattgtttgtttagttgtttatataatttattgtattaaaaatttttttgggtttgtggagtgaaggttggggttgtttgtttggagggttttattttttgtaggggtagggttaatttgttgtggtggtttttggttttttatttttgagtgggttaatttggttttgtggttttgtagtttgtggagggggtgtgttttaagattggtttttttttttagattgtagtttggggaatttggtgttggattttttaggtggtttgagttggtttttttagtttttatggggagagtttggtagtgtaaatagggagatgttttggaggtttttggttttattggtttgatttgaggtttggaaaggaggttttgggtgtgtgtgtgtgtgtttgggggtatttaaggtagattggagttggagaattgggtgattgggaaaataaggtttttagagtatgggtggtgtggttgtgttaattattggagtttttgatttaggtttggtttagttgtagattggaaaggtggaaaagttagggggaggggtggggttggtttagtaggattggtttgttgttttgagggtgatggtttttttggattttttttgtttagttgggggttgtggggaggaagggattggtttttttggatgtatatgttttgtaggggtggggttgtttgttattttggttggtgttggaggtttgagaagtggtgatgtgatgttgggttggttttgtttttatggtgttataggatggaggttaggttgggtgtttagtttgggtttttgtagttgtggatgttgttgagtttttgtaataatgattgtggagatggttattttttgtgtaaaattattagtgttttttgtaaatggaaggaattgggttttttttgtgtgtttttggatgttttattttgtatatggttttgtgtttttattttggtattatgatttgtgtgttatttttgtaataaaaataatgtttataggaaagttgtgtttttaatttttaattgaatttgtaggttggtaaatttggtttgggaggggtatttttggtttggggtttggtttggttgttttgtttatgttattttttttttgtttttagatattaatgggaattttaatggggaagttgatgttggtgttttttatttttttggtttttgttttgtgttgtattgttgtttattgttttagtgagattttgtgtggtggggagttggtggatattttttagtttgtttgtggggattgtggtttttattttagtaagtagttgggaggggtttttttagatttggttaggtttttagagtgattggtgaggatgtttaattttaagttaggggagtatatttttaggttagtagtttagttgtttgttttgagattttgatttttttgttgtgtttttgagtatgtgtggtgttttagggtatttatattagttgttttttttattatatgttttttttgaagggtgggttagaggtgttttttagatgttaggggtatttataggggtttttttgggtattagaatttttgttgggggttgtgaggtttttgtttttgaggtattgtatgtttagtgtagggttttaggttttggaggaagagtttgtttttttttttgtattttttggatattttgataagggatgtgtgtttggtgaatgattagaattaaaattaataaagtgatttatataattaaaattaataagataagtgtagttggtgggtggtaggggtgagtggtgtatgtgtttttttgggttttaaggttgttgtggggggtgtttatttgttgattttaaggatgttttagtttttttttatgttttttttttggttttttagtttgggggttggtaggtgggtgtatggtttattgtttttgagattttatttttagataggggggttgggtggatgtagaggtaggtatggtgtttgggtatgtttgatggggtaggggaggggttgttttttattggtagaggttgtatggtttattttatttgatatttattatgtgatatttttattattattgtttatttatgttgtgaaatgggtttataggatgtaaatgtattttaaagtttttttttgaaaagtttttgttgtttgattttggaagtttttgtttgttttggttttttttgtgtttttttttttgtttgttttatttgggggtaggaagtggtattgtagggtttggtgttagttagtttttgtttagggagaagtttttttgtattaggtttttttgagaggaggggagggttaagtttttatttgggggatttttgtgatggggtttttgtttttttttttggttgatggtatttgttttttggtattttaaggtggagtttttagtgattttttttttttagttgagtattgttgtgggggagagggggaagatgggaggaaagaagggagtggttttattatgtttttttatttttttttttttgttttttttttttttgtttttgtttttttgttttagtagttttaggggtggtgtgggtttttttagttttttaggtggtgttaggttagagtttaagtttagggatagtagttttttttgtgggggtttttgaattgggtttatattttatatattttttaaattatttttattgtgagtttttggttttggtggtgtttttttggttgtgggattaagagtttgtgtttattttttatttgaggaaggaggtagtagaggttatgggttggtttgggttttatttatttttttttttattttttttttttttgggatgtttttgtttgttagtttttattttttttttttgatttgtagggtggttgtgtttttttagggtttggtttgagggtaggggtggtttgttttttttttagtttttgggggttggggttagtgtggtgttaatatggttttttttgtgttgtgggatttttaggtaggtttgtaagttgtgtgagttgttgtagttgtggtattgttgaggagtgttgtttttgtagttgtgatttggtttttttggagatgtattgtgttatttttgttaagtttgagagggatgtgttgatttttttgattgtgtttttggtgagggttttgggttttttttttattttttagagatagagaaatagggttttgggtgtttagtgttttttgtggtttttgggattttttggttagggataaggatttgtgatttttttgtttgttgtgtggtttgggagtagtttagatgttggttttttttgtttttttgtttgtggatattagtttaagttattgattagttataggggtggtttgttaggttaggtgggtggtttaggtggaagagtgtggagagtaggtatttgttgattagttttttttttttttaggataatttttttagatattttgtgggtaagtttttttaatatgatatttggaagtagtttatttagtgtttgtgtaggggtttgtttgtttttttgtgtgtttgttggggttatgtgtttgttaaggagtttgaggtgtttagggaggttaaatgttattgttttttgattgttttatttatttaagattttgtttatgggggtgtttttttagagatggttagtaattggaagtgagtaaaattgttgtaagtttgtagtttggtgttattattttgtagtttttttttgattatggatgtttttattaggttttattttgaaaattttttggttttatgtttttttggggttttttttgatttagtttttgtgttttgtttttttgaaataggttattttttttggttttttttattgggttgaggaagtatagtagtatttttaaatatgtataaaattgattggttttaaatattttttatatattttttttttaaattatttttaattatttttatatataaaaaattaaaatattaaattaattttttttttttttttttataataatttttttaaaattaattggttttttagaaatattttataaaagtttagaaattggttttaaaaaaaataattattaaaaaaaattaattggttaaaaaaaaaaagtattaaaaatgaattggttgagaaataattggtaaaataaaggaatttggtattttttatttttttttttttttttttttttggattttgagttaaattggtttggatttgagtttttgaattagtaaagagaaaagaaggattttagaaattataggtgggtatgttgttgttattgttattttttt

SEQ ID NO: 60 - DNA, 81992 bp, Homo sapiens
gtaggaggattgtttgaggttagaaggtgaaggttgtagtgaatcgagattgtgttattgtattgtagtttgggtgatagagtgggattttgttttaaaaagaattggtttggaataatatttaaataatatttaaattttttgttttggtttataagatttgaatatttggtttttgttttttttttagtttatagtatcggttttaggatttttgtatttgttatttttgttttttagaaagttttgttttttttttatttttgtagttataggtgttttttgttatttagagttttagtttaaatatgatatttttttattgatggaaattattttattattagacgttatgtggtttattgtttattcgttgtttgtttttcggttggagaggcgtagggagttgtttgttttttttgtttagagttatcgtttcgtatttggattatcgtttggtagaggcgggagtggaggttgttattattaggatgaaggataggggtggttcggcgtggagaagttaagaagagatggcgataggttaacgcgattgcgtttttaaggtggaagaaacgaagggcgagggttagtaaagttaaggacgggtttagatttcgttattggtgataagcgggatttataggatcgacgtgatcgcggttaggttttgggtggtttatttggatttttatttggttgttttttttttgtattttttcgtttttatttttttagttatcggtataggttaagttagagtgttgaagaaatatacgagtttggttttggaaaggaaaattagaaaggcggtttaaggggttttatttttaggaacgttaagataggcggttaggggtgagcgggtagggtcggttagtaggttttgaaagtagtcgggttattagcgcgtttcgagtttttttcgtatcgtttcgtttgtttcgtttttgttttttgttttcgtttttgtttcgttttcgaaggcgagttgcgttgatagtcggcggcgggttgggtgtttgtaatataaaggcggttacgcgcggcgtcgttcggtgagtagtcgtcgtttttagtttttcgttgtggagtaggggtcgtagtttcgggttaggcggggcggggcgcggcgtcggggcgttgaggacgcgtggcgaggcgggggttcggtttcggggttcgaggatcgacggtcgggttacgttttcggggttttttacgggaagtggttcgggggagggaggcggggaaataggtttcggaggtcgggagggtttcgcgagtatttttcgggtttggtttttttgacgcgtcgcgaggttcggtgtgggttcggtttggttgatttcgagcggcgtaggggttattgggggttgtcgcgtagttttagaatcgcggggattagttttagtcggttagcgcgggtgcgttttggttttgcgcgattatttttagttttgcgtcggggattgggatgagagtttttttttttttcggagttaggattttagcgttgtagttgaggaaattgaggtttagggaggttgatttttgtgtttaaggttatatagttgtcgggcggtagggtaggttgagtttaggttggaatttcggtttttatattatagtttttttttgcgaggtttttgtattttttttgtagtttaggaggtgttaggtttagtgagtttcgttagttgtttttgtacgtaattttattatgggtaaggttaggaaaatgtaggatgagaagtaacgttttgggagtaatttaagtgttgtggagttagagtaggtaatttgtgtggttagtagttgttggagaaagtagatgttaattttgtttttgattagtaagtaggaaattaattaagataattggtagtattaatttggagatgttttagaattcggtagttttttataggatagaagtgttttgggaaattaaagtttgtagtcgtttttttaattgggggtgttgtggtatggtggtttaggggtagtgattgtgagattgattgtttattttttgtttcgtaatttgggttttattaatgaaagtaagtagttgaggaatgtatagtatttgagaaataagtatatttatatatgaatattttttttgtttttagatttttgttgaaaggtgtaatagttggatttatgattatatattttgatagtattttacgtttgttagtatttgttattgagtgtttttgtgtatgggttgtgtgttttggcgtttattatttttatttgtatgtggggttttgtggttttgtggagttaggtttggatatagttttggattcgggtcgggaggtttgggttttgtttgagttttgtgggattttgagcgagtttttttatttatttaggtttcgtttattagtagttttttttttttagaaaagtatagggggataaggggcggatttgttgagttttgtggtgtgggagagaacgcgagggtttaggtgagagatcgtagggatttttggttgtaggggggattttggaagtgattgagaaggagtttgttttggattaggtggggataattggtttggtttagttagaaggaagtttgtgggttttgtttttttgttttttgcgtggttagttgtataaagggtttagaatagacggtaggggagggttaggagatgaaaagatattttagaagaaggttttgaggttatcgtggtttgagatgcgtcgaggtcggtatagagtattgggttttgtagttgttgttttgattatttatagatgtagaatttgggtagaagattttaattttttgagttttagtttttttatttgtaaaatgaagggataattatatttatttataggattgttgtaaaaattaattgagataaaaaagagtttttggaatataatatggggtttacgaattattgtggttgttatgattttaaagtgttatagggtgttagcgaggaggggttttttgtggggttgggatagttttggttgacgtcggtttttgttttgtaaattatttttgtgggatattttttttttttgtttgttatttttttttcggttggttttttcggattatttgtgtattgggtttaaggtttaaaaggtatttaaatgaggttaattgatttgggtaagtttgttaatgggggtagtcgaggggtataggtagttttttttttagggtgggagggggttgttgtacggatgtcggtagtttttggagtattttgagagatatttaggtgttaggtttcgttaggatatcgaggttggtggttcgatttgtttgtatttgtatttttttattggtagttcgggcgtgggattttggagtttttgaggggttttgaggaggaagtttttggaattatttattagtagttttggggtttgttttttgagaagggtaaagttataattttgatattttattgaattttggattaatgtattgtataataagtttatttatttaaaattggaacggggtgtgtggggaaaaaagagttgggataaaatttaagtaaagtcgtttagtgacgttataggttttttatttagaagaggtttaggtgtttatcggatggttgtttttgaaatgttcgttttttgagttgtgagggagggtttggagagagagaggggtttatgtttgtgtgtcgaggggatatatttatattggttttgttttttgattagaggatgtattagcgtttgaagggaatttgtgttttttaggaggttatattgggttttggggttgttggggttcgaagtaagtgttttgatttttttttttgtgggttttttttttttttttttttttatagtttttttttgtttgtttttttatttgtaatttattttaataagtttttagtagttggggttggggtggggtttgtgtagttagggatatgttgagtagtgagtttttgtttgtagaaagttttgggtttgggttgatttagatttaggttgatattttttataatgaggtatgtggtttaggagttttaaaattttagtagtgtttggtttataggttgttttgtatattgagggatgtagggcgcgttgtgtcgtttttatttttagttgagaggttgggaggaattagatggattgggttttattaggagagaagttagaagtatttttatatcggtggttatggttatagggttatggttatagtggattttttaatttattgattaaatgttgtgatttttgtaataatttaaaattttcggttgatgttgaatgttggggttttttagaaatagttataggttgttagaataggtattttgttttgtaaggaggtttgtttgtttttgagtgtgagttgatttgtattggtttataaagttgattatagattttgtatgggagatataattaatatttttatttgtttgttggtacgtatttgtgtttttttttttttttcggtttcgttttttggaagttttcgtatttttttttttgttttttgttttttagttatatatatttattttttgatgaagtcgtttttcgcgtttatggattttattaggttgtaggtttttagtttataagataggagataagtaataagggttttaggataatgggtattagataagataggcgtttagataattgttttggtaaaataatgttttattattggattttgtgtaatgttagaatgttattagtttcggggtggtttttttgggtttagattttgggtaaatgagaatgtggaatgtaggtatagtttttaaatagttttgtatttattttaattagtaatattttttgtttttgtttttttgggaaggtattatttaaataggtgatatatataaagttttttttggtaagagacgttatttaaagatcggattttgtttggaattagtttgtggttatagaattagtacgtggtttttatttggtgtatgtgttttgaaaagtattttatatttattgttttataatagttttatgaggtggttgtgttgatgttatttttttttataaaatagatgcgaaattgtagtgtagagagtttagtaatttgtttttgattatagagttagtggaaggtggaggtaggatttgaatatttttagagtttgcgtttttatttgttgagttatattgttttttaatagtgttttggaatatttaggtgatatatgtttattttttaattgttggggtgtggtaggggtggggggtaatatagaaataaagttataagggtagagtattttttttgattaagatacgaatttggatagagggtttttgaaagtgcgtagagagaatgtgttattgggtttttgaaggaaaagaacgttttgtttttaattagtgagttaaataattaagagttaaaggatcggagttaaagttttgggttgttttgtttagtatagttgttatattatatttagatgtttatatttatttttatttaggttatttgtattttttggtaggaacgtgagaataagcgttatttggggttgtggtatttgagggttgtaaagtgttagcgttggaggagttgagtgattatttatttgattttttttttaaagtaggagtatttttgtttagtattttgttttgttttagtggttttagtgatggagattttgagattgagtggattagagttttttattttttatttttagttttttgaggttattaataattgatatgaaatatatgtagatataaaaaatataagttagaaagtaatattatgggaagtatttatgataaaaagtgaagattttttttttttttttttaggttggtttttaggggtgaattttgtgaattttgttttgtatgtattttattttagaatttttttatgtatattaaaatatgtataaatgtaattttttaaaaatgggtttagttgggcgcggtggtttacgtttgtaattttagtattttcggaggtcgagatgggtggattacgaggttaggagattaagattattttggttaatatggtgaaatttcgtttttattaaaaatataaaaaaattagttaggttggtggtaggcgtttgtagttttagttattcgggaggttgaggtaggagattggcgtgaatttgggaggcggagtttgtagtgagtcgagattgcgttattgttttttagtttgagtaatatagcgaaatttcgttttaaaataaaataaaataaataaataaaaaattataatgggtttatattataagtatttttgtatttgtttttattttatatatatatttttatgttaatatttatggagttatttttttattattttattattagttttataatattttattttataatgtggatggtttataatttattaagttagagttatatagatattaagttatttttgattttttttattataattaatgttatagttattgtttttgtatacggattttattgtatttgtataattagtttttagcggtatagttgttagggtttgttaataggtgttttaaaagatgggtattgttatattgtttattttatttatgattttgttagtagtgagtgacgatgtttgatttttttattttttatgggttttggggttttaatgaaatgttttgattttggattatttgaaaggtttttttcgatttttgtatttttaattatgaatggggttgaatattttttttatatattattggttaaatgtgaattgtttatatgttttgtttatttttttttttgagttgttttaaggttattttttttttttttttgagacggagtttcgttttgtcgtttaggttggagtgtagtggcgggatttcggtttattgtaagtttcgtttttcgggtttacgttatttttttgttttagttttttaagtagttgggattataggcgttcgttattacgttcggttaattttttgtatttttagtagagacggggttttatcgttttagtcgggatggtttcgattttttgatttcgtgattcgttcgtttcggttttttaaagtgttgggattataggcgtgagttatcgcgttcggtttttaaggttattttaaattgattttaattttttagaggtggttggtgttggtaaaaattgtggggttaggaaagttgtggtaggggttttgaattttggtagttttaagaaagtagcgttttttggtaatttgtgaagtttggagatggattttgttaattttggaataaatgtggaattttttaatttaatcgtgaggtaagaaattatgtgatttttgttattttattttgatagtgttcgtagtgttgttttttttggaattgtatgaaattgcggtcgtgaatgttttggagcgtttgttgtgtgttggagttttatagatgagtttaattatgggaacgtttttttgtttttgggtaaggagggggatgagtagggtgggggtgtgttggaggaggagacgtttgttattttgttattttggaagtttattgtaagagttgtaaaattttttatttgtttaatataggtagggttttggtggcgggattttagggttggttgtttttgtttttttattatttttgttaggaagtattgaaagatttttaaaaggtttttgatttgtagggtttttgatttgtaggttttttaaagtatttttagtttttttagtgagtttttgtattttggacgggaatgttttacgaattttggtatgttaagaaagtttttaattttttagtaggtagtgatggatgtagagttgtgtttttttgtttaagaagttttttaaggtattttggttaggatagtttaattatagggacgttggtggatttagttaatttagatttggtagagggtagtagttgtttataagtgtgtgttagttatagtagggcgtgggttgttgtttaggtggtttgattttttgtttgtgtttttttttttgtattattttgagtttgagttagatttttttttttgttataggtaatttattatttttattaatcgtcgttaagtattagtttataatgttttgaaaagattttttttttgtcgtaagtgtaaattataggaggaagttaatattatttataaattaattttatttttatgtaagttttattagttatgatattattttgggtattttttagaagttttttgtgtttttaaatgttttggatgaaaatttttatttgttttgtaaatttttaaggtggatgtgatttcggcgaatattagtaatagcgtgatgtttgtgattttatttagtgttgggcggattatagatagagtttttaggtgttgagatattgattgtagtgtgtttagaggagggcggttagggtagtgagtaggaagttttaaaatcgtttttgttaagtttagttggggagtcgatagtgttttttttagaggaagggtgttaggggtggttatttagttgttttgatatgattcgttggttttacgagtagtagttaggtttgtatttgagagttgtaattttttgttgataataggaatatagataaggggtattttattttagagtgatattaggttggtttttgaattattaggttttttggatgtgttttaagtttataggtgttttttaagtatttgtcgtgagggtagatgtgatagatcgtgtttgttttttgggtagtgagtgggttttgggtagtttttttttaggaaatgatgaattattcggagttgagtaagtgttagagaagtttttaattatagattgaatttaggagggtgtttcggtttttttaagtttttaagggttgtagggaaggttttgaataatggtttttgattttattttttgagaggttttgttagggagtggtgatgttgcgggtgagagtagttttgaaggtgttatatttagggttaattttgagttttgtttttgtagttattttttatgggaggttatgataataataagattttgtatgtgttgtttaggagtaaagatttttttaaattagtcgttgtgttgattattgaggatgatagtttggtgggtttagttagagttattgtgttaatattttgtttttatatatatagttggtaaatgttagaagttaatatttatagttaggtttttcgatttttaattttgtgttatttttgttttttagttttatttttaggtgttatagttgtttatttaaattgtttgtagtgaattttgtttgggagtattgttttgtgaaatttatgttttggtagagaataatttttgttgttttttttattttttttaatttttttttttttttttgagacggagttatttaggttggagtgtagtggtacgatttcggtttattgtaagttttgtttttcgggtttacgttatttttttgttttagttttttaagtagttgggattataggcgttcgttattatgttcggttaattttttttgtatttttagtagagacggggttttattatgttagttaggatggtttcgattttttgatttcgtgattcgttcgttttagttttttaaagtgttgggattataggtatgagttatcgcgttcggttatttttttttatttttaaattttagtgtttttttttttcgtgtttcgatttgttaagttattttgagggtggtgggtgtattttgttgttttatattttggaatgtcgtgatgggattaaaaataaaagttttttgtttgagatgggttttgcgatggggtaggtatcgcgttagaaatgagtaagtttcgtttttgtttttaaggagagaagatttatttggtagatagatgtttgtttagttatttgataaatgatagtaatattgattaagttattgttttggatggttgggttggagggttgaggagaaggttgaggttgaaagatagagttgtgtgggtatgtttatgaaggggttatatatttggatagtcgggggaggaaatggaggaggtaggtggaaatttagatttgaggggtaattattgtttaatttttgtaagatatttagtttttttttttttttttttgagatagagtttcgttttgtcgtttaagttggagtttagtggcgtcgtttcggtttattgtaagttgcgttttttgggtttaagcgatttttttgttttagttttttgagtagttgggattataggtgcgtgttattgtgtttggtttattttttgtatttttagtagagacgtggttttatcgtgttagttaggatgatttcggttttttgattttatgatttgttcgttttggttttttaaagtgttgggattataggtataagttattacgtttggttatttagtttttaaagaaaggagagtaggaagaaaagtataagtgagaaagatgaataaaaacggggattgtaagagtatatttattgagatagttttgtatttgtatttgttcggttagttttatatataattagatgttgtttattatgatattattttatttttaaggagtaaatttataatgtgaaaatggatttattgttatgttttagataacgtgttttaggtaatgttttagttgaaggaattagaaagggaattaaaattattgttatttatttgtataataaatgagtggaatagtagatttttgaattgtttattaagaggcgtggattaaaataatttaaatttttttatttatttatttattttatatttttttgagatggagttttattttgtcgtttaggttggagtataatgacgtgattttagtttattgtaatttttgttttttgggtttaagtaatttttttgttttagtttttcgagtagttgggattataggtatttattattatgttaatttttgtatttttgtagagatggggtattttgtagagagtttgattatgttggttaggttggtttcgaatttttgattttaggtgattcgttttttttggtttattaaagtgttggtattataggcgtgagtgttcggtttttatatttatttttaataatcgatgttgttcgagttgagtatgttatttattattaatgttataggtagaattttaagtggaatacgtttgtagatttttatgttttttggtgtattatttgtttggttttaatataaaatagtttttaatttagaggtatttggaaagatggtattttagtgggatgtaataattttagaaaatttgtattattttagaaggttaagttagacgatgttatattgaaaaaatttatatgttttttaattttagagtttttttgaaaatttatagttagagaaatttagttttgttaaaggatatttgtaagatttggttgagttttttattaaaaatatttgaattaggggttgtagagttttgttttaagtggtaaataaaatttcgtgaggtgaagttgttattttttgttaaattttgagattaaagttagtaggtttgaaaggaatttggtatggggtgagtgaatagtaggtatttgaaagtcgttttattggaaattgaagttttttatttggttttttgtaggttttgtttatcgtttgttatttttgaggtaattaagatatttttttttttaaagtagatattttttttattgtttgattacgtgttttagtagatagtaggaaattgatattaaagatagttatgagattaatgggtaggtatggggaggtgggttgattggttgggtttgtttgatttttttaggtaaattagtttttttttttagttttttattcgaaatataattgagagtaaaatttgggaatttatgtttagttggtttatttttgtattttttaaatatatgtgttagatttattttaaagagagtttggaggaagggtagagaaagaagagtttggttgtttttaatttgtttgtatttttttaggtaataggtgtttggggtgattgggtttatttcggttttttaaagggtatggtttttttcgtgttttttgggggagggattgttttttttattttaagtttttttttaaagaaattgtttaattaaatagtattttggttttttgaaatgagttttggttaatataattttttttttttttaatttttaaaaaaaaaaagttaattgtgataaaatatatataatataaaatttgttattttaattatttttaagtgtgtggtttagtggtaaaatggaaattttgtatttattaaatatatattgattttttatttttcgtttttttttagtttttggtaattagtttttttgtttttatgagtttgtttgtttaaggtagtttatgtaagtagagttatatagtatttgtttttttgtgattggtttattttatttagtttattgtttttaaggtttatttatatagtagtatgtattagaattttttttttttttaaggtttagtaatagtttatgatatggatggatcgtattttgtttttttatttatttgttatattggagttgttgtttttttttggttattatgaataatgttgttacgattatgggtgtgttaatattttttcgagatttgtttttagtttttttttttgatatatattcgggattggaatggttggattataagttaattttatttttatttttttgaggaatttagattattttttgaagtggttttatattttatattttcgttaatagtggataagagttttagtttttttatatttttgttaatatttgttatattttgttttttttttttttaaatagtagttattttaatagatgtgaggtggtggtatttatttttttaaaaatttttagtgtttagtttaaggtaggtttagggtgtagatgttgagtttttaggaatagataaaagattgttaggtggagtttatgattttgttatttgttgagaattattgagaagattttttgtttttaaatttaggtatttttagatttgtaaagaagttatttaatagaggggatagttaaagatattaaagtattattaatttaagttaaagttatagttgatattaaagtattttttgattttttgcggtaggaaaatattttagattaatttagtgggaaggttatagaagaaattgtagttttggttttgtttttgttatggggggagtttcgttaagttattttttgtttttgggtttatttttaaaaaatgaggttgttggaataataattaaggattttttagttgagaataagagagtagagtaacgatttagttattaaagatgtttttttagttgttaagaattaaggagtggagtttttgttttggaacggatagagttggaattagattttgtaggttatttaggttaatgcgttttttttatagaggagaggttaggatgtagagatgtggtaatgttatttagttatgagttagttagtttgtttttttttttttttttttttttttttttttttttttttttttttttttttttttttttttttttttttttttttttttttttttatttttgggtgttttttgtagagggggatttggtagggttataggataatagtggagggaaggttagtagataaataagtgaataaaggtttttggtttttttaggtagaggattttggggtttttcgtagtgtttgtgtttttgggtatttgagattagggagtggtgatgatttttaacgagtttgttgtttttaagtatttgtttaataaagtatattttgtatcgtttttaatttatttaattttgagtggatatagtatatgttttatggagtatcgggttgggggtaaggttatagattaatagtattttaaggtagaagaattttttttagtatagaataaaatggagttttttatgtttatttttttttatatagatatagtaattatttgatttttttattttttttttatattttttttttttttattcgataaaatcgttattgttattatggttcgtttttaatgagttgttgggtatattttttagacggggtggcggtcgggtagaggggttttttattttttagaaggggcggttgggtagaggcgttttttatttttttttcggacggggcggttggtcgggcgggggttgattttttatttttttttcggacggggcggttggtcgggcgggggttgttttttatttttttttcggacggggtggttgtcgggcggagacgttttttattttttagacggggcggttgtcgggcggaggggttttttattttttagacggggtggttgtcgggcggaggggttttttattttttagacggggcggtcgggtagagacgttttttattttttagacggggtcgcggtcgggtagaggcgttttttatattttagacggggcggcggggtagaggcgttttttatattttagacgatgggcggtcgggtagagatgttttttattttttagacgggatggcggtcgggaagaggtattttttattttttagattgggggtagtcgggtagaggggttttttatattttagacgatgggcggttaggtagagatgttttttattttttagatggggtggtagtcgggtagaggttgtaatttcggtattttgggaggttaaggtaggcggttgggaggtggaggttgtagcgagtcgagattacgttattgtattttagtttgggtaatattgagtattgagtgaacgagattttatttgtaatttcggtattttaggaggtcgaggttggtagattattttcgattaggagttggagattagttcggttaatatagtgaaatttcgtttttattaaaaaatacgaaaattagttaggcgtggcggcgtacgtttgtaatcgtaggtattcggtaggttgaggtaggagaattaggtagggaggttgtagtgagtcgagatggcggtagtgtagtttagtttcggttcggtattagagggagatcgtggaaagagggatagggagacggtggggagagggagattatggggagggggagggggaggtttttgttaatgttgtttttatgtttttcgtttttttttttttgtgagtaaaaaaatattaatagtagttcgtagatgtgttggtttggggttggggttttattgttggggaggtggttttattattcggtgataaatatagtttacgtgtaagggtgatgaaggtaaagagatgggggggatatgagaaggagttttatagaatcgaaagagaggttattttaaaatttaaagatttgggttttagtttggtgaaatggggcgtgttaatttagagagtttttttttattagttttgtgatttttattgtattttggttgttttttggttttattatttgaaaggttgtatttttatagggttttgtgatagttagtatgagataacgtatatgaaagaaattgtataaagatgttattaatattgtttgtacgtagttttagagttagagggttattttttttattaaatatacgttaaaatttaagtttaacgtggaaggaataagaagtattagggttataaagaattattttttatattgtatatttttttaggaattattttattgtattttttttgtatgaagttaaatttgtattatttgtaaatttagaaaaatgtgtgttttgatgtttatatatatgtgatgtattagtaggatagattaagggggagttgggttttggtgtttatttttaggtgaaaaggaaggtagatgtgtgtttttttttgagtgtgtttattaagggttgggtttgttttttcggttgagagaggaggtgtattagtatagagagttttatttaaaattgtaaaatgaatttgggagggttttttgtattttttgtaggtattatttatgatttttggttttttggtttgttttaaattagaattaaattcgtagtttttattagtttttgtatgtaggggatttgattatttttgagttttatttgtaaatgggtgtgttgattttatttttgtttattttataggggttgaggtaagatttataaaaggtatattttgtttttttaatttgaaagattaaggttttatttttggttttaagaatgtagtttataaaagaataaataaattatataattttttttatttttatatacgtttttgatattaaacgtgtgtgtgttttttgtacgttaagtagttttttagttttcggagtatattaattgggtgtttataatttaatttaattttgatattatttatttggagttagtattagattttataggttaagggttcgtttttataagttgttttttattttagatgttagttatagtttgggttttttgtgtttttgtttgattggttataaatcgggggtttttatgatttttttttcgcgtttatttttttgtggatcggtttacggaatttagggaaatagtttattgattgttattggtttattataaaggatgtaatttcggagtagttagatggaagggtgtatagggtaaggcggtggaggcggcggtggtgtttttatgttttttttagtattttagttttttagtattgttacgcgtttattaatttggaagttttttgagtttttttttttcgggttttatggaggttttattataaaggcgagattgattaatttatcggttattgattatatttaattttttttttttttttttttttggaggttgggggtggggtggtgggtgggtggggagtggttgaaggtattaatttttattatagatttgtttttttggtagttgtggtttagtttttatttttcgagagttttttgattaaattttggtgtgggtgaagagggtttattatgaatgatagaagatattttttttatttttattgttttggagttaaggagttattttaggagtaggggaggaaaatgaaatattataataaaagatatttttattattttgattatttagaaattataaggggtttaggagttttggtttggatttggggatgaagattaaaatatatattttttattatattataatattatagcgttattgaatgataggaaaagtttttagaattaatttttttatatagtaggtttgtgagttataggtttatatacgtggtgttttttggagtttgtaggtgatttgaggtgggggttttgttagtgtggttatatgtgttttgggatagttgttttgaagaatgggagtagtgtggattaggaggaggggtgaagtttcggggtggattggaagttacgttatgtaaattttttttgtttgggtagtatttgtaattacgtggttttacgagttcgttaaattattaggtgaataaacgggagaggagaagagagtttaggatttagttttggagtataagttagagttggaaaagaagaggttttagagattggacggttattgagaggtgttacgtttttgaagggtttgaggagggttgatggtatgattttatgaagtttagtaaggagtggagagaggagggttggaggattttcgtttgttatgatttagtttagggataagatgtgagtgttatgggttagttacgatcgtcggttagtatagtagggtatagtgacggtagaaggttgggagcggagagtcgggtagagtggatagtgatgtgggtaggtgtggattgtattaggtggttagggatttagagttacgaaaagaagggtataatacggcggtagttcgtagtttagttgtttgaatttagaatattttttggtttgtttttttttttttttttcgtttgtttttattttttttttaggcggggaaggaatcgttttttttttagtttttttgtcgttaggttttttttttgttagtttttatattgttacggtgatgttttttttaaattttggattaaagtgttattttgttttagaattcgatggttttatatagtagagttcgtattttttggtacggtttcgtattttttatttttttttagtgtatattttgtgttttgggtgtagtttttttttttagtttggtggttttaagtttttatgtttttgtatggatttttcgttgtattttgtttattttgtcgtttgatatttgagggtgtttttgttttttaagttcgtttttagcgttagtttttttgatgtattttttttttttgattataatttttttagtgtttatttaaaataaattcggtgatattgatatatattttagtgtgtgtgtgtgtgtgtgtgtgtatatatatatatatatatttggagatagggttttttgtttagttagagtaagattttatttttaaatgtgtgtgtgtgtgtgtgtgtgtgtatatatatatatatatatatatatatatatatatatatataacgattaaaatatatgtaagtgttgttgatatgtatttatatatgttatatatatggttttgcgtttcgtggttggagtgtagtggtacgattttagtttattgtagtttttattttttgggtttaagtgatttttttattttagttttttaagtagttgggattataggtatgtattattacgtatagttaatttttgtgtttttagtagagatgggattatgtcgtgttgtttaggttgatttcgaatttttgggtttaagttatgtatttgttttatttttttaaagtgttgggattataggtatgagttattatgtttcgttagttttttgtatattatttgtgttttttttacgagtttgtgagtttttttaggggataggatttttttttttatttttggtgtggttttaggttttgtagaggagagatggtttgaatgtttgttaagtggattgtagttgatagttggttagtagtttagagcgttggtgttttttggagtagtggagagaagttagataggtaggtaaaggttatatggaaattgttataaataaaaattatttattttttttttttagtaaaagtagttatttgttttttaattaatattaagtagttattatgattggtacgatgggggattttacgttgtatgaaatagttttttttttttatagttttgagatttagtgtgtaaaatttgtttattatgatagaagaaggggtaggtggtagtggttttaaggataatataaaaaagttttatgggattgtagaggagatagggtttggggataattgagattagatattatggggttaaggttttttgtgttggattttgggagagtggagattggtgggtttgttgtgggagttggggtgataggtcgtgatgggttatgatgggttgtgatggattttgatgggtcgtgatgggttgtgatggattttggtgggttttgatggtttatgatgggttatggtggatattgatgggtcgtaatgggttatgatggatcgtgatgggtcgtaacgggtcgtgatggattttgatgggttgtgatggttcgtgatgggttatgatggatattgatgggttatgatgggttttgatggattttgatggattttgatgggtcgtgatggattttgatgggttgtgatgggtcgtgatggattttgatgggttatgatggatattgatgggtcgtgatgggttttgatgggttttgatggattttgatgggttatgggggtggatagaatatatttcggaaatgagaggagttgaaagttgagtgtgtaatttacgtttttgaaatggtgaggagtttattttgattggtttttttttggattaattgtgtgtttgtgtgtgtttttttttgtttgttttttaggtgtagattatgaattacgtggggtagttagtcggttaggtgtttgttatcgtgaaggagttttataaggggttgaatttcgttatatttttagggtgtattgatattattgttattcgttagtttaatggaaatttttaatgtttttttttttacgttcgttttgggaagatgggggttttgcgttttcgagagaaagtggtgagtttttagggtacggggatttggtatcggttttttttagagaatgtttttgtattttggtgatgttatttgttttgaatttttagatttagagttttaggttttcgttggaaatggttagttacggaattgatagtgattaattgaaattattttagttagtatggttgtgtaaattaaagtgtcgtggtatatattattgtttattaagtttttgtatttgtgggttaggaatttaggtagagtatagtggggtggtttgtttttgttttttggggttttagttggaaagtttaaaggttgagggttggaattatttgaatatttacgttttttgtgattggtggttgattttggtttttggttgggtttttcgttgaggttttggttatattaattatttatggtttttttacgtggttagggtattttataatatagtggtagtggtgaggtgagtattttgagagggaggaagataggtagatgttggagtttatggtttagttttgtaagttatatggcgttacgtttgttgtgttttattggttggggttattataagttgtttgggtttaaggggaggagaaataggttttttttggtggtgttaatggaagaaggataaagtttataaatttggagaggagaattaggttgttgtttgtagggtggttaattttgataggttgggaagtgtagttttttgttagaagtagaaatagatattttgaggaaggggtaaagagattagggatttgtgttgtttggggttatagaatttatatatttaataagttataggagaggtcgtgagtgtttaggagaggaaaatatgtatacgtgtaattgagtttttgtttgtttatgggatttatgtttaaaacgtgatggtattagtattagttaagggtggagttttttggtgtttaatattaaagggtggagtagaggaagggaaaatttttagggtatattttttttaggtgggttaggattagtttttgggtttttattaggtaaaaaataaatataaataaataaataaataaataaataaaaacgtagagtagttttttttgttgatattagtgtatagttttttgaaagggttggtttttgtttggtttttagggaggaaagcgtaatggtggttattgaggtggggtatgaggaagtttgttttattttttattttattatggtttggaatttagtttttaaggtttttttggtatttttttgttttagagggggttcgtttagttagttgcgagtttagaattttatttttagtttatttttaggagtggcgaaggttttggaagagtaggtaggattaggatattgatgtggttagttttagaagataatttgttatataaatggaaagaaataaatttttgtaaatagatattttatgtttttatttaatgtggattttgggatgatgttttttgattggttttttgagttaagtttaagaggaaatttttttttgagtatgtgtgaaggattttagttaatagttgatgagttttttagggtgtaatttttaatgtttggggttggggaagttttgattgtagtttgaatttttattagttatgtgattttgggttggttattttttttgtttggttttagttttttagttaaaaaaggaggagttagattaggtggtttcggaggaatttttttattagtttgttgtaaaaataattgtagtttttgttattatttttaataattataataatggttaaaattgtagttatttttgtattaacgtattgttttgggttttattttttttggttagggatttgttttttcgaatttagaatttttttagtttttaagtgatagtttttttggatgggacggtttgattgagattgggagttgtgtggtattttagggtgtatgcgatgatagcgtatttgtggagatttggtcgtttttatgaggttttttgttttggtgaaggtagtttattttttttttaattatgttttttttttaggttgatatagaaattaatggggaatttgtggatttgtatatgaaattgggagataatggagaagtattttttgtttaagaaatagataatgattaggtaaggaagtttgggtggttagggttattttttagttttgagttttgagtaatggttatttggaaatacggtagaagtttgtgtaaagtaatatcggtcgtggttgtgtggacgatggggtagagaaaagtgggcgttgatttgtgtgggggatttgagttagacggtttaggggtgtgttgagtttatatagatttagtttttttggttggttttagtttgttgattgttttttaggagatagagggatggattttatatatgggtttggattattgttagaggtgtatagattatatcggtgtgttaaattttaaatgtttaatgtttttttatttagtgagtggttgaattattttaaaaaatattttaaaagttttattgagatatatattatatatatataatttatttattttaagtgtatacgtagtggttttagtatatttatagataggtgtaattattattatagttaaatttagaatttttttattaattttaaaagaaatattatattttttaggtatcgttttttttatattttattttttaattgttgagttttaagttattattaatttttttatttttatagatttttttattttgaatttttgaatggaattatagtatttggttttttgtgtttgtttttttttgattaatgttttaaggtttatttaggttttagtatgtattaatattttatttttttttatggtcgaatagtattttattgtatttatagattatgtttatttatttgttttatttattattataaataatttggggttgggtatggtggtttacgtttgtaattttagtattttgggaggtcgaggtgggcggattacgaggttaggagatagagattattttggttaagacggtgaaattttatttttattaaaaatataaaaaattagttgggcgtggtggcgggtgtttgtagttttagttatttcggagattgaggtaggagaatggcgtgaattcgggaggcggagtttgtagtgagtcgagatcgcgttattgtattttagtttgggtgttagagcgaggttttgttttaaaaaataaaaaaaaagaaattaaaaaaatttaaaaaaaattaatttgggttgtttttattttgtagtcgttgtaaataatatggttgtgaatatttgtatataagtttttgtgtggatacgtgtgtttgattttttttggttatatatttaggaatggtattgttgggttatgtggtaattttatatttaatatttgaggaattgttagattgtgttataaagtagttgttttattttatatttttgttagtagtgtataaagagttgtgatttgtttatatttttgttaatatttttttgattttgtgattttagttattttagtgggtgtgaagtggtatttttttatggttatgatttgtatttttttaataattagcggtatttgatatttttttatgtgtttattggttatttttgaatttttggagaaatgtttatttagattttttgttagtttgtgtgtgtgtgtgtatgtgtgtgttgttttttttttttattgttgttttgtatgtttttattatatattttagatataagttttttatcgggtatatgatttgtaaatatttttttttattgggtgggttttttttttatttttttgatggtgttttttgtagtataatagtttttagttttaatgaagtttaatttttttttttaaagtttgtgtttatttttttaatgtattttgtttttttttttgttgtgtatgtttttggtgttatatgtataaagagttttttgttaaatttaaggttatgatttatggttatgttttttattaagatagattatttttttaatttttttgtttatagatgaagtattttaaaggggtttgatgtagggatttttgaatgaaatcgatttgaattagtttttttttaggaagatagttatgattaaaaaggaacggttttttatagttttaggttttaaagtaagtgtttataattgtagtttcgggatagaatagttttaggtatagtttttattttgttcgtttagaatggtggtgtttggggaggatttagtatttttttttttatgttttggagtaattttgttgatattggggatttttgtatatttgttttttattttttttagatgggaagattttaaaaatattaattggtttttaatggtttttgatagaaattttttgtattgtatgtggatatttgtatttttaatttttatttgtatttggttttagatagatttttggttatcggagttgaggaagtattttgggttagcgtgtagcgggatttgtatgggggttgtttgttggttttgttggtttgatagggtgtttgtgggtggggtggggttttggaggttagagtatgtttagttttatatagatgttttttaggatttttgggatgttgttggaagttggagagttcgtgttttttagtattgtttggtattgtatgtgtttgtgggggtttgtttggttgtttatttttttttagtttacggatagtaaagggtttttttttgtttttgatttgagaatttgtgttgtttttttagttgttttagtttagtagtcgggtgagatgattttttatttttttttagttttagttgtgtgttttaggtgtagatattttattttagtatgtttgatgttttttaaatttatttgaatgattagtagtatacgtttatttattttttttgttttatgtatatttttattgttaacgagttttttatataaaatgaggtatttattaataaaatgattattagagttttataaaaattgttgaattattataaataattattaaatggataggttgtgttttttttttttgtttttaaggagaggattagtatttattttttcgatgtttagggttttttttgggttttggtgtaggtaggtttttgggcggggttatcggttgttttacgtgtttttggtttttagatggttattattttaatttattgtatataaaaaatatataatatatattttttgttttttttttatatttatttatgtatatttatatttatatagaagtgtaagagtgtatttaatttttagtataatatggtgagttaaagtttattttttttttttgtgttttgggtattatagttaaagttgaattttgggggtttgagattattgagaattattttttattgttaaaattatataaatgtaggattgagtataaagtggtatttaatatattgttggttttttgattttttattagattgggtagttatatttttaggttattatggttgtggtttttagttgggttatttgttgtggttttttttaggaggtgtttggtttttgaagtgaattttggaggtttttggtaaggttttgttttttatatttgaattaacgaggttttttttagaaaatgtgttttttttttaggaagttatttttatgtatttggttattttttttattttgttagaaggagtttcgagaatggaatgttagttgaaaaggggttttgtggataggatgagaggtttggattttagtacgttagtttaagtgatcgtttttagcgagacgtcgttaagtagttttgtagtaaagaagagaagaaaaaggaggagaaagttatagttggatagtttgaagagagatgataatatgaatatatttgaggatgaggatatgttttttatcgagatgagttcggatgaggttatggagttgttggagagtagtaggtaataattgtttagggtggaggggttgtgttagaattagatagttaattgtttaagattatttttatgaattttttttttataattttttatttttttatgtgttttagattagtggtttttaatttttttggtattagggattagttttgtggaagatagtgtttttatggattaggggtggatggttttaggaggatttaagtatattatatttattgtgttttttatttttattattattatattgtaatatataatgaaatatttatataattcgttattatgtagaattagtgggagttttgagtttgtttttttgtaattagacggttttattttgggggtgatgggtgatagattattaggtattagatttttataaggagtgcgtagtttagattttttatatgtgtagtttataatagggttcgtgtttttgtgagaatttgatgttgttatttatttggtaggaggaggagtttaggtggtaatgtgagggatggggagcgattgtaaatatagatgaagttttgttagtttgttcgtcgtttattttttgttatgtggtttagtttttaataggggtatggattttaggggttggggatttttattttaggttgaattttggaattatgtggatttaattttagagtggtataaagatttgttgtgttgtagttaagagatagttggtgatgttaaatttttttggttgatcgttttagtagtttggaatggagttaagaaataggaattgagtaaattaatagtttatgattaaatttatttttttggaatttatttatttttatttgagtattaacgatgtataattgggttgatttataggtaagggttgattttaggtttaaaagtgaatgaagaaaatgttgttttttttataagttaatttttttttttttaattttgatttaggtttaaagtttaatggaaattttgttttttttttttttgtttttaatagtgtggtgaaattttgtttgtatgtattattattttggtgaaaaatgttagttttaaaagataaaatttattttgaaggatatttgatgttttagatttttatataattcggtataatttttgataattttgttaatataaagaagggataaggggaattaggagtatttttttgtgttattatttggaataaaatatattttttttcgtggtgaaaaataaatgttaattggtaacgaatattgttttttttaattatagtttttatttaatttgtgataggtttagaattagcgttattgggttttttataattgttttttttgtatggttgttaagtataaaatttagtggtaggtgttttaggtaatattaatatatagatagatggtttttgtatgattgaaattgtgaattgtatttagtagtgagtgtgtttatatttgaaacgaggttatttgtagttattttgtaatcgtaaggtatgtttggttgatgttatttattttttttgttagataaaatgtgattagcgtatggttattgagttatttagtagttttgtttgtatttggtaggggttttatatcgttttggggtcggtttggggttattttattttttaggtttttggaatatgatcgtgtagggtagtaggaggtggtacgatgggaggatttagtagtgtgattattgtatgtgtgtttgagtttaaatgttgaaataaaattattttataattagaattcggttaaagtattagtatatagatacgtttatggatgtcggtattttattttttttttttttattgtttggaatagatttgggtgtttaaagagattatgttaattataaagtatttagagttaattaagaaaaaattggaatttgattatgaatttattattaagaattttttgattttaattttttttttttttttttagaattttttttaatgatatatttttattttaagatgatatttttgaggaaaatttttttttggttgtgatttatttttagttagttttatattttaattcggatagagagtggttatttatttttaggtaagttgttttttgtttttttggtttagtgtagaggtttagaagttagtgataggaagtaattttaagaaaagaatgaaatagaaatgaaaagtgaaaataattaggattaggaaaaatacggtgtagagtcggaggtatagattaggattaaatatagaatatgtttagattatatatttatatttggtgttagaatttatttgtagatatggttgttagttttttggaggtgaatttgaaaggaaaaatatgtaaattatattatgttaattgttaataggagaaaatatagtggtagagttttttttgatatttagttttaagtaaaatttaaaaatagacgttgttttaggagttgttgaggtcgtttagggttattagaatggtgttttcgttatatttaatttattttgtcgaatttaagaatatttatttttttgaaatgaatttataagttgttttagaggaaaatttggagaattagagttgtttattgtgtagatgttattttgatgattttagagatgtttatattagtgaaatttttgggaatagtgagttttttggttagtttttaaaggatttggggaagagggtagagttaaattttgtgtttttaatataggaaataatataatttttattgggatgaaaatttatttttgggtggtgataaaattttagacgttataatggtttgtggtttttaaggggttatagtattaaaattttatggtgggtggagttgggttattaattttttagaatgtttaggggtatgttgataatgaaaaagagattgagaaacgttgatttaaatgttagtgatatttttgggttattcgtatattttatgttttagattcgtttttggtttatggtgttagtttttagaaattttgggtttttatttgaagtcggttttattaaaacgttatttttggttttagtttgattagggtaattttgtgaattagtaagtagtagtttttagtgtgtgttgatatggaggttggagagaaaatagatatgttttatgtttggtttttagttaatattgatgtcgcgggttagtttagtaggttgaggttgaggtttgtgataaagtttttgtatggaggtttttttgcgttagagtttagttttgtttaatagaaacgtaataattagttttatatgtaattttaagatttttagtagttttatttttaaaaagtaaaaaaaaaaaaaaaagatgaaattaattttaaagttatattttatttgattatagtatttttaaaatattattttaataagtaattaattttaaagaattattaatgagatatattatatttttgtttatatattaagtttttataaattttattatgtattttatatgcgtagaatattttaatttggataagttacgttttaagtgtttaggagttatttgtagttggtggtttattatattggatagtgtagatataagatttttttagatttttattttttttttaggtttgtggagataaaatagtggagggaaaaatagtggtttaggaggaaaataatgtagaatatttagaatttaataatagatgaaaaaatttgtttaagtattgtatgttaattttaaggatttaaaagaaatattttaaatataattttgagcgtgtttaatgtttaaaatatttgtaatgttttgttttatgaatgtagtataatgattgagttaggttatgtagttttgattattattaaatggaatgataaattaggataaatagttatatttttatatttggaattaggtattttttgtaaagagataattgatagtatatacgagtatatttttggattatgtagtttgattaagtacgaaagtgtgattagagatgattagttttatatatgggtgaaatagaaagtgaaataggttatttggtagttttttgtttttgtgttttagaaaatttatgttgattttttagtaattttaatattcggtgttttgttattattagatgtttgagtttttttatttttttaaaaatgtcgttgttgagagtagttaaatattttacgtaatatatataatttttatataaagtatatatattttgtaattatatataattttatatataatttttatataaagtatattatatatattttatataattttatatatagtttttaaagtatattatatatattttatataattttatatataatttttatataaagtatattatatatattttatataattttatttgatgtaattgatttttgattttgttttttttttaatgtgtattacgtggtggtatttagtagtttggtagattgtaaaaggattgttttttattttgtagttgcggtcgagggaggtttgtttagtttttgttttttatagttttttttgttttatttttcggaaaggtagaggagttattttttttattgggatatatttaataatgaaaaatttgatttaatttttattataagtttattttattattaattaaattatttatgaagaaaatatttgtagattatatgaagtgaaaattttgatttaatttttataaatcgattttattaattaaattatttatgaaaaatatgtatatagattattttttttttttcgttataagtatttgtagatgattagatttttttttttttttaatttttaaatttgattttttggaaattatggttaagtatataattttatttaattttgtgaagtgttttgaaaatgagaataatgaaatatagtttgggaatatgattttttgttttttgtttcgggttgtttgataaataagtttataagatatttttggaatattattttaatttattataaatatttaagtagtttattgggttgtttgaataatggagttagatattttttatagtatttttagaatagaattttggagaatggtttgggttgggttttaggttgaggattaaaggttggtgtgtttattcgatgtagttattttagatttttgtttttatttttttagttttgatttatttattttgtggatttatatggtttattttgtaagttttagtaaatgaagttacgattaatttgtacgtggaaaattttttgtttttttgattaaagatttagattttaggatgtattttatttagaggttatatttgtagaagaaaagttcgtttaaaatgaggaaaataaagttgttaatagttaaaattaattagttttattgggattggtaaaaatattgaaaattttgataaggttaataaatattttgtttatgaatattagttattgattttgtaagtttatttttttgaataatttttgattttaaaataataatattttatgacggagtattttggagttatttttttggtaaattttatttggtagtgggttttatttttgcgttttttttggtttgtttgaatttttttagtgacggtcggtagaaagcgtatttgtgtttgtgtacgagatttttggagaagggttgttgtggtttgaacgggtagtatttatggtggtggtttgtttgttgttggggagggatttgtagtagattttttcgtagggttgggttttttatgcgtgagttgtacgtttgagtgtttttatgggttttgtggttcgtggtttttatgaagggattagaatgttaggaattttggagttgggaattgttgtaggagaatcgtgtttcgtatttcgtttttttagagtagaggttggtaaagtacggtttatgggttaaatttggtttattatttgtttttgttagattttttcgggtataggtagttggtttatatattggttgtggttgtttttatattattatagtagcgagtggttgcgatagacgtcgtaaaattcgtaaagttcgagatatttgttattgggttttttatagaaaatgtttgtcgatttttgttcggagtaagttttgtttaaaggattttattttatttagtgatagtgagataatttattgttgtaaagaatttatagttaaatatgttttattttgtttggtgaaatagaatggtaagagttttttagatattttgaggtttgggaatagtatcgttgagggtgagaagttggttttgatggatttattttatgatgatgttggagaaagagtggattgcggttatatttgtaggtattgaggtttttcgttggaggttatagtttgcgttttttttattgtagtgatatcgaatacgtgattgtagacgttttagtgttattaaagcgttgtttttttggagaagtttagttgtggaattggaagagtaaggaggttgaaaggttaggagttttttttatatggacgtgggggggtttacgtgtttttttataggattgttttttaaagggtagaaatgtgtgtttgttgggagtagggtgttttattgtagaagtttttttaatgtgatgttaggagttttttttttttaggtaggcgaaagagagcgtgtaggttgtttcgtggtagtacgttattagaagggttgggagttatgggtattaagggagtagggattattttttgttttttggtgtgagatgagagagatggtatttggtttggttgttttatgtagtttgattaaagagatttaggattagtttagtttataaggtttttgtttgttggatataagttatgtattattatgaatttattttgtattgataggaaagttatatttaattggagttgaattttaggtaaatgagattagaagtattagttttcgaagaatagataaggtttgggaaagaagacggtaagggaaattgaaagttttattttttgttttgtttgaaaaattttgtcgtttttttttagaggaaatgatgtgggaaaataagtaataattaattatgttattatgcggtaataaataattataagaattgttgttgtaaataatatttttttaagttgtttagaatatggtgaggattttgtggataagttaatgatttttggatggttattttggttgggtagaagtaagattttgtttgggtttttagagtaaaaatttaggaaatatggaggtggttattgagcgagttttaattagttggtgagttttttgtgaagtatttttggaagatataagattttagaaaattttaatttgtaggtttttgtttaacgttatcgagtttatttgtggtatttagtatttttggtaaaattggtatattatataatttttttgttttttaggttagtgtagatgataaatatttaaaatatggattttaatgagtgtttgttcgagttaattaagatttttttgtagttttttgatagtagaggaatttgatttggaaatagattgtaggagatgcgagtgtagagtggggtggggaagggtggtttttttgaggtaagaatagattatttttttttttttttttttattttttttttttgtattttgggttattttttttttttttttttttcgcggtgtattaggcggtagggtggggcgggcgatttacgtggagcgttttttatgggaggcgtttttttgttttttggtggtcggaggagggatttgttatgaggtttcgtttagagcgaacgatagttgggggtgtattttttgggttatttgagttatggagttgggtttaaaatatttataaaagtttttttttttattttaattttcgttttgtgttttttttaagttttttcggttttcgatttttaatatttaaaagtgatttagaattggttagtaagtttacggaaaggatagggtagaagaatttagaaatgttttggttgtggggagagttgtcgtaggttgttaaggtgagagtttttttaattttgttacggatcgaagatttttaatttagtttaaattatatggaattagtattatagtatagttaagaaatatagttattaggagttagaggtaaattaaaatatattaagggttagttttgaatgttggaattatttttttttacgttattaatattatagagaggttttattgtttttgtagattttaaatttatgggattttttttaggatttattttttttttttttttttgagatagagttttattttgttattcgggttggagggtaatggttttattttggtttattgtaatttttgttttttaggtttaagcgatttttttgttttagtttttcgagtagttgggattataggcgtatgttattacgttttattaatttttgtatttttagtagagacggggttttatcgtgttggttaggttggttttgaattgttgattttaagtgattcgtttgtttttgttttttaaagtgttgggattataagcgtgagttgtcgtgtttagttaggatttatattttttattatagttaaatgtaaattaaattaaagaaatataatttatatataattttgttgttttgaaattgtaaataaaaatagtttttagtttttgagtttgttaggttattgatgagtggagtaaagttatagggagagagttgtggatttttggtttattgaaaaagaagttgagttgtaagagttggaatttatatgtttttgtgttttttatatagagagatatttgggagagttttgggagagggaaaggttaatagaatagaaatgaaagattttagtttaatagataaataaagttagaaaattttaaggttttgatttattaagtagtaagtatttttgggtttttattgttggtgggattttgaatttgattttatggagatttttaaaataaatagagaagtagttgagggtagcggagagaatgagggtttgggaggtagtaggttattttgggtttgagtttttattgtatcgtttgttaaaaaggtgattttgggtaaatgagtagatttttttgaattttagtgtttttatttgtaaaattgtgagaaaatgatagaattgttgtgaggttagaagggttaatgtaggtatgtgaagtatttggtatttgtaggttttttgaatatttgtattttttttttttggttgtggtatatgtacgttgagttttagtttttttattttggatatgtagtgggtttatatgtaggtatataattggtttagtaaatatgtttttaaaaatatgaaatgaatataatttttttttttaagaaattttatttggtatgttaatgtattataagtattttgaattatgttattatattataagttttaaaaaatattgtaaggtttttagaagatgttatagttttttgtatttttaataaatgtttgtaatatgaatgaatgagtgagtgagtgagtgaatgattattgaaaatattttttataaagagttaagatgggtagttttttggagagtagtttgttgaggttaaagttgtggatttattttttttttaggttatatttagattttatagaaaatgttgatttatttgtttatagttatggtgttgatttagttaattttttttgtaagtttatgtcgttagttgttggagaaatagtatggaagtgtaaatttattattttttttggtaaaatagttgtaattatagattttttgtagtattgtttttatttgtaattgaagttgtttgattagatagagaagtgaatatttttttttttttttttagtttatgaattgtattttggtttttgtttgaataaattttttttgtaattggaaatttttttggcggtagaattagaaatgttaattttttatttatgtgaattaattgttattaaatttttatttatttatttatgttttgggaataaattttattgaaatatatatatagagaaatatatatattgtaaatgtatagtttaatatatttttatagtaggaatagatttgtgtagcgtgtatttagatcgagaagtagagtatgattagtagtatggaaatttttattttttgcggttattgtttagattgatttttttgttttttgtaaggggaaatttgattttagtaatagagattagttttgtaagatttatttatgttgttggtgtagttgtaatttatttatttttatggttattgagaattttagtgtgtgtgaaaagatttgtaatttaatagtatttagggtgtttttgtttgttggtattgttaattttatttttttttggtagttgatgttttataggaaagtttatttgttttggatttaatatttttggtttttggattttttggtaggtatagaaattattaggtgattgttgaggtttaaaagtttttgtttatttttgattatttgttttttttgggttatttagtttttttggttgtttttgtgttgattttgtttttttttttgttttttttttttttttgttttagtttttttttttatataagatgaaagagtttagtttattgagtagtagaaaaatttgtgataaaagttatttttaggttatttatagcgaatttttagatatttttagtgattaatcgttaattttggtcggtggggtatttttggattagaataagttttagatagaaatgtagtttgtgaatgaagaagatttggagattttaggagtagtagcgttatttttgtttatgatcgaggagtttaaatttttttttgttagtgtagtttagatagtaaataagacggattttttttttaggaaaagaggtattaaggttggggtttttcggttttttttttgtttatagtttgtgtttattttatatatgataggttttttttaaagttttaaggaaattgaggtagaaattgaatcgtgataatgattatgtttagtttgagttttttagtagaatatattaattatcggaatttagttataggaaattagatatgaagaaggttttgaggattatgtagtaaattttattttatatattgaggttgttcgttgagatttgggagagttaagttttttttagtatattatgggatttataagtgtgatttttataaagttgattattaggttaattttggttatttttttttttgttttgcgttgttttttagttttttatttattgtaatttttgtatattatttattatgattttaaatgattattattttattgatttatttttgtttgatttttttatagaatatgtgttgtttgagattaagagttttttttatttaatttgttttttttttttcggcgtttggtatagtggttggtatatagtgggcgttttgtgttggtttaatgtatttttggttgtgtgttagtattaacgatgttaggtttgatttttatttatttagtagtttcgtgtggttttttagaattatatggattaattatattattttttgttagaagtaaagaggatatttgaagttattatggttagtgtttgataatgtatagtgtgggatgttttgtttcggggtattgatggggaagtgtttaataaaagtttttattattttataataagtgtaataataatggtaatagttttaatgcgtttagtgtttagtatattttaggtattttatagaggaggaatgaggtttagtaagttaattaatttgatttaggttatacgatggtggatgacggttttggtttgtggattttggtggtttacggttacgttgtattgtttattattttttaatgggaaaagcgtaggttgtggtttttagcgaggggtttcggtatttataagtgtgattttaatttattttttttttagtaatattatggaataagtttattaaaattattttatttttaacggtattgtgtttaaattttaaagtatttgtttaaaaagtttttgttattttgttttattagataaaatagaatatatttggaattgttgtggtttttgggtagtttgagtatttgggagtaaatttgtatatagtgtttaaatgttgtttttatagatataaggttatgagtttatttttagaagagtggttttttgatttgagttatttgtcgttttagataaacgaagtcgatattttggtgttgacggcgtttatttggatgattttatagatatggattttgaagtggcggttttgtatttttttaaaaagtaaaatttttgttaattttttatattattttttataatttgaatattattttgtgtgagattagtttttttttatgtttgattagaaagtgtgtaagatagttgggcgcggtggtttacgtttgtaattttagtattttgggaggttgaggtgggcggattatttgaggttaggagtttaagattattttggttaatatggtgaattttcgttttattgaaaatattaaaattggttgtacgtgttggtatgtatttgtaattttagttattcgggaggttgaggtaggagaattgtttgaatttaggaggcggaggttgtattgagttgagattatgttattgtatattagtttgggttatagagtgagattttattttaaaaaaaaaaaaaaaaaaaaagtgtgagagagaggtagtgggaggtttttattgttttgtgaaatgcgtttgttttatggatataagggtgcgggtattgggcggcgttttatttttggataggggcgtagtatcgggttgttttttttgtaaagtttgaggttatgttgtttatagtggtcgtggtttatagtttagtaagtggtagttgtgtagttttttttttttttaggagggtttttcgtgattttggggatttatttttagtttttttgcgatttagggtagggttggcgtttggaggggaagggtagggaatagggaggatagtttgttttttttttagtatattttagggggatatagggagatgtagttagttgagaagtaatggtttttttttttaagttaaggcgtttaatgtttttttttttgtcgtggtgttttaataaatatttgtgttgagatgtagtcgtttgcggttttgagggtggtcgcgtgttagagtattattggatggtgatgtaggattttgaattgggatagtttttagtcggtttttgtcgttttttttttttttagcggagattttttcggattcgtaaaatatgtaagcgataacggagttcggttagttaattagttttcgtagtcggtgggtagttcgggcgtggatagtggcgtggagagtatttcggacgggttgagggattttttttttatcgttatttttttttgcgggggttttagcgattatcgggagattacgaaaggtatcgcgggtttcgcgcgggcgttttttggtggtcgtcggttagaaggcgtagaggtttaggtttttttaaggagtgcgtgttaaggtagttttttttttggttgcggttaatgatagtatagatgatagtatcgaatttataatttcgatgtttttggtttgtagttagtcggttttagagttttgtgggttatttatggttcgggttatcgttgtgtgttttttgtgttttaggttagtattgtagagatggtttttagaggtttgtaggttagagggggtgttagtttaattaaattagagggtgtcggtagcgagagagaagtgcgtcggcgttttggaatagggaggtttgagtttgtcggaggagggttgggaattttttttagttggatttaaagggcgttaatcgggtgggtttaggtgatttatttatagtatttgttatattcgtagtaatgtatttttagggttttttgatagttttatggtagggtgtgtttacgttttttagtgggtgtagttagtagttattagttggggattagatatagtggttttgtatttttttcgtttttttttttattattgttttttttttattttttcgtggtatttttagtagggaaggggtcgaggttgtgtattttttttttttattttttaggagttatttttatttttttttttaattagggttgttatgtgagatttttgtttttattttggtttttttaaggttttgggaattttttttttcgtaaagattgagatttttttgtttttacgttcgtgttagttagttttttgagagcggaaataagattgtgtgttgggtttcgtcggttttatttatttatttagtttttttagggttatatattaatatttagttttattgtgtttttgaagttatgggggttttttggatattggcgtgaggagttttttgggcgttttttttttgatatatatgagttggtgggggtggggtggtagtattgataaggttgggtatcgttatttgagtgttattttatggggttaggatttgtagttgtttagtttttataggtgaggttagatcgttatagttaggagattttaggagagttttcggaggttttgattagggttttgagggtgtatgttgaagttagttaggttggtattaagatttagggattttttttttggacggaggagatttttagtgtttgatgtttgttgggtttcggttcggtttagggtaaataggagtttttagggaaggagtgggcgtggttttgggttagggagatggttagaatcgcggttaaggtttaaggtatagtttagttgttagagttcgttaaagaattgagggttcggggttgaggtttgggttttttgattttgttatttttttttttgttttgattttggtggggttgttttattatgatgagaatagtgttttgtttgtttttgattgtggtggaggtagttttatttttgaaagggttttgtgttttttatttacgatattattagtttttatgattattttaggaagtagatgtggttattatttttatgttagaggagggaattggggtttgggaggtgaatcgtttgtttagggttattttcgtaatcgtgattttagtcgagggagtttggtttttgcgttatgcgtagttatgattttgtttgtgtagatgtacgtgtgtgttgtttttatttttattttttgtgtgaacgtatgtgttttaattaaggtatacgttttttaatatttttagttttgttttggtttttttgtattgttgtatagacgtcgttttttaggtaaaatggtgcggtttttataaatatattttataggattgtttgtatagttggaatgtataaatttttagaaaatatttgtgagtgagtaaatgaaaggtaggtttaattttgaattgaattttttttttgtttttttttgattttttgtaattgttgttatagatgtatttttggagtaagttgtgttatattaatagtttgtggataatttcgttattatcgatgattttaatttcgtggtaaagattgggagtaagtaagtattttttgaaagttattttggtagtagtatgatattgtttttgttttatgtttttaaatagatttagatattaagttttagaaatatataaaataaagattttgttatattgtattattgtattatttttattgtggttagggttttatgttaatagaattggtaatatagttgataggtttagatagtttttagttttgtgagtttttttttttttttttttttttttttttttttttttttttgcgataaggtgtagttttgttttttaggttggagtgtagtggtgtagttgtagtttattgtagttttgaatttgtgggtttaagagatttttttattttcgtttcgtaaagtgttgggattttaggtgtgagttattatatttagttcgatgtttttattgaatgtgaatagttatattttgtagtatatgggtatgttagagtagtttatatttttatttttttgaaaaattttattatcggttgggcgtagtggttggcgtttgtaaatttagtattttgggaggttaaggtaggcggattatgaggttaggagatcgagattattttggttaatacggtgaaatttcgtttttattaaagatataaaaaattagttgggcgcggtggcgggcgtttgtagttttagttattcgggaggatgaggtaggagaatggcgtgaatttgggagtcggaagttgtagtgagttaagatagcgttattgtagtttggtttgggtgaaagagtaagattttgttttaaaaaaaaaaaaaaagaaaagaaaaattttattatttgagggtaagggatgtataggtatttttgtagattgttagtaagttttttttttttaagttatggatgttttatatttagttgtttttattttgatacgtggtaagaaatattttaagtacgtcgtggtttggtgtagtagttgtacggtgggatttgggttgttggtatgtttaattgtttgttttgttggtacggttgttgttgggtttttaattggtcgttggggtgaggtggggggagtttttgtttaggggtgatatggaggagggttgggggttagtaagagtattgagttttttaagggtttcgttggagtttcgagttttttttgattattttatatgatattggaaaggtttttagtttgagtttcggttttttgatatatattttattgttttgtgttagatattataattggataatagtagtatttttttttttggtaatgtaggttttttagaaatttttgttaaaggtgagttttaatatgagaaagaaaaggggatgttagaaatgatgggtagtttaatttggggtggttggaattttatttttattttggaaattatagagttaattttattgtgtttttttgaagtttatgagtatataggttaggagtttttgattttttttttgtattttgtacgtggttgttttttttttttattaaggtaaaattttttaattatggtcgagcggatcgaagattttttttttaatatttgttatgtaaggggtataggtggaggttgagtagataggtgttaggattttagagtttagtgaggataaagggagatgattgttattttggaaaggtggagtaggtattagggttaggtgtaggtgttttgtgttaagtgttaagtgttagtgttaagtgttgtttagttaggaagttagttttatgtttgagtttttgaggttagagttagtatagggtttggatagtttttagtttgtaggggagagtaggtaagtggtcgtagggaggagttaggagggtagttacgttatttgttagtttgtagtgtttttattttattttaaataatttattagatagttagtttggagttgttaatttttttaatgatagatttttttgttagattatacgttttttgttgtagagattgttttaggtttgtttgtattttttgtgcgtttagtaagtttttgtatggtttaggatgttgtcgtcggttagttagtttaaatatttgagatttttgaaggtttaattggattttgttgagtttaggtttgttgttttttgggtttgtgtgtgtgtgtgtgtgtgtttgtgtttgtgtgttagtgtgtgtttatgtgtatgtgtgtatacgtgtatgtgtatgtatttgtatgcgtgtgtgtgcgtatgtatgtgtgtgtatgcgggtatgtgtgtatgtttgtgtaggtgtgtgttttatgtgtgtgcgtgtgtgtatgtgtatgtgtatatgtgtggatgtgtacgtgtgtgtatgtgtggatgtgtacgtgtgtgcgcgtgtgtatgtatgtgtggatgtgtatatgtgtgcgtgtatgtgtggatgtggatgtgtacgtgtgtgtgtgcgtgtgtgtgtgtgtatgtgttgtgttttgaggatcgtagttttattttgggtggtgttttatttgattatttttgtggattgggttgagggtatgttttttagagtggtttttattttgtttttgttatggtatttatggtttgggatatatttttatgttatcgtttttaatatttataaattcgtaagaaaaaaggttattgtaatagtaatatagttaaaggatttatttatttattgaagaagaaatttatatgggttttgaaatttaaaagatattagtttttgtgatatgtatgttaaatttttttataagttagtaatttttgattatatatggtatttttttaatatagaaattatttttaaatgtagaatttgtttattttattttttatggttgttgggttttgtattatatataaaatggttttgtttttttatttttaaaatttgtgaagataggttttatattttttttttgtgtttttttgtatatggggtatatttttataagttttggaaatttcgaaagattttaaaattttttatttatttagattttgttttaagtgtaatgagaggtattaggaagtaaattagttttttttttaggaagttattgaattggtgaagatgatttttgttttaggaaatagaatgattaaaagtggtttaagtaatgattttatatgatgaggattttagaggttggtagttttaggtttgatgaatttgggttagtttttttgtgatttttttagtttttttttgatggttataaggtgattgtcgtatatatcgtttgtttagattgtcgtatttgaaacgggagggtaggggtagtttttttatagtttaagatttggttatatgattattattaaagtattttttggtaaagtaatgaaatgattgtgaacggtttcgattattgaggtgtattttttggagttgagttagtttttttcgtatgtattgtagtttgatttttgaatagagttttagatttgttagtaagaaaggggaggtagatgagttgtttatagggtttgatatggttattgaattattttaggatcgtgtattaattaattttattttttatttagaggtagttataattttattttttgttacgtgtttttgtgaatttagatttatttttggatttcgttttttgtttttgtgatatgtgtttttgtatattaatattgtatttttttagttattatatattttggtatattttaatatttagtagtgtttgttttatttattatttttttgtttgagaattttttgggttatttttgtttgttttttaaatgaatattagaattagtttgtgaaggattgaaaatatttttgtttgttttttttttttttttggtttgttttttttttttaaaaaaaatgtggttttgttatatttatgagtggatttaggggaaatagggttatttatagttttgttaattgttttatttatgagttggatgtgagtggtttgtattttagtgtagttgggtttttttttgtgttagatagggattttttaagttatatagtaaattatttatttgtttgttttttttagattgaattttttagtttaaattttttttttgttattagttgaggtgttagttttttgaaagttttgtaaattgaggaagggatattatttaatttttattttggttttggaattaattttaagatagataggtattttgttttttggaaaaacgtagaaaattattaatttatatttaatttttttattaaatttatttatttaaaagtatgaattttttttttaatattcgagattttaaattaaatgtatttattaatgtaaatgtttagaaatttatttttagtaaaaattttatgtattttattttttgttgaaaattgttttattttttattttatattaattattttatattttatttgataattattatattgagagtaatgatattttaattagttagttattttaatttgaaaatttttagttttattaattattaatgatttttaatgttttttttttttgttgttgttgttgtgttgtattttatttgttgtttgtttatttttttaatatttttttaagtttttatgtttaagttatttttatgtaattttggacgttattaggttttgtttttttaaaatttttaacgtataaatagtatgttgtgttttttttgatttttttttaaattttattttaatttgtatgtatgttttttttggtttgaatgtgttaagttgatttttttttgttttattatttatgttattatttatttaaaataggttattgtggaatttattatgagggataaaatgtttaaaaagggaggaagatggtggtttttatggaggggaagaaatattataattaaggaggtaagtttagaagataaagtagtgtttatatttagtaagtgttggttttgtgtagtgagattggtttttatgtatttatattagagaaatgaagataggttttagtgttgagtttttatgagttagttttgttatgaagtagggcgagtgttcgtggaacgtggggaaggtggggaggaaggttaggagttagtagtataggtgttattttttggttttgtaattgttgggagattgtggtttagttatttttttatggtaagatttcgttatttataaaagaagggatttagtttgggaatttagttttttaagaaattaaatattttttttttgtttgtggagataattttttttttttttttttttttttttttttttttttttttttttttggagacgggtttgtttagttatttaggttggagtgtagtggtgtaattttagttttttgtaatttttgtttttcgggtttaagtaatttttttattttagtttttagaatagttgggattatagttatgtattattacgtatagttaagttttgtatttttagtggagacggggttttgttatgttgtttaggttggttttaaatttttgggtttaagcgatttgtttgtttaggttttcgaaagtgttggtattataggcgtgagttattatgtttaggttgtgaggataattttaatgaggtatatttatagtagttgattaattttttgagtttttttattgaaatggtatgtttaaaggtttatggttttggcgtttatgtttatgagtgtttgtgattttttttagattttcgttgtttttttttttattttttgaagcgtttgttttgtttggtttttaggtttttgtgtttatttgggttttttttttttagtaggttgtttttgttttggtttagttatttttaggagggtttttaaagtttatgttaggttattttttttttttttattttttattttttttttttgtttatgcgatgattttatttttgtttttaaattagatatttttttttattttatatttatttattaagtagtcgattaagtagatatcgttttgtggatgttttaacgtattttaaatttaacgtttttagaattgaatttatgggatttttgtgagtttttttattattggggttatagttagaaaatggtattattgtttatttgtgggtgagatttatgtttttagttttatttttatattaggttttattagttttttatttgaaatatttttttgacgtgtttatgtttttttagttttgtttttataaatttgtattattattattttttttagaggtgtttttagatggtttttttgtatttatttttatttttgtttttttattttttgtattgtagatgtattggtttttttaggggattgtttttatttttgttgttttttaaagttttattgtggttttttagggtttttataatgaaggtttgtgtttttattacggtttatagtgtttgtgtgttttagtttttgtttgtttttttaattttatttttgttgttttttgttttttgtgtattagttttaatggttgaaggtattttttattttgggggttttgtatatgttatttttattatttagtattttgtggattttttttttttgtttcgtttagttaattagtagatttagtagttttttttttgtagatgagtttggtttgttgttttttgtttgtgaattttttttttataaattttgttatagttgataattatgtaattattagcgtgattatttgatgaattttttttttttgtttagattcgaaattttatgaggtagagattatatatggttttgattgttttggtgtttttggtttttatattggatttagagtaggggtttagtaaatatttgttgagggtacgttgattattttgggaaagtagtatgaagaagttatagggataatagttaagttggttattttaattataaattgttatgaattttatttatgttattagttgaaagggaaaatgtttgttggaagagttttattaagatataattgttttttgatattttttgttagtatatttgaggtttatttattagttttattaatttttaaaggttatcgataaatgagtttaaatatatatgttttatattagaggttttaaagtatgaagggtttttttggtttttttattagagagtagaatgttttagaatttaagatggaagtatattttagtgatttttttgtagaatatttaaatttttattagtttgtattaagtggagtgtcgttataaagtaaggaatagttatgaaattaaatgtttttttaaaaatttgaaatatatttattttagttagatatatatttgggaaatagtttaagaagaaattgttaatagtgatggttaagttatatgataaatagataaaatataattggatatattatattaattatttgtgtggtaataaaaaaatttaaaggatatttgaatttagtttatgttagttatatgttaagatagttagtttattatatagtttgtattgtttattttttttattaaaggatcgtagatttttttttttgacgaaacgagtatagagaaagagatttagtcgtttattttcggttttttggtatttttttttggttttttttgtttttggggttagtgtttattttcgtttttttttgtttgttatgtgtttggttttgtggtttagatatagttttttttaatttttatggtagcgttaggagatggagaattttattcgttttatagatgaggaagcgaagttttgaatagttaaatgatttgtttaaagtttgtaagtaagagaaataagattgggtttaggtatttttttagaaatttaaggttttttttagtatattaatagaggattttttattaagagtatgttattttggaaaagaagaaaatgtttttatattttttttaagtaaaatatggtataaaaatatttttaagcgtttttattagtaattataagaaaatattttgaaaggtttttagaatttaagtagtttttgattaagtatttgtataagttatagtgatgatggagtttggtttggtgttataaatatttatggataatagattcgtttttgttaaaaatattttttggtttaatcgtatattttttagtaaagttgagattaggatttatcgaaataaatatagttagagttttttgggcgatcgttagggtgggcgttattggggaatggtttatttttaggggttttgttttaaggaagtttatgggaaaatatcggttgtttgtaagttttttttttgtggtatttttgtgatttttttttttttttttttttaggaaagtaagttagagtagtgtttggttggtaaggtttatagtatcggagagtaatcgtcgtagtttagtttggttattaggtgcggtaggaggttttttgggatgtttgtagttttttttcgtatttaagtttatggcgtgtgttgtttggatgtagatagggtttattatatagttttaattttggttttgtgatttatttggtgatttggagtaatttatttaatttggtttttttatgagtaaaatgtatgtagttgtttttttagatagttaatttgtaaaataaatgtgagtttttagtgagataatataattagagtattttttatggttttggtatgtaatagttttttatatatagatgatgatgatgataataataatagtgagaataatgatagtgatgataggaataaatagtagttttaataataatatggaaataagttttatttttgaaggaatttgtttttttttgtaatttaaatattgattaggatttacgttgatatttttaatatggatttatatttatttggtataggagaggttagattttgatgatattgattcgtatttgtggtgttttgtttttaggttaattattttgtatgggattggaggtgattttgaggatagtttcgttatatattaattatgatggtggtattatatattgatattgaatgatttgcgttgtattattttttattttttattttatgtttatagtatttttgtgtttaagaaatttaggattttattttttatttagtagatagaaagtgttaatagattaattggggttagatttatattttatttatttttgtattttggaggttattgttttatagagtagtcgtttttaaagtgttgtttaatcgttattgaattattgaggttttttttatgtgttgttgatttatgggagaggtaggcgtggatttttatttttttgaatttcggttatggttttgtgttttaaataattttatatttaggattttttgttataaatagaaatttacgtgggaggtaggtgggaaatgatttgatttttttattgttttttgtggagaagaatagggtggagacgagtgtgcgggatttggtaggggtgagtttgaatgtgattgtgaatggtttggttcgttttcgtttgggatgtttttgaaatttttttgttttttttggtggtgttttaggtgtttttttttgatttatcgttggtttgtgttttataggtataagaaagaataggaaggtattagggtatcgatattttttagttgggaattttgagtttggttgtgagtgtgtttggaagggagaaggtaggtgtgttgaggatggagtttaggttaaggatatgttattttttgagtagttagtatggaaagtagatattttaaaataagtggttgtttattgtataagttgtagcggaagtagtcgatattggagttaggtaagtgtggtttggaattttagttttgtttttcggtaattattggattttggggaagttttttgatatatttgagtaaaggtgttagtgttatcgttagtgtttagataggttgggatggagttggtttggaggttgtatgggaggtatgttattttaaaagaggtatatataataaagatgcgaaattgcgtgtttttagtaatttaaattaatttaaatagttatattagaaatgtttcgtttttttggaatttattttaataattttttttgttttggtaataatttttaaatataagaggtagtatagagtaggatgtatagtagggattttgtttaatagtttttagtgtgatttttggtaaattaatttattttttagcgtttttatttgtgaaatggggttaagaataatatcgatgcggtagatttcgttttattgggttttcgaggtaattttatgagaaaatgatttagagtgtagaaattaattggggaggatggttttgtggttatttggaggatatgcgtttaattttaaattatatagtttttgttggttgaatgtaggatgtttgttaaatttattttgttttttggtagtgtttaaggttgtgggagtttattttttatattagtgtgatttggatgtgagatatggagttaaaggagattattttggaatttttaaatttaatgattgttttattggattttatatttgtatggggtttgtagttttttcgttttggttaatttgttttaatggaaataggtgtatttatttaatgtttgtattttaattgtatttaggaagtaatttatttgtttttgattttattggtttataggtagaggggatttgttttagatgagattttggattgtggattttgagttaatgttgaaatgagttaagattttgggggattgttgggaaggtatgtttgattttgaaatgtgaaaagatatgagatttgggagggtttaggggtagaatgatatgttttggttttgtgtttttatttaaatgttattttgaattgtaatttttataatttttaggtgttaagggtgggattagttggagggaattgtattatggggtcgttttttttatgtcgttgttttcgtgatagggagtttttacgagatttgatggttttataaatatttggtattttttcggtttgtatttatttcgttttgttgttttgtgaagaaggtatttgttttttttttgtttttagttatgattgtaagttttttgaggtttttttagttatgtggaattgtgagttaattaatattttttttttttataaattatttagttttgggtatttttttatagtagtgtgagaacggattaatatagttagttttagatttaggggaagatgggtttgagggttagagagttaggtttataagggagggaagaggatagtaattgggaggggttcgtatatagtgggtatagtggtattgttggtgttagtattgtttttatttttattttttttagatatagtaggtaggattttaggagagtgtggagagtagcgagatatttttgtagttttttttacgttggaattttagtttttgtagtttatttggggtgttacggatttttttattgttcgatataattatatttaaatggggtaaaaaatgtttttttttattaaatagaaatagttggattattcgttattttgagttagttatagtatggttttttattaaatttgaaaaattaagaattgatttttgtgaaaatttagattttgaaaagaatataaagtttttttgaaaaatgtaaattttttaatttatattggtattttagattttgagtttttttattagagttatgtagttgattaaaaaaaaaaaaaaggtgttagaatgtttttttaattgatagacgtgattgatagaatagttttcgaagttttataattgagtaaatagtttgttattatataaataattaaaatagcgtttgaaaaacgtatattgataagtgttaatttagatgttgtttatagttatttttttgtgtatatatttttaaatgatatgagtttttttgttttgttttgttgttttttgtagatattgtaaagtaagtaatatttaatgagttattgtaaggggtggggtgggggttttcgaaaaggaggtattttattttgtgtagggtggcgtaatttgagacgtggtagtcgtaaatgatcgtgtatttgttttaagtcgaaattattaatagttaattgcgtatttcgtattttagtttttgtatttgtgtttttttttttgtgtttttttaaatatggtatgttgtataaatttagtggattttttttttaaagtagtagatggaaattatagttatttcgttttgtttttttatttcgtcggtagaggtatatattaatttgttgttattaagagttttgttttatatttggattttattttattttaaattgtttggttggaatataaatatttttttatttaatgaggggtttgtagtttcgttttttttttgtttgataaggaaatttgtattattttttttttttcgtttttagtagtatttgttaggttgtattagttttaggattatatttattttatttgaaaatttttagattgttggtttagaggaattagtatggtttataggattcgtaggtgttagaattggaagggattttggttggattaggttattttatagatgagtttattgaggtttagggaggaattttttaggatgaggtttttgttggggtttatgtttgggttttttagtttaggtttttttagtttgttatttgtttttattttgaagttttgggtggatgtgatttagttgtttttttgtattttaagataaagaaattaaggttgaaagataaagaaatgatttttttaaggtaatgtagttcgaagttattatgggttggaaatttgtgttttttagagtttaattgttgtattatttttattttatttagaattaggattagtttttaatgttatggcgttgttttatttacgtgtagtttagttttgttatagattaattatagttttagtcgatgttttgtttttttttaatttagttttttgtttttatggcgtatttttttagggttttgttttagtgatttttaaatttttgtttttagtttaggtttttgtgttgtgatttagatataagttttgcgtgagtgggaataggttgtttgttgtgttatcgatgtttggtatggtatgtttgagtgtcggttgaatgaattttgggttattattttaaagtttatcgattttttttttttggggtttagggagtaggtgtttagggaggggttgtttattttaggattggaaggagttgggtttttatataagtgtggtagaaataatatagaagtggaggtgttgtgggatattatttttttttatgtttttttagtattgggtagtattgggttgtagggatttttttttttttttttttgagatagggttttattttgttatttaggttggagtgtaatggcgtatttttggtttattgttattttcgtttttcgggtttaagtgatttttttgttttagttttttaagtagttggattataggtaagaattattacgtttggttaatttttaaattttttgtagagataggttttgttatgttggtgaggttggggattattttttaaatgaatatttatggggttagaaagttgtaggttgtataggagattttaagggaggtaggggcgggggaaataggaggtagtaaggcgagaggaagttagtattgagaggagagagtttattgagataaaaagataaagataattttggtatttttttttttatgaaatttagattttttttttatttttaaatgggatgattggtttttttgttgttgagttgtttgagttttttgtatatatattgggtattagtttttttttgaatgaggagtttgtatatatttttttttatttaacgggttgttttttcgttttgttgattgttttttttgttgggtagtagttgttgagtgtgatatagttttatttgtttaatattattaattaggaaagtgtaaattaaaattatagtgagatagtattttattttagttagtatggttattattaaaaagataaaaaataacgaatgtttataaggatgtggatagaagggaatttttaaatattgttggtgggaatgtgaattagtatagttattatggaaaatagtatggagattttttagaaaattaaaaatagaattagtatataatttagtaattttattattgtttatttatttaaaggaagggaaattaggatgttaaagggatatttgtatttttatgtttattatagtattatttataggagttgaaatatggaattaatttaagtgtttattaatggataaatgaatgaagaaaatgtgatatatatataatggagtattatttagatataaaaaagaatgaattttgttatttgtggtaacgtgggtggaataggaggttattatgttaagtgaaataagttaggtatagaaagataaatattacgtgtttttatttatatgtgggagttaaaaatattgattttatggaggtagagagtagaatggtggttattagagttgggaagggtagaggggagaggaggatgaagagaggttggttaatgggtataaatatatagttagatgaaaggaataagttttagcgtttgatagtatagtagaatgattatagttaacggtaatttattataaattttaaaatagttagaagagaagatttgaaatgtttttaatataaagaaatgataattgtttggggtgatggatatgttaattattttgatttgattatggtatgtatgatattttgataaatgtaaatatatacgtttattagaatattatatgtattttataaatatgtataattaatatgttaatagaaaaataaaaaatacgaaagatagtaaaaaaaaaataagttggagttttgtgtatattttaattttgtttagaggaaggtgttgagttagaggttttgtaggaaggtaaagtatcggagggtttgggatgtgttgttttgggggttatttagttttttttatttagtttaaggtatttattaagtgatttatatagtattgaggtatttttaaagatagtggttttgggaggtagagttgatattattgggttggggattatgttatagtaggatttttattgagtgaatagttaattatagatatgtattatgtgagttatttaaagaaaacgagtttaatttttattttgtattttttagttttttattaaataaaaaagtttagaagagttaggggtattgatttgtatattttgagtagggaagtaaggcgtattttttgtttatgggatgattttttgggggattttgagagaagaattggtgagttttttttgtttttattggtatttgttcgtaagttttagaaaggttttaattgtttggagttgtatatttggcgagttttatatagggaattgatggatgagtgtggatttgtagaaatttggatttttagcgtttggtatgtagttttagataggaagagaagagagatagagaagatagtatttttttaggttaagagggagtttaattttgtttgttatgagtaggaatttgttggtttaaaatagtggtggtagtttattaataggtaagtgaatgaggagaggtagtttttatacgtgtaatgtaagagatgtatgaatggggatgtagtgagagtttattgataaatttaacgttttatggtaaatgattattcgagagacgggatttaggagagattggattgatttagttattgattaaaggttaatgtattttttatggttatttagatgtattttttaattggtgatgatattattgtgtgttttagggtaaagtatgaattattttttagtgatgaggagcgcgtagttgttaagttattaaacgtaggttattttttttttttgtttaatgttagttataagaagatttttcggttgattttcgagtagtttgtgagttttttatgtttggcgcggttgtgttgtgagtatatgaggtttttgtagatttttaaggttgtgtgatggttgggatgtgttcgttatttgttattttttattttagggggtttgtaattttttaattgggtattcgttgtttttattttaattttagtattatttaggttgggtttttaatatgattttgttttttgttttttttttttgttggtttggttttggaggatttagtttattagagttaggaggaaggtagtttggcggagttaattcgttttaaggtgttaattatagatagatttgaaaattatttaagggtgtttttgttttaagagagagatgtttgttaatttaaatgtattttttaagttggtggaaattaagtagttgtgatagaatttagagaattttaggtaattaggggtattatttggttatggtgtttttttatttttttgtgtgtgagattagttttaattaaaagtttttttttggatttcgttggttatggttagtgagtatttgtttttgtttttttgtgaattaagttttgtgtattttttttaagagttagtggggagtttggtttaagtgtgagggtgtttattaggaaaagataaggaagaggtttagatatttatttaggttatgtgtgggattttgtagtttgggggtttttgtgtgatttattgtttttattggcgatattggggatatttgtagttaggtagtttgggggtttgaatggttagttggtgtgtattaggagttttggtatagagatttaaaattgtttaaaagttattttgtattttgaatttggtgtgatttttttgggtttagattatatttttttggatatgaggtatgattgataattaagatttttttttttttaattcgtgttagtataataataatttaaaaatatggttatttagggaaatgtatttttatatttggtttaaatttgtttttttgaatgatgatttttttatttagttttagagtggtaagtgtattttattttaaatttgtgatttattacgtcgtgtagtttcgttattgaattttggttaatgattgtaatttgaaaatatttgattaaattagtattattttgggaagtagaataattttgtagtaagtaggtaagttgtattataagggggtttgagagagttgaggttttattttgtttgtttagtttcggaaagaattagaataaggaagggtggggaaagaaagaattatataagggtttagggtagttatttgtttttaaagtcgaattttgttttttatagaatagaagttaaatgtttattaattagggttttttttttaagtagataaatattaatggtttatgttttttagaaaagtttgaagttgaagaatggttttaacgacgtggtttttagtgttattacgtagtattaaggtacgtgtcgttgtgagggtattatttatttgtggaattgggatgataaagttattatttttgatattgatgggataattattaggtaggttttgttgatttggggtttatggtagatttttttgttttatcgtgggggtttttgggtttggtgttggtatttttgttttttttatgggatttgtacggttcgaattttggtgtagttggagttttttacgtagttttagttttttggtggtaattattgtgtttagggtttagttgtttttttttggggtattattattttttcgatttggttgtttttgtgggggttttttaagaacgtttttttgaatggtttttatttttgattgaataagtcggttatttcgatgtatgattagattggaggcgtttttttgtggattatttgttttttcgttagtattaattttgatgatttgagttttgggttttttatttagaaagaaagttgtgggttttgtttgtgttttttttttttttttatgaggtatgaatggtgtaatgaatttgaaagggatttttattttatttttttttttttttttttatttagattagatatttttggttatattttgtttatttttgggaaggattggatttattagggtatcgttaagttgtattataaagtgagttagtgagtatagagtttttgtttttcgttttttgtgaacgttggtgtgtgtatcgtattttgtatatggaattttttttgttttagtacggggtgatttgtagagagggttgtattttaattagggaggggtagtgggggttaggggtagtagtggagtttagagtgaaagtgaattttagtaattttaaatttgaatttaatattaagaaataaggggcgaagtataggggaattgattattaggagaatatagatggtggtagtattaggggtgagattgaggtttagtttatttcgagggatggtagaggtagttagttgaagaaataggagtttatatgttatatatgttaagtgattttttgtagattaaaaagttgtagattttaggtaagttttggcggcgttgtagattttgcgagttaattagtagggtatattatgtttatttggtttgtggagtgttttagtaagtggtttaaaatagaatagtgtttatcgtgggatttttagttttagatattagatgggagaggggtttttcgattgtttttttgtgttgggtatatgggttattttatttatattttatagagattttgaaaagtatataatattatttttgtatttagatgagtgaaattaattaggagaattaaagtgatttatttaaatttttattgttttcgtttgtttttagggtttagagttttgtagggattttttatgtttcgtttttttcgaaatatttttattttagtttgttaggtttaagtttttttttcgtttagttatgttttttttagttttttgtggtttagagttttttatgcgagtgaaatttttttttttatagtattttgttttttagttagttagagttggaaggtgtttttgtttgaattaggatagtgcggttttttcgtgggtgaggtgggtgagtaagttatatttatatttagtgagtgttaagatagtgttaagacggaagtgttaggtttatggtttttaattttgtttgtttatttttagtttatagtggtgatggtagggaatgggttattatttagagttgtttttagaattttgtgaatatagatgaatgaattgtatttttttgttttgtattcgtttatttatttagtattttttgagtgtttgttagtgttttattttagggtaggtgtttgggattgttatgaattaggtaagtttttgatttgggattttatgatttagtagaaaaatggcggtttggagagagaattttaattttggtgggattaaaagttttagattttgttgggtatatgtcgatagttttagttatttgggaggttgaggcgggaggattgtttgaatttaggagttcgaatttagtttgggtaatatagtgagatttttttttatttttttaaaaaaataagtatgtatattaaaaaagttttagatgttattttagatgtttaagtttattggtttgattttatttttttagattttatttttaaaaaattattaatataaaagttatgtatattttttaagatataaaaatattaataaaagaggttgagattatggaaatagtaaagcgtagaggttgtattatttttttgtttgtttttgttgtaagttatttttttttttaaaagtagaattattatgaatagtttggttttattttgttgaattttaaaaatttatttatatttttatatatatatatttatattatttaattatttattatattttttttgttttattttatgtaatatttattttattttttttgttattgggtagaattttgtcgtttagatatattatattttttttaattcgttttttattgatgaacgtgtaggtagttgttatttttttttttattgttaatagtgatgtagtaagcgtttatagataatgtttatgatatataatgtatgtataaataaataaagaaggtatatatatttagggaagtttcgttgtaaagtagatttttaggagtagaattgttgggttaaaggatgagtatatttaaagttttgattaatattgtcgaattgtttttttaaaaggttattttagtttgtgttgttgtaggtggcgtatgtgtagcgtcgtttttttatagttttattacgggttgattttttatttagaaggattaatttatttatgaggtgttttgatttgtgtgatattgaaaattgtatttatttttagttgaaggaaagaaatttttatgggttaggatgttgagtagtgtatagttgatttatttggtttttggaatataaatttatttttgtttttattgtaatattaaataagttttgttgttttttaattttttttttttttttggttttgatttgttttttggtttttttagaagagagatttttttgaaaaataaagttgtgtggtttattgaagaatttttgattatttttttttttgattggttggtttagaatgagtgaaatttgtttgtttggattcgtagatattgttcggagtatgatgtgacgtggagatttaaatttttgtttgtttattgagttggatatgtgtgttgttcgcgtatttagttaggtttgtgtgatttgtaggatggttagggtttttgaaaatttatttttagggtagttttttataatttttagggttttttgtttagtattgtaggaggaggtgttagttttttgatgtggtatttgaaatttggtatttttaggttttagttttttgttaagtttttatttttagttgttgttttttagttttttttgttttaatttagcgattttgttttttttttgtattttatttttttttttttgtttttgtttatgtggcggttttagtttgatatggttttttttttgattttcgtttttttatatttttatagtttttaatgtttggtttaaatgttatagtttttaggttataatttgtgattttagttagttttggtttttttttcgttttcggatttgttggattttatgtggatatcggagggtttgggtttggtttgttggtttcggtttttattatggaggatagtttggatacgatggtagtttttagagttaattattgatgaaagtaatttttattttagtaggtttttttaagtttttttatacgagggttttagtagttattattgggagatttgttaggttaagaattgattaaggtttgtgatttattgttttagtgatttttattatatttttgaatttgtattgtgatttttagagaaatagagaaatgatttttatgttagggtattagggaaaagatgtcgtttatatgagggtttgtggatttttttttgattttgttttttttaaatttgggtacgatttatattttatgtattgtagtatttgtttaatgaaaaagttaatttttagttgggtatagtgattaatacgaatagttcgagtattttgggagttcgaggtaggtggattatttgaggttaggagtttgagattagtttggttaatatgttgaaattttatttttattaaaaatataaaaattagttagggatggtggtgggtgtttgtaattttagttgttcgggaggttgaggtagaattgtttgaattttagaggtagaggttgtagtgagtcgagatcgtattattgtattttagtttgggtgatagagtgagatattattttaaaaaaaaaaaaaaaagagagagcgagagagagagaaaaagttaattttgtagttagttatttgtttgaaataatagtgaataaggataattttgttttttgttgaatttaatgatttgtttggatttagttagtttatgaggaatgatttataaggttaattgttattttgtttatagagagggtataaagttggtttgagtattgatgaaatagaataaatgtaaatggaagatataggaattttttttagatttaggtgtatttaaaattagaaggaaagttaagaaggattgttgtttaaaagatttagattatttagttaatgggttttttgaggtttaaatttgggtaataattgtttgaatttttgattttattttatatatgtttttatatttatgtaattagaagttagtgtttttgtgatttagaaaaaagaatatttatcgtgtttttcgaggttcgttagtttcgttggggtttaggtatgcggtgttttaagttagtggattgaaaatgagaggtatttgtagtagatttgttagggttttttttttttggagatggagttttgtttttgttgtttaggttggagtgtaatggtatgattttggtttattgtaattttcgttttttaggtttaagcgatttttttgttttagttttttaagtagttgggattataggtatgtgttattacgttcgggtaattttgtatttttagtagagatggggttttattttgttggttaggttggtttcgaatttttgattttaggtgatttatttattttagttttttaaagtgtggggattataggcgtgagttattgcgttcggtttagattttttttttttttttgttcgtagtagttattttttttatgttagtatttttttgtttattgtagttattgttttttgttagtaagagataggatgatgcgagatgataagagataggatggaaggtttgattaggagtcgggttaggattttagaagcggtagttattagtttattttgggttttgggatcgagtattttttttattttgagttttgttttttttttttgtaaaatgagattaggttagatgatttttgaggttattgttaatttaggaatgttttgtttttggttgtgtggattgtataagggtgtgttttgtttttttaagttaaattttagtttaaatttagagggagtttttagattttggttgtattaggagttgttttaggtgtcgtcgggggtgttgagtagtttttttttttaagaagtttgtggttttgtgggaggagatatttagggttttttgtaataaggtagtgaggggtagatcgagtgtgaaagatgttggtttttgttggatatatattaggaagttaattttgattgattagaggtgttagaggaggtttttgtgagaaggtggtatttagttgagtttttatggaggagtagggttttaaaggagaggaaagtttattataggtggaagtaggagcgagaggggaggttgggagacgagtaggtattgggtgggtttattgaaagggagatttcggtgtagacggtggggtgggtaaaagatgaagtaggaaagtaggtaggagttaggttgtagagcgtttgggaggtaatttattaagtttgagtggtgttgagttttttttttttaaggtggtttgtgattttttttttttttaggatggtagatggggttatagagttttttttttttatagtagtggtttttaattgacggatatatggtagtgtttagagatgtttttgatggatataaaggggtatgttgttgatttttagtgggtggattcgggatggtgtcgtatatttgatgaggtggtatcgtgggggtttcggtttttaatagatatttttttaattttagatgttagtgttgagaaattgtagtttagaagtttgtaaaatgttttcgaaggtaatttttttaaattatttaaattttttcgagttagtgttttaagagggatgtagagattaggtagaggagaaaatttgtattaagtttgggtatggattttttttttttttttttttttttttattttggtgtttttttagagttttgttttagttgttgagaatgttagaggaataggggtgatgtgtgtatcgtatttttatttattgatattttttatttttgggttttatttgtttttttgggtattgttggttttttttaagtattttttgtttttgtggggtagggttgtgttatgttttgtgcgtattttaagtttcgtgtgtagtttggtataggagtgtttagtgagtgagtgtgtattgaagggatcgtggaaggagtttgtgggttgagtagggatttgggttgggttggtttgtgtggtatgttttgttatcggttgtttttttgagtgaggggttttttttgtgaggggtattatggagatttagtgttgtttgagtatttggtggggtatttgttggtattgtagatagtttttgttgaaggtaggagggaaggtttttttattagtagtaaatattttttttattaggttattttcgagttggttttttagttaagtttagttaggtaagaaggttggtatgttgatagtaatttagtggtatggtttaattgtgaaatatatttgataatttagttttgagtgagattagtattttagatttttgtaggtggtagtttttaggattttgatgtgaagagttatatatggaaatagtgatttttttttaaagattgtatgaattagatggttaaaatataaagatatttagaaattaaaaagattggttgggcgtagaggtttaggtttgtaattttagtattttgggaggttaaggtaggtggattatgaggttaagagatcgagattattttggtcgatatgatgaaattttgtttttattaaaaatataaaaattagttgggcgtggtagtgtatgtttgtagttttagttatttaggaggttgaggtaggagaatcgtttgaattcgggaggcggaggtagtagtgagttgagatcgtgttattgtattttagtttggtgatatagcgagatttcgttttaaaaaaaaagaaaaaaaaagaaatttttaattttgtttgatttttagatgtatttttgtattttagataagttgatatttttagattttttttgttttaaaatttttttattttttagttttaaagaatatgttattgagtaattttcgaaataaatttattggttattataaaatatttatggtagaataatatgttggataggaagtgggtagtttatttatttatttagtaaatatttattaaatgtttgttatatgttaagtattgtttttggtacgggggttgtagtaaagaatgggataaagtttttgtttttatggagtttatggatgaatgagagatatagtcgaatgaaggattataacgttatattagtgattagtgttaggaggagagggaaggtagagtaagggttagtgtttgggtgaggagtgagggggtgtgtgttttatcgtatgggggaggttaagggaagggttttttggagaggtgagatttagtagagatttagatgaggtgagggtataagtagtttttgtagattgggggaaaggtgttttaggtaggaggaacggtatgggtaagtgttagcgtagatgagcgtggcgagttggaggaaggatgggaatatttgtgtggtttgttaggagtgaggagttggatagttattgtagatggggttggggttggagagaaaggtgggggttaggttttgttggttttataggttatagtgaagggtttggacgacgtttgtgagaggttgtagttttaggagggttttgagtgtgagtgggttacgttttatatttttttagagtattacgtggagtcgggatagtagtagggaggttatttaagattgtcgtagtaacggaggttaggaggttatgcggtgtggacgtggtgggagtattgggtggtgtcgagggtggagtagaggggatttgttgattgtgtggcgtgggggttgggggtaggtagatattaacggggtttttgagggtttgacgttatatttgggttaggagagtgttatttgttatttgtagtgttatttgtaataggggttttcgaggagtttcggggtgagttggggaggagtcgttgtggtgtgtgtggttttggaggtatttattttggagtgcgatgagtattgtggggtttacggtgagtacgtattgcgtagtgggtgtaatgtggagtttatagtagtttgtagtttgggagaggggtttggacggggtttatgtatttgggagatattagtgtatagatagtgtttaaaatttttgaataatatgttttatttaatttaatatatttaaaatgatattatttagatatgtaattaatatgaaaacgattaatgaaatatattatattttttttttttttaattaaaaagtaaattttaatgtcgaaaatgtaaatttggggaagatagaaaaggttatatatagggttgttattttatatttggaaggttgtatagcggtcgggtagaggtgttttttattttttagatagggcggcgtatatttttttttttttataatagattttgaaatttggtatatattttatatttagagtatattttattttagatattaaatttttgatagttaaaaaaagtgaaatggggtcgggcgtggtggtttatgtttgtaattttagtattttgggaggtcgagacgggtggattatttgaggttaggagtttaggattagtttggttaatatggtgaaattttgtttttataaaaaatataaaaattagtcggcgtggtggtgtatgtttgtaattttagtaatttgggaggttgaggtaggagaattgtttgaatttgggaggtagaggttgtagtgcgttaagattacgttattgcgttttattttgggggatagagtaagattttgtttcgaaaataaataaataaaaaaaaaaagtgaaatggatttgttaacgtaataaagttgtgtttatagattagttgtttttttagtttagatatggtatttggagttgtggaagtgggtgaggtttttaggttttttagggagtgtggggggtgtggagaaatgaggtttgagaattttgggcgtttgtgcgttttgaggttggtagagttgatgggagtaggcgagttgttgtgtttgggaagcggtggttgttgaggaggagaatattcggatattttggagttttgggagttgagtgatttaggtgttttgggagaaggaatgagttttcgaggtagatgttattggggagtttatttttataagaattgagagttgatatttgggtttggtaagatgggtattagggtgatttgtgtagggatagtaaggaagggaataagagaataagagtttgttaggagtgtgaggagaggaaggaaagtgaagaagtggatttaatgtttgtagttagttttttggaagaattttgttataaaagggaatagagaaatggtattttagttagagagagattaaggatgttttggtgtgtgtgtatgtgtgtgtgtgtgtgtgtgtgtgtgtgtgtgtgtgtggttgttttggtttggtttgttttaaggatgaaatgagagattgtagaatatttatgtgttgatgtgaattatttaaaagagaggaggaatttgatggggtgtgtgtaggggcgaatgaagtaaatgttggagtaaagtgtgtgaattggtaggtggttgtggttttgtcgtaggggttttagttaagagttgggattagggggagtataaggggtttaagcgtaggtaggtgagttagttttatttatttgaattttagtttttatagtagtaaaattaggggaaaatatttatttagttatgtttttttgaggattaaataaagtggggaatgtaaaagtatttagtgaattatagtgaaatgtatttaagtttattttttaattgtaagtaagattttgtagaatgtggatttttgtatgtgggggaatttgaaatagtgttattttttatagaatagatatggattaggatttatgaatgtagaaaggttttattttttgatgttatgaaatgtgaatgttttatgttttttaggaatggatataaatttttttattgttttgttcgtgttatcgggatggcggatatgacgcggggttatttgtattgggttaacgagaggggtacggtgttgttttaggggtttttgttgttgagttttagtagttttttttttgttttgtataggtattaggtttgttttttgtatttttatttgtgagtttgtttagattcgttttttttttaattgtaagttttgtaagaatagtttttttattggttttttgttttaatatttatgttttatagtaggtattagaaaaattattttaaatataggtttatatttgtattggttttttatggtttttaggtcgagtttagatttaggagtttggcgtttggtggttttttatggtttgcgtttttttttttttttaggcgtgtttttttcgtttttatattttagtttgtgttttttagataattgtttttgtttggagtttttgtatatgttgtttcgtttttttgggttatttttttgttttatttttttttgagtggtttggttgaattttaatgttcgttggataatgagtttttattttatttttttagggatttttaagtggtttgtttgcgaattattattatttatttggtttttgatatttattatatttgttattttttgttttagatttttgggaatattgtttattttacgggttttttaatagattattggttagtttttgattatttttttttttttatttatggggttatattaaggtagttaagttagattaattttggttttttggagttggaggaagaaaatattggacgtttttgtagttggaggtttagggtaatttattagatattttttaaagtaaaagttattgtggttaattataggatattggtttttgttgaaggttgattgtaaatattataaatttggtttttatgaatgttattgacgtgattttgtttgaatttgaagattagatgaattgtttgttgttgttaattatgtaaatagtggaagaatttagatgggttttaaatgttgtgttgatttttgtgtatttttttttagttttgtaggtattttttttattacggcgttgttttgtgtaagtagtagttttttttttgtagtaaaagatgttaaattgagatatgtatattttaggggagaaaagttaggtataatttagtgtattttaagtttttagagttattataatagtattgattttaatagaaattttgatattttagtgaaattgtgtttttaagttatgttgataatttgtaataagttatttattagtttgtgttaagtagtaaggttttgttaggttaagtaaaaagtttatatcgttatttcgatattttaatattaattatgtatttaaagtgattttttttatttttttatttaaatattattgtttaaggtgtattgttttttttttgggaggaattattttaaaaattttaaattttatagttgatatgtttttttggaaggttaaggtgttttagtggtagatggttatcggtttggttttttttagggttgttattaagttagagtcgttttatgtgttagttgttttgtggagttttttagaattgttagcgaaggttgttttaatataaatgattttttttttttttttttttttttaattttattttaagttttgggatttatgtgtagaatatgtaggttttttatataggtatatatgtgttatagtggtttgttgtatttattagttcgttatttaggttttaagtttagtatgtattagttatttgttttaatgtttttttttttttttttttttaattttttgattggttttggtgtgtgatgtttttttttttgtgtttatgtgtttttattgtttaatttttatttatgagtgagaatatgtagtgtttggttttttgtttttttgttagttttttgagaatgatggtttttagttttatttatgtttttgtaaaggatatgagtttatttttttttatggttgtatagtatttcgtggtgtatatgtgttatattttttttatgtagttttattattgacgggtatataaatgattttttttagtataattttttaattgggtgtagttttgattttattgttaggttttgaattaggatgaaggaggggaaggtagtgggtggatatgcgtgtggtgtagttggtaaaaataagtttttagtataggatggtgattatttagtttttgttaggagtgttgcgaatgtttttttttagtttatagtttttaatgaaaataaatttagttttatgttattgaatgtattgttttttttgtagttgtgttttttgtgtattattaaagttttttttgatttgtgggtatgaagatagtttttttggattttatttgaaggtgttgtttttatatttaggtttatagtttattaagaatggatttatttaggtagaatgaagtaggggtgtagtttaatttttttttttttatatggatatttatttgtttttatattatgtgttaaaaagattgttttggttgggcgtagtggtttacgtttgtaattttagtattttgggaggttaaggtaggtggattacgaggttaggagatggagattatttggttaatacggtgaaattttgtttgtattaaaaatataaaaaattagtcgggtatggtggtaggtatttgtagtgtagttttagttacgcgggaggttgaggtaggagaattatatgaatttaggaggcggagtttgtagtgagtcgagatagcgttattgtattttagttttggtaattagtaagattttgttttaaaaaaaaaaaaaaaaaaaaaaaaaaaaagattgttttgtttttgttgtttcgagatgttattgtggttataaagtaagtatttgtgaacgtgtggttttgttttggggttttttgttttgttttattggtaaaggtttggacgaattggttaaggttatagtgttttagtttttatagttgtagaagttttttatttttttagtatcggaagtgttaggtttggttttttgttcgttttcgtagtttttagatttaaattttattaaaatatttaagattttgttatgagtttgattgaaattgtagtgaatttgtagagtaatttaggaagaattaatattttaaaattatattggattttttaatttaagagtatagtttattttttatttgtttaggttttttttaatatattttagtaaagttttataattttagttgtaaaggtttggtatattttttgttagatttatttttagatattttatattttaaaatttgatttaaaatattatttatataattattttttttgtttgtttttaatgtatgaaaatgatgcgattaatttttgtattttttttttttggtatattgatttgttaattttattagagtttttttaattttggtaatttatgtgtaggtttatttttttaatgtgtatatttgttttttgtgatgataatttttttttttaattttttttagtatgtataatttttatttattttttttatattattgtatttgataggataggtaatatagtagtgaattgttatgatgatatagattatttttattttattgttaataagatgtttattgtaggtttttttagtatttttttttatttttggttggagtttttatttggattagatgttaaattgtattaaattttttttttaaatttaagtattttaaaaaatgaattttaatttgggaggtaattggtattaaatattttttttgtatttattgagatgattatgttttttttttttaatttgataatgtgttatattgattttaaatattaaattattattttatttttggaataaatttagtttttatatattgttataatttgtatatatatatatatatatatatatatatatatatacgtgtatatatatattttagaatttttgtacgtatatttataaatgagattggtttatattttgtttatattttttttttttaggttttgtttttaaggttatgttagttttatcgaattaatttggagatgtttttttttgtttttatgttttgttattttttgttttttggatgattaggataatttttggtgaaatggtttatttttggtgtttttttttgtagaaagatttgaaagtacgggtttattttttatttcgtgtttttttgggatgttttagttgtttgatatatattaaatttttgaagatttgagtttttttagtgttgcggtagttttgttagttaaaaatagtttgatgttaaaggaagtttagttttttatgttaatttgttatttatttgtttaatagagaagtgattgaaaagaagttagaaaagtttaaagtttagtgtttgatagatattaaaaatttgtttttttttaatatagaatttttttatgttgtttttggaaatcgattagttgtaagtagtagattgggtatagaagaatttttgaaatgattgttttttttggttgttgttatttgaaagttttattcgagaattatatgtagagttagatttttattttagaagtagtagtttggtgaagagttatttgtttatatttaaaggtaaggggattataaattattttatggtttttagggttttttgaaggttggcgggtgggttaaagtttgagatatgggatttaaaattttaaattttaaattatttattaaagtagtaaagtaagaatatttaatcggattagtttttttttattagaagggaatcgtaaaattagttttaattataatggcgaatttagtattttacgttttaagtgtttagtgttgtttcgtattatgaaagaagcgttttgagattttgtatgtattgttcgtatttattggaaagttaagtattttagagaatgtagttgggtattaattgttttattagaaagttttatttttgaaagttacgagagatttttatgaagtaggaatatgggttaaagaataatttgaaggaatgttagaattgcggggacgtggtaggttgttttttttttaatttagtttttgaatagatgagggaattgaggtttagagagtaaaattaattgaatagttttttattaaaggatatttttttattgtattattttgaggtagagttttggttaatgaaaatttgatattttattaaattagaaatattatggatttgtttttataatgaatttttttttaatgaatattttaaattatttttattaaatataggatgtgtatttatataagtaagtaggagtgtttttgaatagaatatttatcgttaattttaaaggagagttggtataggaatatgtaaagattaatattttttcgtgagtattgtatatattttatgtgattatgatattagtattattattttaaaacggtgttttttagtttgcggtgtatttttttttttttgttgtttatatgttaatttgtaatttttataatgaaaaaatgtattttaattttttgtattttgtttaaaatataatttttagataattggaattaaattagattttttttgggtttaaaatttaaattcgtggttagagtttgttatagaatggaattgaatgaatttgaaaattagtagtttagatttgttaagttaggtttgaaagtttagaatgtgaatgagaaatataattaaattgaaatatgtgaagttatatttaaagatgaggaattgtatatttttttatatattaaatgttttttattagagatattgttgtgtaattgttaagaattttttttatatttttggttaaagtttagtttttttgagtcggtgggttaaatgggattattttttttaatgaggtatttttgtgtgtttagaattatttttgattttattttgtttttttcgggtttttaatttattaggatggagagtatttttttattttatgttgttgggaggttggtttattgggtgatattagtttaggtcgatttttgtttttttgttttgtttattttagagattatattttttttggtttggtttgtgtagatttggaaaagagtttttggtaggttaggtacggtggtttatgtttgtaattttagtattttgggaggttgaggtgggtggattatttgaggttaggagttcgagattagtttgattaatatggagaaatttcgttttttttaaaaatagaaaaattagttaggtgtggtggtgtatgtttgtaattttagttatttaggaggttgagataggagaattatttgaattcgggaggtagaggttgttgtgagtttagatcgtgttattgtattttagtttgggcgatagagttagattttgttttaaaaaataaaagagtttttggttttagtggttttagatagttcgaggggtttttttttatttggaggagttagattgggggagtttggttttaggagatttttaaggattggttttttttatgtagtttttgtggttttagatagagagataagttttttttagggtagatttttatttttaagatggtttttaaattagttggattttaattgagtgttaatagggtagttttaggttaataggagttttggggttgttttataagattttttttattttgtagttatgttagtatttaagtagtttttaaggtttgtgtagagagaggggaggttggagttaaggttttgtttttttttgtagaaggcgaggtagtgttaggttgttttttgattggtagaaaaatagtaggaatttgattttttttttaatttttttttgcggtttttgttatttttattgttttaagtggttgattgtgataatgtttcgtttttattttttttttattttttaggttggagaggatttattgggtttttatttaggatttgtgttatagtttgtttttatgttgttaataaagatatggatttaaggttgggtaatttatataggagaaaggatttaggttgggtacgatggtttatgtttataattttagtattttgggaggtcgaggtgggtggattatttgaggttaggagtttaagattagtttgattaatatggtgaaattttgtttttattagaaatgttaaaaaaaaaaaaaaaaaaaaaaaattagttaggtatggtagtttgtatttgtaatttaattatttggaaggttaaggtagaagaattatttgaatttaggagacggaggttgtagtgagttaagattatgttattgttttttagtttgggtgatagagtgagattttatttaaaaaaaaaaaaattaaaaaaaaaaggggagattttataattatggttaaaggaggtaaggaggattaagttatgttttatatggatggtagtaggtagaaagagagttcgtgtagggaaatttttttttataaaattattagattttatgcgattttattatagggatagtatgggaaagatttgtttttatgatttagttaatttttattgagttttttttataatacgtgggaatttaagatgagatttgggtggggatatagttaaattatattaggattaaaaagaattttgaattaatgagacgttgtttaggaatgggaaagtggtaggttttgttatgtacgtatggaaagagggattttagtatttgagagggtttggttaggtggtttttgcggttattgtattgattgaggttttagggttaaaatgtatatttcgtttatggtttggtttagggtggagttttgtagattttatttattgttaggggatgttgatattttatatttggattggaggcggggttgtttttgtgagagagtaaatttttttttttaggaagtttatatttttttggcgttgaatttggtatagttatttttgagttaagtagatgtttgttatttagaattgggatagttatttgaaatgtttttagaggttggggttatatagcgggagtagtttagttttttttttttttcgtttgcgagtgtttgtgcgtaagttttgtttgtttgggaggagtattgtgtgtggaggtcggtttgggggaggcgcgtagatggaattcggtttggtcgtttagggagtgtgagagtgggtttggttttagtgtatcgcggttttgtagttaagtttgtagggaggggttttgttgtcgtagttataaattttagataaataagttttaaagtcgggaggtattttaaaaatttgtttgtttgtttgaattttaaggaaagatataatttttggttttgtattaggagacgttatttttttattttgtgtaagtatattgttttttataagttttttggaggttttttattaaatatatatattcggttttatttagtatattattttatattttagaatatgtatatttttggagtttggattttggaagtttttttaggtttttagtaatttggaattagatagtgattagtgattgttaaggaggaatttggggatggttggtagtgggttgggtgtgttagaattttagtttggaggtgtttggaggtttgaatatgtatatttaatatagtaatagtaattttttttttatagtataagttatagaaattaatatgtaatatatttttgggtatgtaaataaaagagagtaagagaacgttgtaggaagtattgggaagttttgttttaatttagttttatagattataaagacgaagggttttaagagggtaagataattgtttaaggttatagtaagtaggagagttcgggttttttgatcgttatgttaattagggtttttttttttaagacgtgttgataatttgttatttagatatatttgagtatttagtatatattattttaatgttgtatatgttattttatttaaattatttttaaaattgtggtatagtttttatttttttttttttatagtggaggaaattggtttagagaggttacgttatttgtttacgattacgtagttagtaaatggtagagttgaatattaaattaatgtttttttaattttaggatttagtttttttttattatgtaatgaagtaatttttgttaggtgttttaaagatgtgttttgtttgtgatttttttttcgatgttttatatgtgatttttgtagtaggcgttattttatggttatggtgatttttttttgtcgttttttgtttggttgtattttttttatttgttttttaagtgaagttaggttttatttattttttttttagagttttttttgatgttttgtttgtatattttttatttttattttttatttttaattaatcgataataaattattttagaatgatttgagtcgtgtcgataagtaggcggtttgttttttgaggttgtagattttttttgatttttacgtgtagttttgggtgtatagttggtatcgtttagtgttagtgataatgtttttttttttttaggtatgtgagattttgtgaagtagtcgattacgttttttcgttgttgaaaagaagttattttttagattttttttgttcggatatttttagtaattttattttttggagagagttattgttattttttgaaaattaggatatttattttgttttagcgtaaaatgttttaagtagttttttgttagtagtgtagagtttggttgttatttattaaaggataggttttttcggagtgtatagttttatttgggagtttggcgcgttattattggtttgatagtagagagaattgagaagtattttttttttgttttatttcggggttgatatttttaagtaagataggaagggagtattttttaggttaggagttgggtgtatttgtatcgtgaaaagtattttttagttgtggtttaatgttagttacgacgttgttttttcggtttgttttagtaagtagttattggtttacgtgtagtttggggttgtgaaatttaggtagaaggcggttgtttgagggttgttttcgtttaggatagggttaatcgaggaatgttagatgtgtacggtttttggtaaagtagggggtatatttttattatagtaatgttagtgttattattttttgaatatagtggggagggttgtgaaggtttatgtgatttggatttgaggtttttgatagaaatttggacgttatcgggtttaggtttggttttagatttggttttgtggatgggttttttatagtatttgttgattagttttatttttaggtgataaatttttttttaatttttttggttaaagatagtttattttattggtatatttttttttagtttttgtggtttaaggttggaatatttatgttttaatatatttatggtagatatttaagaatgcgttttatttagtttatggtaattttgtaacgttttagattaaaatgatagtaaatattattaaggtagtattttgaatgagtttgatattgtcggtttttttttatttagcgaggtggtgttgatagtgtggatttgagtatatttatgttaaatgataatgatattgatttttgttgggagttttttaaagaaattggttggttttaagaaaatagttttaagaagtttaattatatttttttagatattatgtattgttttattttgattaggttattgtgataggtatttatttatattttttttatattattgttattaatatattaaaaagatgtatgtgttagattatcgaaagggttttatttttttttttttatagattgatttttttttggaatttttgagttatttattttttttagttttttttatttaaattaagggtaagcgaaaaagtaataatttggtattttttaagtttatagaatgtgatttttttatttgtttattatattggttcgtggatagaataatttgaaaagtgaaagaattattttggtaaaagattttgttttatttttcgaagtattatttttttaaagagtgttttattttaacgattgaaatatttttttatttaaattttattgttagaattataggaggtaaaaaatggaacggttgaatgaaattttattttttttgtgaaagaaaatttatagagttgttgttttcgttgtagttggtgggtttcgttagtattggatgtttttgttaaatggtttatgtggatatataaaggtaaatagatttgttatcgatcgtagatttttgtagaaatacggatgtgtatgtgtagatttttttttgtaggtattaaaaataattaaaaatagttttgtttgaggttgtagtgagtcgagtttgtattattgtattttagtttgggtgatagagtaagattttatgttaaaaaaaaaaaaaaaaaaaaaaaagttttgttttaattaatttttttgcgtttgtttattagtaatttaaagaggttatatttattttttatgtaatgagggtatttttgagtgaattttaattgttttgaattaagtataagtttatgggtttgtaaaggtttagacggttttttttttgtatttaggaggaattttggttgcgagaatggggggatgtattttttatgtagttggtatttaggtagttttttgtagtagtatattttgtaggcggagtttttagaggatgtaattttggatttcgaattttgatgtattttaaatttttatattattgtattttgaaatagagtatgttttttagaaagttatatttttagatttgtgttaagtttaatgtgagttttggtaaggttggtatattaatatttgttttttggtttttgaaagtgagatttgtatatgggttgtatttacgtatatacgagttggtttatttttgtgtatatgattataatttagtgatgttgaggttatgtgttggaatgttgtatttggattatatattttaaagttgttttatggaaatgaattttatttagtgataagttattaaatgtttgttatatgtgatgaagataaatatgtatatttggtatagagaaaaatatatatttggtatattggagaaaaataattatatttttaaagagaattttttttgtaattttatgtttggattattattgtaagtatattttatttgtatttgatttgtatttgtatatgttgatgtaatgataaaaattattgtaatattttattgtgttgtattggatgtaaagttagaaaatattgtaataaatgagatcgatgaaagatttttttgaaaattaggtgtgtgaattttaaatagtttttggtaagttattaagttgttgatttttttggggtgtgttattaagtatattttaaaaaaaatttttaggttatgaattgtttattatttggaataaatgttttttttgatgttttagatttaaatgggtaaaagattagttttttttatgtatttgttggggacgggag

SEQ ID NO: 61 - DNA, 81992 bp, Homo sapiens
gtaggaggattgtttgaggttagaaggtgaaggttgtagtgaattgagattgtgttattgtattgtagtttgggtgatagagtgggattttgttttaaaaagaattggtttggaataatatttaaataatatttaaattttttgttttggtttataagatttgaatatttggtttttgttttttttttagtttatagtattggttttaggatttttgtatttgttatttttgttttttagaaagttttgttttttttttatttttgtagttataggtgttttttgttatttagagttttagtttaaatatgatatttttttattgatggaaattattttattattagatgttatgtggtttattgtttatttgttgtttgttttttggttggagaggtgtagggagttgtttgttttttttgtttagagttattgttttgtatttggattattgtttggtagaggtgggagtggaggttgttattattaggatgaaggataggggtggtttggtgtggagaagttaagaagagatggtgataggttaatgtgattgtgtttttaaggtggaagaaatgaagggtgagggttagtaaagttaaggatgggtttagattttgttattggtgataagtgggatttataggattgatgtgattgtggttaggttttgggtggtttatttggatttttatttggttgttttttttttgtatttttttgtttttatttttttagttattggtataggttaagttagagtgttgaagaaatatatgagtttggttttggaaaggaaaattagaaaggtggtttaaggggttttatttttaggaatgttaagataggtggttaggggtgagtgggtagggttggttagtaggttttgaaagtagttgggttattagtgtgttttgagttttttttgtattgttttgtttgttttgtttttgttttttgtttttgtttttgttttgtttttgaaggtgagttgtgttgatagttggtggtgggttgggtgtttgtaatataaaggtggttatgtgtggtgttgtttggtgagtagttgttgtttttagttttttgttgtggagtaggggttgtagttttgggttaggtggggtggggtgtggtgttggggtgttgaggatgtgtggtgaggtgggggtttggttttggggtttgaggattgatggttgggttatgtttttggggttttttatgggaagtggtttgggggagggaggtggggaaataggttttggaggttgggagggttttgtgagtattttttgggtttggtttttttgatgtgttgtgaggtttggtgtgggtttggtttggttgattttgagtggtgtaggggttattgggggttgttgtgtagttttagaattgtggggattagttttagttggttagtgtgggtgtgttttggttttgtgtgattatttttagttttgtgttggggattgggatgagagttttttttttttttggagttaggattttagtgttgtagttgaggaaattgaggtttagggaggttgatttttgtgtttaaggttatatagttgttgggtggtagggtaggttgagtttaggttggaattttggtttttatattatagtttttttttgtgaggtttttgtattttttttgtagtttaggaggtgttaggtttagtgagttttgttagttgtttttgtatgtaattttattatgggtaaggttaggaaaatgtaggatgagaagtaatgttttgggagtaatttaagtgttgtggagttagagtaggtaatttgtgtggttagtagttgttggagaaagtagatgttaattttgtttttgattagtaagtaggaaattaattaagataattggtagtattaatttggagatgttttagaatttggtagttttttataggatagaagtgttttgggaaattaaagtttgtagttgtttttttaattgggggtgttgtggtatggtggtttaggggtagtgattgtgagattgattgtttattttttgttttgtaatttgggttttattaatgaaagtaagtagttgaggaatgtatagtatttgagaaataagtatatttatatatgaatattttttttgtttttagatttttgttgaaaggtgtaatagttggatttatgattatatattttgatagtattttatgtttgttagtatttgttattgagtgtttttgtgtatgggttgtgtgttttggtgtttattatttttatttgtatgtggggttttgtggttttgtggagttaggtttggatatagttttggatttgggttgggaggtttgggttttgtttgagttttgtgggattttgagtgagtttttttatttatttaggttttgtttattagtagttttttttttttagaaaagtatagggggataaggggtggatttgttgagttttgtggtgtgggagagaatgtgagggtttaggtgagagattgtagggatttttggttgtaggggggattttggaagtgattgagaaggagtttgttttggattaggtggggataattggtttggtttagttagaaggaagtttgtgggttttgtttttttgttttttgtgtggttagttgtataaagggtttagaatagatggtaggggagggttaggagatgaaaagatattttagaagaaggttttgaggttattgtggtttgagatgtgttgaggttggtatagagtattgggttttgtagttgttgttttgattatttatagatgtagaatttgggtagaagattttaattttttgagttttagtttttttatttgtaaaatgaagggataattatatttatttataggattgttgtaaaaattaattgagataaaaaagagtttttggaatataatatggggtttatgaattattgtggttgttatgattttaaagtgttatagggtgttagtgaggaggggttttttgtggggttgggatagttttggttgatgttggtttttgttttgtaaattatttttgtgggatattttttttttttgtttgttattttttttttggttggtttttttggattatttgtgtattgggtttaaggtttaaaaggtatttaaatgaggttaattgatttgggtaagtttgttaatgggggtagttgaggggtataggtagttttttttttagggtgggagggggttgttgtatggatgttggtagtttttggagtattttgagagatatttaggtgttaggttttgttaggatattgaggttggtggtttgatttgtttgtatttgtatttttttattggtagtttgggtgtgggattttggagtttttgaggggttttgaggaggaagtttttggaattatttattagtagttttggggtttgttttttgagaagggtaaagttataattttgatattttattgaattttggattaatgtattgtataataagtttatttatttaaaattggaatggggtgtgtggggaaaaaagagttgggataaaatttaagtaaagttgtttagtgatgttataggttttttatttagaagaggtttaggtgtttattggatggttgtttttgaaatgtttgttttttgagttgtgagggagggtttggagagagagaggggtttatgtttgtgtgttgaggggatatatttatattggttttgttttttgattagaggatgtattagtgtttgaagggaatttgtgttttttaggaggttatattgggttttggggttgttggggtttgaagtaagtgttttgatttttttttttgtgggttttttttttttttttttttttatagtttttttttgtttgtttttttatttgtaatttattttaataagtttttagtagttggggttggggtggggtttgtgtagttagggatatgttgagtagtgagtttttgtttgtagaaagttttgggtttgggttgatttagatttaggttgatattttttataatgaggtatgtggtttaggagttttaaaattttagtagtgtttggtttataggttgttttgtatattgagggatgtagggtgtgttgtgttgtttttatttttagttgagaggttgggaggaattagatggattgggttttattaggagagaagttagaagtatttttatattggtggttatggttatagggttatggttatagtggattttttaatttattgattaaatgttgtgatttttgtaataatttaaaatttttggttgatgttgaatgttggggttttttagaaatagttataggttgttagaataggtattttgttttgtaaggaggtttgtttgtttttgagtgtgagttgatttgtattggtttataaagttgattatagattttgtatgggagatataattaatatttttatttgtttgttggtatgtatttgtgttttttttttttttttggttttgttttttggaagtttttgtatttttttttttgttttttgttttttagttatatatatttattttttgatgaagttgttttttgtgtttatggattttattaggttgtaggtttttagtttataagataggagataagtaataagggttttaggataatgggtattagataagataggtgtttagataattgttttggtaaaataatgttttattattggattttgtgtaatgttagaatgttattagttttggggtggtttttttgggtttagattttgggtaaatgagaatgtggaatgtaggtatagtttttaaatagttttgtatttattttaattagtaatattttttgtttttgtttttttgggaaggtattatttaaataggtgatatatataaagttttttttggtaagagatgttatttaaagattggattttgtttggaattagtttgtggttatagaattagtatgtggtttttatttggtgtatgtgttttgaaaagtattttatatttattgttttataatagttttatgaggtggttgtgttgatgttatttttttttataaaatagatgtgaaattgtagtgtagagagtttagtaatttgtttttgattatagagttagtggaaggtggaggtaggatttgaatatttttagagtttgtgtttttatttgttgagttatattgttttttaatagtgttttggaatatttaggtgatatatgtttattttttaattgttggggtgtggtaggggtggggggtaatatagaaataaagttataagggtagagtattttttttgattaagatatgaatttggatagagggtttttgaaagtgtgtagagagaatgtgttattgggtttttgaaggaaaagaatgttttgtttttaattagtgagttaaataattaagagttaaaggattggagttaaagttttgggttgttttgtttagtatagttgttatattatatttagatgtttatatttatttttatttaggttatttgtattttttggtaggaatgtgagaataagtgttatttggggttgtggtatttgagggttgtaaagtgttagtgttggaggagttgagtgattatttatttgattttttttttaaagtaggagtatttttgtttagtattttgttttgttttagtggttttagtgatggagattttgagattgagtggattagagttttttattttttatttttagttttttgaggttattaataattgatatgaaatatatgtagatataaaaaatataagttagaaagtaatattatgggaagtatttatgataaaaagtgaagattttttttttttttttttaggttggtttttaggggtgaattttgtgaattttgttttgtatgtattttattttagaatttttttatgtatattaaaatatgtataaatgtaattttttaaaaatgggtttagttgggtgtggtggtttatgtttgtaattttagtatttttggaggttgagatgggtggattatgaggttaggagattaagattattttggttaatatggtgaaattttgtttttattaaaaatataaaaaaattagttaggttggtggtaggtgtttgtagttttagttatttgggaggttgaggtaggagattggtgtgaatttgggaggtggagtttgtagtgagttgagattgtgttattgttttttagtttgagtaatatagtgaaattttgttttaaaataaaataaaataaataaataaaaaattataatgggtttatattataagtatttttgtatttgtttttattttatatatatatttttatgttaatatttatggagttatttttttattattttattattagttttataatattttattttataatgtggatggtttataatttattaagttagagttatatagatattaagttatttttgattttttttattataattaatgttatagttattgtttttgtatatggattttattgtatttgtataattagtttttagtggtatagttgttagggtttgttaataggtgttttaaaagatgggtattgttatattgtttattttatttatgattttgttagtagtgagtgatgatgtttgatttttttattttttatgggttttggggttttaatgaaatgttttgattttggattatttgaaaggttttttttgatttttgtatttttaattatgaatggggttgaatattttttttatatattattggttaaatgtgaattgtttatatgttttgtttatttttttttttgagttgttttaaggttattttttttttttttttgagatggagttttgttttgttgtttaggttggagtgtagtggtgggattttggtttattgtaagttttgttttttgggtttatgttatttttttgttttagttttttaagtagttgggattataggtgtttgttattatgtttggttaattttttgtatttttagtagagatggggttttattgttttagttgggatggttttgattttttgattttgtgatttgtttgttttggttttttaaagtgttgggattataggtgtgagttattgtgtttggtttttaaggttattttaaattgattttaattttttagaggtggttggtgttggtaaaaattgtggggttaggaaagttgtggtaggggttttgaattttggtagttttaagaaagtagtgttttttggtaatttgtgaagtttggagatggattttgttaattttggaataaatgtggaattttttaatttaattgtgaggtaagaaattatgtgatttttgttattttattttgatagtgtttgtagtgttgttttttttggaattgtatgaaattgtggttgtgaatgttttggagtgtttgttgtgtgttggagttttatagatgagtttaattatgggaatgtttttttgtttttgggtaaggagggggatgagtagggtgggggtgtgttggaggaggagatgtttgttattttgttattttggaagtttattgtaagagttgtaaaattttttatttgtttaatataggtagggttttggtggtgggattttagggttggttgtttttgtttttttattatttttgttaggaagtattgaaagatttttaaaaggtttttgatttgtagggtttttgatttgtaggttttttaaagtatttttagtttttttagtgagtttttgtattttggatgggaatgttttatgaattttggtatgttaagaaagtttttaattttttagtaggtagtgatggatgtagagttgtgtttttttgtttaagaagttttttaaggtattttggttaggatagtttaattatagggatgttggtggatttagttaatttagatttggtagagggtagtagttgtttataagtgtgtgttagttatagtagggtgtgggttgttgtttaggtggtttgattttttgtttgtgtttttttttttgtattattttgagtttgagttagatttttttttttgttataggtaatttattatttttattaattgttgttaagtattagtttataatgttttgaaaagattttttttttgttgtaagtgtaaattataggaggaagttaatattatttataaattaattttatttttatgtaagttttattagttatgatattattttgggtattttttagaagttttttgtgtttttaaatgttttggatgaaaatttttatttgttttgtaaatttttaaggtggatgtgattttggtgaatattagtaatagtgtgatgtttgtgattttatttagtgttgggtggattatagatagagtttttaggtgttgagatattgattgtagtgtgtttagaggagggtggttagggtagtgagtaggaagttttaaaattgtttttgttaagtttagttggggagttgatagtgttttttttagaggaagggtgttaggggtggttatttagttgttttgatatgatttgttggttttatgagtagtagttaggtttgtatttgagagttgtaattttttgttgataataggaatatagataaggggtattttattttagagtgatattaggttggtttttgaattattaggttttttggatgtgttttaagtttataggtgttttttaagtatttgttgtgagggtagatgtgatagattgtgtttgttttttgggtagtgagtgggttttgggtagtttttttttaggaaatgatgaattatttggagttgagtaagtgttagagaagtttttaattatagattgaatttaggagggtgttttggtttttttaagtttttaagggttgtagggaaggttttgaataatggtttttgattttattttttgagaggttttgttagggagtggtgatgttgtgggtgagagtagttttgaaggtgttatatttagggttaattttgagttttgtttttgtagttattttttatgggaggttatgataataataagattttgtatgtgttgtttaggagtaaagatttttttaaattagttgttgtgttgattattgaggatgatagtttggtgggtttagttagagttattgtgttaatattttgtttttatatatatagttggtaaatgttagaagttaatatttatagttaggttttttgatttttaattttgtgttatttttgttttttagttttatttttaggtgttatagttgtttatttaaattgtttgtagtgaattttgtttgggagtattgttttgtgaaatttatgttttggtagagaataatttttgttgttttttttattttttttaatttttttttttttttttgagatggagttatttaggttggagtgtagtggtatgattttggtttattgtaagttttgttttttgggtttatgttatttttttgttttagttttttaagtagttgggattataggtgtttgttattatgtttggttaattttttttgtatttttagtagagatggggttttattatgttagttaggatggttttgattttttgattttgtgatttgtttgttttagttttttaaagtgttgggattataggtatgagttattgtgtttggttatttttttttatttttaaattttagtgttttttttttttgtgttttgatttgttaagttattttgagggtggtgggtgtattttgttgttttatattttggaatgttgtgatgggattaaaaataaaagttttttgtttgagatgggttttgtgatggggtaggtattgtgttagaaatgagtaagttttgtttttgtttttaaggagagaagatttatttggtagatagatgtttgtttagttatttgataaatgatagtaatattgattaagttattgttttggatggttgggttggagggttgaggagaaggttgaggttgaaagatagagttgtgtgggtatgtttatgaaggggttatatatttggatagttgggggaggaaatggaggaggtaggtggaaatttagatttgaggggtaattattgtttaatttttgtaagatatttagtttttttttttttttttttgagatagagttttgttttgttgtttaagttggagtttagtggtgttgttttggtttattgtaagttgtgttttttgggtttaagtgatttttttgttttagttttttgagtagttgggattataggtgtgtgttattgtgtttggtttattttttgtatttttagtagagatgtggttttattgtgttagttaggatgattttggttttttgattttatgatttgtttgttttggttttttaaagtgttgggattataggtataagttattatgtttggttatttagtttttaaagaaaggagagtaggaagaaaagtataagtgagaaagatgaataaaaatggggattgtaagagtatatttattgagatagttttgtatttgtatttgtttggttagttttatatataattagatgttgtttattatgatattattttatttttaaggagtaaatttataatgtgaaaatggatttattgttatgttttagataatgtgttttaggtaatgttttagttgaaggaattagaaagggaattaaaattattgttatttatttgtataataaatgagtggaatagtagatttttgaattgtttattaagaggtgtggattaaaataatttaaatttttttatttatttatttattttatatttttttgagatggagttttattttgttgtttaggttggagtataatgatgtgattttagtttattgtaatttttgttttttgggtttaagtaatttttttgttttagttttttgagtagttgggattataggtatttattattatgttaatttttgtatttttgtagagatggggtattttgtagagagtttgattatgttggttaggttggttttgaatttttgattttaggtgatttgttttttttggtttattaaagtgttggtattataggtgtgagtgtttggtttttatatttatttttaataattgatgttgtttgagttgagtatgttatttattattaatgttataggtagaattttaagtggaatatgtttgtagatttttatgttttttggtgtattatttgtttggttttaatataaaatagtttttaatttagaggtatttggaaagatggtattttagtgggatgtaataattttagaaaatttgtattattttagaaggttaagttagatgatgttatattgaaaaaatttatatgttttttaattttagagtttttttgaaaatttatagttagagaaatttagttttgttaaaggatatttgtaagatttggttgagttttttattaaaaatatttgaattaggggttgtagagttttgttttaagtggtaaataaaattttgtgaggtgaagttgttattttttgttaaattttgagattaaagttagtaggtttgaaaggaatttggtatggggtgagtgaatagtaggtatttgaaagttgttttattggaaattgaagttttttatttggttttttgtaggttttgtttattgtttgttatttttgaggtaattaagatatttttttttttaaagtagatattttttttattgtttgattatgtgttttagtagatagtaggaaattgatattaaagatagttatgagattaatgggtaggtatggggaggtgggttgattggttgggtttgtttgatttttttaggtaaattagtttttttttttagttttttatttgaaatataattgagagtaaaatttgggaatttatgtttagttggtttatttttgtattttttaaatatatgtgttagatttattttaaagagagtttggaggaagggtagagaaagaagagtttggttgtttttaatttgtttgtatttttttaggtaataggtgtttggggtgattgggtttattttggttttttaaagggtatggttttttttgtgttttttgggggagggattgttttttttattttaagtttttttttaaagaaattgtttaattaaatagtattttggttttttgaaatgagttttggttaatataattttttttttttttaatttttaaaaaaaaaaagttaattgtgataaaatatatataatataaaatttgttattttaattatttttaagtgtgtggtttagtggtaaaatggaaattttgtatttattaaatatatattgattttttattttttgtttttttttagtttttggtaattagtttttttgtttttatgagtttgtttgtttaaggtagtttatgtaagtagagttatatagtatttgtttttttgtgattggtttattttatttagtttattgtttttaaggtttatttatatagtagtatgtattagaattttttttttttttaaggtttagtaatagtttatgatatggatggattgtattttgtttttttatttatttgttatattggagttgttgtttttttttggttattatgaataatgttgttatgattatgggtgtgttaatatttttttgagatttgtttttagtttttttttttgatatatatttgggattggaatggttggattataagttaattttatttttatttttttgaggaatttagattattttttgaagtggttttatattttatatttttgttaatagtggataagagttttagtttttttatatttttgttaatatttgttatattttgttttttttttttttaaatagtagttattttaatagatgtgaggtggtggtatttatttttttaaaaatttttagtgtttagtttaaggtaggtttagggtgtagatgttgagtttttaggaatagataaaagattgttaggtggagtttatgattttgttatttgttgagaattattgagaagattttttgtttttaaatttaggtatttttagatttgtaaagaagttatttaatagaggggatagttaaagatattaaagtattattaatttaagttaaagttatagttgatattaaagtattttttgattttttgtggtaggaaaatattttagattaatttagtgggaaggttatagaagaaattgtagttttggttttgtttttgttatggggggagttttgttaagttattttttgtttttgggtttatttttaaaaaatgaggttgttggaataataattaaggattttttagttgagaataagagagtagagtaatgatttagttattaaagatgtttttttagttgttaagaattaaggagtggagtttttgttttggaatggatagagttggaattagattttgtaggttatttaggttaatgtgttttttttatagaggagaggttaggatgtagagatgtggtaatgttatttagttatgagttagttagtttgtttttttttttttttttttttttttttttttttttttttttttttttttttttttttttttttttttttttttttttttttttttatttttgggtgttttttgtagagggggatttggtagggttataggataatagtggagggaaggttagtagataaataagtgaataaaggtttttggtttttttaggtagaggattttggggttttttgtagtgtttgtgtttttgggtatttgagattagggagtggtgatgatttttaatgagtttgttgtttttaagtatttgtttaataaagtatattttgtattgtttttaatttatttaattttgagtggatatagtatatgttttatggagtattgggttgggggtaaggttatagattaatagtattttaaggtagaagaattttttttagtatagaataaaatggagttttttatgtttatttttttttatatagatatagtaattatttgatttttttattttttttttatattttttttttttttatttgataaaattgttattgttattatggtttgtttttaatgagttgttgggtatattttttagatggggtggtggttgggtagaggggttttttattttttagaaggggtggttgggtagaggtgttttttattttttttttggatggggtggttggttgggtgggggttgattttttattttttttttggatggggtggttggttgggtgggggttgttttttattttttttttggatggggtggttgttgggtggagatgttttttattttttagatggggtggttgttgggtggaggggttttttattttttagatggggtggttgttgggtggaggggttttttattttttagatggggtggttgggtagagatgttttttattttttagatggggttgtggttgggtagaggtgttttttatattttagatggggtggtggggtagaggtgttttttatattttagatgatgggtggttgggtagagatgttttttattttttagatgggatggtggttgggaagaggtattttttattttttagattgggggtagttgggtagaggggttttttatattttagatgatgggtggttaggtagagatgttttttattttttagatggggtggtagttgggtagaggttgtaattttggtattttgggaggttaaggtaggtggttgggaggtggaggttgtagtgagttgagattatgttattgtattttagtttgggtaatattgagtattgagtgaatgagattttatttgtaattttggtattttaggaggttgaggttggtagattatttttgattaggagttggagattagtttggttaatatagtgaaattttgtttttattaaaaaatatgaaaattagttaggtgtggtggtgtatgtttgtaattgtaggtatttggtaggttgaggtaggagaattaggtagggaggttgtagtgagttgagatggtggtagtgtagtttagttttggtttggtattagagggagattgtggaaagagggatagggagatggtggggagagggagattatggggagggggagggggaggtttttgttaatgttgtttttatgttttttgtttttttttttttgtgagtaaaaaaatattaatagtagtttgtagatgtgttggtttggggttggggttttattgttggggaggtggttttattatttggtgataaatatagtttatgtgtaagggtgatgaaggtaaagagatgggggggatatgagaaggagttttatagaattgaaagagaggttattttaaaatttaaagatttgggttttagtttggtgaaatggggtgtgttaatttagagagtttttttttattagttttgtgatttttattgtattttggttgttttttggttttattatttgaaaggttgtatttttatagggttttgtgatagttagtatgagataatgtatatgaaagaaattgtataaagatgttattaatattgtttgtatgtagttttagagttagagggttattttttttattaaatatatgttaaaatttaagtttaatgtggaaggaataagaagtattagggttataaagaattattttttatattgtatatttttttaggaattattttattgtattttttttgtatgaagttaaatttgtattatttgtaaatttagaaaaatgtgtgttttgatgtttatatatatgtgatgtattagtaggatagattaagggggagttgggttttggtgtttatttttaggtgaaaaggaaggtagatgtgtgtttttttttgagtgtgtttattaagggttgggtttgtttttttggttgagagaggaggtgtattagtatagagagttttatttaaaattgtaaaatgaatttgggagggttttttgtattttttgtaggtattatttatgatttttggttttttggtttgttttaaattagaattaaatttgtagtttttattagtttttgtatgtaggggatttgattatttttgagttttatttgtaaatgggtgtgttgattttatttttgtttattttataggggttgaggtaagatttataaaaggtatattttgtttttttaatttgaaagattaaggttttatttttggttttaagaatgtagtttataaaagaataaataaattatataattttttttatttttatatatgtttttgatattaaatgtgtgtgtgttttttgtatgttaagtagttttttagtttttggagtatattaattgggtgtttataatttaatttaattttgatattatttatttggagttagtattagattttataggttaagggtttgtttttataagttgttttttattttagatgttagttatagtttgggttttttgtgtttttgtttgattggttataaattgggggtttttatgattttttttttgtgtttatttttttgtggattggtttatggaatttagggaaatagtttattgattgttattggtttattataaaggatgtaattttggagtagttagatggaagggtgtatagggtaaggtggtggaggtggtggtggtgtttttatgttttttttagtattttagttttttagtattgttatgtgtttattaatttggaagttttttgagttttttttttttgggttttatggaggttttattataaaggtgagattgattaatttattggttattgattatatttaattttttttttttttttttttttggaggttgggggtggggtggtgggtgggtggggagtggttgaaggtattaatttttattatagatttgtttttttggtagttgtggtttagtttttattttttgagagttttttgattaaattttggtgtgggtgaagagggtttattatgaatgatagaagatattttttttatttttattgttttggagttaaggagttattttaggagtaggggaggaaaatgaaatattataataaaagatatttttattattttgattatttagaaattataaggggtttaggagttttggtttggatttggggatgaagattaaaatatatattttttattatattataatattatagtgttattgaatgataggaaaagtttttagaattaatttttttatatagtaggtttgtgagttataggtttatatatgtggtgttttttggagtttgtaggtgatttgaggtgggggttttgttagtgtggttatatgtgttttgggatagttgttttgaagaatgggagtagtgtggattaggaggaggggtgaagttttggggtggattggaagttatgttatgtaaattttttttgtttgggtagtatttgtaattatgtggttttatgagtttgttaaattattaggtgaataaatgggagaggagaagagagtttaggatttagttttggagtataagttagagttggaaaagaagaggttttagagattggatggttattgagaggtgttatgtttttgaagggtttgaggagggttgatggtatgattttatgaagtttagtaaggagtggagagaggagggttggaggatttttgtttgttatgatttagtttagggataagatgtgagtgttatgggttagttatgattgttggttagtatagtagggtatagtgatggtagaaggttgggagtggagagttgggtagagtggatagtgatgtgggtaggtgtggattgtattaggtggttagggatttagagttatgaaaagaagggtataatatggtggtagtttgtagtttagttgtttgaatttagaatattttttggtttgttttttttttttttttttgtttgtttttattttttttttaggtggggaaggaattgttttttttttagtttttttgttgttaggttttttttttgttagtttttatattgttatggtgatgttttttttaaattttggattaaagtgttattttgttttagaatttgatggttttatatagtagagtttgtattttttggtatggttttgtattttttatttttttttagtgtatattttgtgttttgggtgtagtttttttttttagtttggtggttttaagtttttatgtttttgtatggattttttgttgtattttgtttattttgttgtttgatatttgagggtgtttttgttttttaagtttgtttttagtgttagtttttttgatgtattttttttttttgattataatttttttagtgtttatttaaaataaatttggtgatattgatatatattttagtgtgtgtgtgtgtgtgtgtgtgtatatatatatatatatatttggagatagggttttttgtttagttagagtaagattttatttttaaatgtgtgtgtgtgtgtgtgtgtgtgtatatatatatatatatatatatatatatatatatatatataatgattaaaatatatgtaagtgttgttgatatgtatttatatatgttatatatatggttttgtgttttgtggttggagtgtagtggtatgattttagtttattgtagtttttattttttgggtttaagtgatttttttattttagttttttaagtagttgggattataggtatgtattattatgtatagttaatttttgtgtttttagtagagatgggattatgttgtgttgtttaggttgattttgaatttttgggtttaagttatgtatttgttttatttttttaaagtgttgggattataggtatgagttattatgttttgttagttttttgtatattatttgtgttttttttatgagtttgtgagtttttttaggggataggatttttttttttatttttggtgtggttttaggttttgtagaggagagatggtttgaatgtttgttaagtggattgtagttgatagttggttagtagtttagagtgttggtgttttttggagtagtggagagaagttagataggtaggtaaaggttatatggaaattgttataaataaaaattatttattttttttttttagtaaaagtagttatttgttttttaattaatattaagtagttattatgattggtatgatgggggattttatgttgtatgaaatagttttttttttttatagttttgagatttagtgtgtaaaatttgtttattatgatagaagaaggggtaggtggtagtggttttaaggataatataaaaaagttttatgggattgtagaggagatagggtttggggataattgagattagatattatggggttaaggttttttgtgttggattttgggagagtggagattggtgggtttgttgtgggagttggggtgataggttgtgatgggttatgatgggttgtgatggattttgatgggttgtgatgggttgtgatggattttggtgggttttgatggtttatgatgggttatggtggatattgatgggttgtaatgggttatgatggattgtgatgggttgtaatgggttgtgatggattttgatgggttgtgatggtttgtgatgggttatgatggatattgatgggttatgatgggttttgatggattttgatggattttgatgggttgtgatggattttgatgggttgtgatgggttgtgatggattttgatgggttatgatggatattgatgggttgtgatgggttttgatgggttttgatggattttgatgggttatgggggtggatagaatatattttggaaatgagaggagttgaaagttgagtgtgtaatttatgtttttgaaatggtgaggagtttattttgattggtttttttttggattaattgtgtgtttgtgtgtgtttttttttgtttgttttttaggtgtagattatgaattatgtggggtagttagttggttaggtgtttgttattgtgaaggagttttataaggggttgaattttgttatatttttagggtgtattgatattattgttatttgttagtttaatggaaatttttaatgtttttttttttatgtttgttttgggaagatgggggttttgtgtttttgagagaaagtggtgagtttttagggtatggggatttggtattggttttttttagagaatgtttttgtattttggtgatgttatttgttttgaatttttagatttagagttttaggtttttgttggaaatggttagttatggaattgatagtgattaattgaaattattttagttagtatggttgtgtaaattaaagtgttgtggtatatattattgtttattaagtttttgtatttgtgggttaggaatttaggtagagtatagtggggtggtttgtttttgttttttggggttttagttggaaagtttaaaggttgagggttggaattatttgaatatttatgttttttgtgattggtggttgattttggtttttggttgggttttttgttgaggttttggttatattaattatttatggtttttttatgtggttagggtattttataatatagtggtagtggtgaggtgagtattttgagagggaggaagataggtagatgttggagtttatggtttagttttgtaagttatatggtgttatgtttgttgtgttttattggttggggttattataagttgtttgggtttaaggggaggagaaataggttttttttggtggtgttaatggaagaaggataaagtttataaatttggagaggagaattaggttgttgtttgtagggtggttaattttgataggttgggaagtgtagttttttgttagaagtagaaatagatattttgaggaaggggtaaagagattagggatttgtgttgtttggggttatagaatttatatatttaataagttataggagaggttgtgagtgtttaggagaggaaaatatgtatatgtgtaattgagtttttgtttgtttatgggatttatgtttaaaatgtgatggtattagtattagttaagggtggagttttttggtgtttaatattaaagggtggagtagaggaagggaaaatttttagggtatattttttttaggtgggttaggattagtttttgggtttttattaggtaaaaaataaatataaataaataaataaataaataaataaaaatgtagagtagttttttttgttgatattagtgtatagttttttgaaagggttggtttttgtttggtttttagggaggaaagtgtaatggtggttattgaggtggggtatgaggaagtttgttttattttttattttattatggtttggaatttagtttttaaggtttttttggtatttttttgttttagagggggtttgtttagttagttgtgagtttagaattttatttttagtttatttttaggagtggtgaaggttttggaagagtaggtaggattaggatattgatgtggttagttttagaagataatttgttatataaatggaaagaaataaatttttgtaaatagatattttatgtttttatttaatgtggattttgggatgatgttttttgattggttttttgagttaagtttaagaggaaatttttttttgagtatgtgtgaaggattttagttaatagttgatgagttttttagggtgtaatttttaatgtttggggttggggaagttttgattgtagtttgaatttttattagttatgtgattttgggttggttattttttttgtttggttttagttttttagttaaaaaaggaggagttagattaggtggttttggaggaatttttttattagtttgttgtaaaaataattgtagtttttgttattatttttaataattataataatggttaaaattgtagttatttttgtattaatgtattgttttgggttttattttttttggttagggatttgtttttttgaatttagaatttttttagtttttaagtgatagtttttttggatgggatggtttgattgagattgggagttgtgtggtattttagggtgtatgtgatgatagtgtatttgtggagatttggttgtttttatgaggttttttgttttggtgaaggtagtttattttttttttaattatgttttttttttaggttgatatagaaattaatggggaatttgtggatttgtatatgaaattgggagataatggagaagtattttttgtttaagaaatagataatgattaggtaaggaagtttgggtggttagggttattttttagttttgagttttgagtaatggttatttggaaatatggtagaagtttgtgtaaagtaatattggttgtggttgtgtggatgatggggtagagaaaagtgggtgttgatttgtgtgggggatttgagttagatggtttaggggtgtgttgagtttatatagatttagtttttttggttggttttagtttgttgattgttttttaggagatagagggatggattttatatatgggtttggattattgttagaggtgtatagattatattggtgtgttaaattttaaatgtttaatgtttttttatttagtgagtggttgaattattttaaaaaatattttaaaagttttattgagatatatattatatatatataatttatttattttaagtgtatatgtagtggttttagtatatttatagataggtgtaattattattatagttaaatttagaatttttttattaattttaaaagaaatattatattttttaggtattgttttttttatattttattttttaattgttgagttttaagttattattaatttttttatttttatagatttttttattttgaatttttgaatggaattatagtatttggttttttgtgtttgtttttttttgattaatgttttaaggtttatttaggttttagtatgtattaatattttatttttttttatggttgaatagtattttattgtatttatagattatgtttatttatttgttttatttattattataaataatttggggttgggtatggtggtttatgtttgtaattttagtattttgggaggttgaggtgggtggattatgaggttaggagatagagattattttggttaagatggtgaaattttatttttattaaaaatataaaaaattagttgggtgtggtggtgggtgtttgtagttttagttattttggagattgaggtaggagaatggtgtgaatttgggaggtggagtttgtagtgagttgagattgtgttattgtattttagtttgggtgttagagtgaggttttgttttaaaaaataaaaaaaaagaaattaaaaaaatttaaaaaaaattaatttgggttgtttttattttgtagttgttgtaaataatatggttgtgaatatttgtatataagtttttgtgtggatatgtgtgtttgattttttttggttatatatttaggaatggtattgttgggttatgtggtaattttatatttaatatttgaggaattgttagattgtgttataaagtagttgttttattttatatttttgttagtagtgtataaagagttgtgatttgtttatatttttgttaatatttttttgattttgtgattttagttattttagtgggtgtgaagtggtatttttttatggttatgatttgtatttttttaataattagtggtatttgatatttttttatgtgtttattggttatttttgaatttttggagaaatgtttatttagattttttgttagtttgtgtgtgtgtgtgtatgtgtgtgttgttttttttttttattgttgttttgtatgtttttattatatattttagatataagttttttattgggtatatgatttgtaaatatttttttttattgggtgggttttttttttatttttttgatggtgttttttgtagtataatagtttttagttttaatgaagtttaatttttttttttaaagtttgtgtttatttttttaatgtattttgtttttttttttgttgtgtatgtttttggtgttatatgtataaagagttttttgttaaatttaaggttatgatttatggttatgttttttattaagatagattatttttttaatttttttgtttatagatgaagtattttaaaggggtttgatgtagggatttttgaatgaaattgatttgaattagtttttttttaggaagatagttatgattaaaaaggaatggttttttatagttttaggttttaaagtaagtgtttataattgtagttttgggatagaatagttttaggtatagtttttattttgtttgtttagaatggtggtgtttggggaggatttagtatttttttttttatgttttggagtaattttgttgatattggggatttttgtatatttgttttttattttttttagatgggaagattttaaaaatattaattggtttttaatggtttttgatagaaattttttgtattgtatgtggatatttgtatttttaatttttatttgtatttggttttagatagatttttggttattggagttgaggaagtattttgggttagtgtgtagtgggatttgtatgggggttgtttgttggttttgttggtttgatagggtgtttgtgggtggggtggggttttggaggttagagtatgtttagttttatatagatgttttttaggatttttgggatgttgttggaagttggagagtttgtgttttttagtattgtttggtattgtatgtgtttgtgggggtttgtttggttgtttatttttttttagtttatggatagtaaagggtttttttttgtttttgatttgagaatttgtgttgtttttttagttgttttagtttagtagttgggtgagatgattttttatttttttttagttttagttgtgtgttttaggtgtagatattttattttagtatgtttgatgttttttaaatttatttgaatgattagtagtatatgtttatttattttttttgttttatgtatatttttattgttaatgagttttttatataaaatgaggtatttattaataaaatgattattagagttttataaaaattgttgaattattataaataattattaaatggataggttgtgttttttttttttgtttttaaggagaggattagtatttatttttttgatgtttagggttttttttgggttttggtgtaggtaggtttttgggtggggttattggttgttttatgtgtttttggtttttagatggttattattttaatttattgtatataaaaaatatataatatatattttttgttttttttttatatttatttatgtatatttatatttatatagaagtgtaagagtgtatttaatttttagtataatatggtgagttaaagtttattttttttttttgtgttttgggtattatagttaaagttgaattttgggggtttgagattattgagaattattttttattgttaaaattatataaatgtaggattgagtataaagtggtatttaatatattgttggttttttgattttttattagattgggtagttatatttttaggttattatggttgtggtttttagttgggttatttgttgtggttttttttaggaggtgtttggtttttgaagtgaattttggaggtttttggtaaggttttgttttttatatttgaattaatgaggttttttttagaaaatgtgttttttttttaggaagttatttttatgtatttggttattttttttattttgttagaaggagttttgagaatggaatgttagttgaaaaggggttttgtggataggatgagaggtttggattttagtatgttagtttaagtgattgtttttagtgagatgttgttaagtagttttgtagtaaagaagagaagaaaaaggaggagaaagttatagttggatagtttgaagagagatgataatatgaatatatttgaggatgaggatatgttttttattgagatgagtttggatgaggttatggagttgttggagagtagtaggtaataattgtttagggtggaggggttgtgttagaattagatagttaattgtttaagattatttttatgaattttttttttataattttttatttttttatgtgttttagattagtggtttttaatttttttggtattagggattagttttgtggaagatagtgtttttatggattaggggtggatggttttaggaggatttaagtatattatatttattgtgttttttatttttattattattatattgtaatatataatgaaatatttatataatttgttattatgtagaattagtgggagttttgagtttgtttttttgtaattagatggttttattttgggggtgatgggtgatagattattaggtattagatttttataaggagtgtgtagtttagattttttatatgtgtagtttataatagggtttgtgtttttgtgagaatttgatgttgttatttatttggtaggaggaggagtttaggtggtaatgtgagggatggggagtgattgtaaatatagatgaagttttgttagtttgtttgttgtttattttttgttatgtggtttagtttttaataggggtatggattttaggggttggggatttttattttaggttgaattttggaattatgtggatttaattttagagtggtataaagatttgttgtgttgtagttaagagatagttggtgatgttaaatttttttggttgattgttttagtagtttggaatggagttaagaaataggaattgagtaaattaatagtttatgattaaatttatttttttggaatttatttatttttatttgagtattaatgatgtataattgggttgatttataggtaagggttgattttaggtttaaaagtgaatgaagaaaatgttgttttttttataagttaatttttttttttttaattttgatttaggtttaaagtttaatggaaattttgttttttttttttttgtttttaatagtgtggtgaaattttgtttgtatgtattattattttggtgaaaaatgttagttttaaaagataaaatttattttgaaggatatttgatgttttagatttttatataatttggtataatttttgataattttgttaatataaagaagggataaggggaattaggagtatttttttgtgttattatttggaataaaatatatttttttttgtggtgaaaaataaatgttaattggtaatgaatattgttttttttaattatagtttttatttaatttgtgataggtttagaattagtgttattgggttttttataattgttttttttgtatggttgttaagtataaaatttagtggtaggtgttttaggtaatattaatatatagatagatggtttttgtatgattgaaattgtgaattgtatttagtagtgagtgtgtttatatttgaaatgaggttatttgtagttattttgtaattgtaaggtatgtttggttgatgttatttattttttttgttagataaaatgtgattagtgtatggttattgagttatttagtagttttgtttgtatttggtaggggttttatattgttttggggttggtttggggttattttattttttaggtttttggaatatgattgtgtagggtagtaggaggtggtatgatgggaggatttagtagtgtgattattgtatgtgtgtttgagtttaaatgttgaaataaaattattttataattagaatttggttaaagtattagtatatagatatgtttatggatgttggtattttattttttttttttttattgtttggaatagatttgggtgtttaaagagattatgttaattataaagtatttagagttaattaagaaaaaattggaatttgattatgaatttattattaagaattttttgattttaattttttttttttttttttagaattttttttaatgatatatttttattttaagatgatatttttgaggaaaatttttttttggttgtgatttatttttagttagttttatattttaatttggatagagagtggttatttatttttaggtaagttgttttttgtttttttggtttagtgtagaggtttagaagttagtgataggaagtaattttaagaaaagaatgaaatagaaatgaaaagtgaaaataattaggattaggaaaaatatggtgtagagttggaggtatagattaggattaaatatagaatatgtttagattatatatttatatttggtgttagaatttatttgtagatatggttgttagttttttggaggtgaatttgaaaggaaaaatatgtaaattatattatgttaattgttaataggagaaaatatagtggtagagttttttttgatatttagttttaagtaaaatttaaaaatagatgttgttttaggagttgttgaggttgtttagggttattagaatggtgtttttgttatatttaatttattttgttgaatttaagaatatttatttttttgaaatgaatttataagttgttttagaggaaaatttggagaattagagttgtttattgtgtagatgttattttgatgattttagagatgtttatattagtgaaatttttgggaatagtgagttttttggttagtttttaaaggatttggggaagagggtagagttaaattttgtgtttttaatataggaaataatataatttttattgggatgaaaatttatttttgggtggtgataaaattttagatgttataatggtttgtggtttttaaggggttatagtattaaaattttatggtgggtggagttgggttattaattttttagaatgtttaggggtatgttgataatgaaaaagagattgagaaatgttgatttaaatgttagtgatatttttgggttatttgtatattttatgttttagatttgtttttggtttatggtgttagtttttagaaattttgggtttttatttgaagttggttttattaaaatgttatttttggttttagtttgattagggtaattttgtgaattagtaagtagtagtttttagtgtgtgttgatatggaggttggagagaaaatagatatgttttatgtttggtttttagttaatattgatgttgtgggttagtttagtaggttgaggttgaggtttgtgataaagtttttgtatggaggtttttttgtgttagagtttagttttgtttaatagaaatgtaataattagttttatatgtaattttaagatttttagtagttttatttttaaaaagtaaaaaaaaaaaaaaaagatgaaattaattttaaagttatattttatttgattatagtatttttaaaatattattttaataagtaattaattttaaagaattattaatgagatatattatatttttgtttatatattaagtttttataaattttattatgtattttatatgtgtagaatattttaatttggataagttatgttttaagtgtttaggagttatttgtagttggtggtttattatattggatagtgtagatataagatttttttagatttttattttttttttaggtttgtggagataaaatagtggagggaaaaatagtggtttaggaggaaaataatgtagaatatttagaatttaataatagatgaaaaaatttgtttaagtattgtatgttaattttaaggatttaaaagaaatattttaaatataattttgagtgtgtttaatgtttaaaatatttgtaatgttttgttttatgaatgtagtataatgattgagttaggttatgtagttttgattattattaaatggaatgataaattaggataaatagttatatttttatatttggaattaggtattttttgtaaagagataattgatagtatatatgagtatatttttggattatgtagtttgattaagtatgaaagtgtgattagagatgattagttttatatatgggtgaaatagaaagtgaaataggttatttggtagttttttgtttttgtgttttagaaaatttatgttgattttttagtaattttaatatttggtgttttgttattattagatgtttgagtttttttatttttttaaaaatgttgttgttgagagtagttaaatattttatgtaatatatataatttttatataaagtatatatattttgtaattatatataattttatatataatttttatataaagtatattatatatattttatataattttatatatagtttttaaagtatattatatatattttatataattttatatataatttttatataaagtatattatatatattttatataattttatttgatgtaattgatttttgattttgttttttttttaatgtgtattatgtggtggtatttagtagtttggtagattgtaaaaggattgttttttattttgtagttgtggttgagggaggtttgtttagtttttgttttttatagttttttttgttttattttttggaaaggtagaggagttattttttttattgggatatatttaataatgaaaaatttgatttaatttttattataagtttattttattattaattaaattatttatgaagaaaatatttgtagattatatgaagtgaaaattttgatttaatttttataaattgattttattaattaaattatttatgaaaaatatgtatatagattatttttttttttttgttataagtatttgtagatgattagatttttttttttttttaatttttaaatttgattttttggaaattatggttaagtatataattttatttaattttgtgaagtgttttgaaaatgagaataatgaaatatagtttgggaatatgattttttgttttttgttttgggttgtttgataaataagtttataagatatttttggaatattattttaatttattataaatatttaagtagtttattgggttgtttgaataatggagttagatattttttatagtatttttagaatagaattttggagaatggtttgggttgggttttaggttgaggattaaaggttggtgtgtttatttgatgtagttattttagatttttgtttttatttttttagttttgatttatttattttgtggatttatatggtttattttgtaagttttagtaaatgaagttatgattaatttgtatgtggaaaattttttgtttttttgattaaagatttagattttaggatgtattttatttagaggttatatttgtagaagaaaagtttgtttaaaatgaggaaaataaagttgttaatagttaaaattaattagttttattgggattggtaaaaatattgaaaattttgataaggttaataaatattttgtttatgaatattagttattgattttgtaagtttatttttttgaataatttttgattttaaaataataatattttatgatggagtattttggagttatttttttggtaaattttatttggtagtgggttttatttttgtgttttttttggtttgtttgaatttttttagtgatggttggtagaaagtgtatttgtgtttgtgtatgagatttttggagaagggttgttgtggtttgaatgggtagtatttatggtggtggtttgtttgttgttggggagggatttgtagtagatttttttgtagggttgggttttttatgtgtgagttgtatgtttgagtgtttttatgggttttgtggtttgtggtttttatgaagggattagaatgttaggaattttggagttgggaattgttgtaggagaattgtgttttgtattttgtttttttagagtagaggttggtaaagtatggtttatgggttaaatttggtttattatttgtttttgttagatttttttgggtataggtagttggtttatatattggttgtggttgtttttatattattatagtagtgagtggttgtgatagatgttgtaaaatttgtaaagtttgagatatttgttattgggttttttatagaaaatgtttgttgatttttgtttggagtaagttttgtttaaaggattttattttatttagtgatagtgagataatttattgttgtaaagaatttatagttaaatatgttttattttgtttggtgaaatagaatggtaagagttttttagatattttgaggtttgggaatagtattgttgagggtgagaagttggttttgatggatttattttatgatgatgttggagaaagagtggattgtggttatatttgtaggtattgaggttttttgttggaggttatagtttgtgttttttttattgtagtgatattgaatatgtgattgtagatgttttagtgttattaaagtgttgtttttttggagaagtttagttgtggaattggaagagtaaggaggttgaaaggttaggagttttttttatatggatgtgggggggtttatgtgtttttttataggattgttttttaaagggtagaaatgtgtgtttgttgggagtagggtgttttattgtagaagtttttttaatgtgatgttaggagttttttttttttaggtaggtgaaagagagtgtgtaggttgttttgtggtagtatgttattagaagggttgggagttatgggtattaagggagtagggattattttttgttttttggtgtgagatgagagagatggtatttggtttggttgttttatgtagtttgattaaagagatttaggattagtttagtttataaggtttttgtttgttggatataagttatgtattattatgaatttattttgtattgataggaaagttatatttaattggagttgaattttaggtaaatgagattagaagtattagtttttgaagaatagataaggtttgggaaagaagatggtaagggaaattgaaagttttattttttgttttgtttgaaaaattttgttgtttttttttagaggaaatgatgtgggaaaataagtaataattaattatgttattatgtggtaataaataattataagaattgttgttgtaaataatatttttttaagttgtttagaatatggtgaggattttgtggataagttaatgatttttggatggttattttggttgggtagaagtaagattttgtttgggtttttagagtaaaaatttaggaaatatggaggtggttattgagtgagttttaattagttggtgagttttttgtgaagtatttttggaagatataagattttagaaaattttaatttgtaggtttttgtttaatgttattgagtttatttgtggtatttagtatttttggtaaaattggtatattatataatttttttgttttttaggttagtgtagatgataaatatttaaaatatggattttaatgagtgtttgtttgagttaattaagatttttttgtagttttttgatagtagaggaatttgatttggaaatagattgtaggagatgtgagtgtagagtggggtggggaagggtggtttttttgaggtaagaatagattatttttttttttttttttttattttttttttttgtattttgggttatttttttttttttttttttttgtggtgtattaggtggtagggtggggtgggtgatttatgtggagtgttttttatgggaggtgtttttttgttttttggtggttggaggagggatttgttatgaggttttgtttagagtgaatgatagttgggggtgtattttttgggttatttgagttatggagttgggtttaaaatatttataaaagtttttttttttattttaatttttgttttgtgttttttttaagtttttttggtttttgatttttaatatttaaaagtgatttagaattggttagtaagtttatggaaaggatagggtagaagaatttagaaatgttttggttgtggggagagttgttgtaggttgttaaggtgagagtttttttaattttgttatggattgaagatttttaatttagtttaaattatatggaattagtattatagtatagttaagaaatatagttattaggagttagaggtaaattaaaatatattaagggttagttttgaatgttggaattatttttttttatgttattaatattatagagaggttttattgtttttgtagattttaaatttatgggattttttttaggatttattttttttttttttttttgagatagagttttattttgttatttgggttggagggtaatggttttattttggtttattgtaatttttgttttttaggtttaagtgatttttttgttttagttttttgagtagttgggattataggtgtatgttattatgttttattaatttttgtatttttagtagagatggggttttattgtgttggttaggttggttttgaattgttgattttaagtgatttgtttgtttttgttttttaaagtgttgggattataagtgtgagttgttgtgtttagttaggatttatattttttattatagttaaatgtaaattaaattaaagaaatataatttatatataattttgttgttttgaaattgtaaataaaaatagtttttagtttttgagtttgttaggttattgatgagtggagtaaagttatagggagagagttgtggatttttggtttattgaaaaagaagttgagttgtaagagttggaatttatatgtttttgtgttttttatatagagagatatttgggagagttttgggagagggaaaggttaatagaatagaaatgaaagattttagtttaatagataaataaagttagaaaattttaaggttttgatttattaagtagtaagtatttttgggtttttattgttggtgggattttgaatttgattttatggagatttttaaaataaatagagaagtagttgagggtagtggagagaatgagggtttgggaggtagtaggttattttgggtttgagtttttattgtattgtttgttaaaaaggtgattttgggtaaatgagtagatttttttgaattttagtgtttttatttgtaaaattgtgagaaaatgatagaattgttgtgaggttagaagggttaatgtaggtatgtgaagtatttggtatttgtaggttttttgaatatttgtattttttttttttggttgtggtatatgtatgttgagttttagtttttttattttggatatgtagtgggtttatatgtaggtatataattggtttagtaaatatgtttttaaaaatatgaaatgaatataatttttttttttaagaaattttatttggtatgttaatgtattataagtattttgaattatgttattatattataagttttaaaaaatattgtaaggtttttagaagatgttatagttttttgtatttttaataaatgtttgtaatatgaatgaatgagtgagtgagtgagtgaatgattattgaaaatattttttataaagagttaagatgggtagttttttggagagtagtttgttgaggttaaagttgtggatttattttttttttaggttatatttagattttatagaaaatgttgatttatttgtttatagttatggtgttgatttagttaattttttttgtaagtttatgttgttagttgttggagaaatagtatggaagtgtaaatttattattttttttggtaaaatagttgtaattatagattttttgtagtattgtttttatttgtaattgaagttgtttgattagatagagaagtgaatatttttttttttttttttagtttatgaattgtattttggtttttgtttgaataaattttttttgtaattggaaatttttttggtggtagaattagaaatgttaattttttatttatgtgaattaattgttattaaatttttatttatttatttatgttttgggaataaattttattgaaatatatatatagagaaatatatatattgtaaatgtatagtttaatatatttttatagtaggaatagatttgtgtagtgtgtatttagattgagaagtagagtatgattagtagtatggaaatttttattttttgtggttattgtttagattgatttttttgttttttgtaaggggaaatttgattttagtaatagagattagttttgtaagatttatttatgttgttggtgtagttgtaatttatttatttttatggttattgagaattttagtgtgtgtgaaaagatttgtaatttaatagtatttagggtgtttttgtttgttggtattgttaattttatttttttttggtagttgatgttttataggaaagtttatttgttttggatttaatatttttggtttttggattttttggtaggtatagaaattattaggtgattgttgaggtttaaaagtttttgtttatttttgattatttgttttttttgggttatttagtttttttggttgtttttgtgttgattttgtttttttttttgttttttttttttttttgttttagtttttttttttatataagatgaaagagtttagtttattgagtagtagaaaaatttgtgataaaagttatttttaggttatttatagtgaatttttagatatttttagtgattaattgttaattttggttggtggggtatttttggattagaataagttttagatagaaatgtagtttgtgaatgaagaagatttggagattttaggagtagtagtgttatttttgtttatgattgaggagtttaaatttttttttgttagtgtagtttagatagtaaataagatggattttttttttaggaaaagaggtattaaggttggggttttttggttttttttttgtttatagtttgtgtttattttatatatgataggttttttttaaagttttaaggaaattgaggtagaaattgaattgtgataatgattatgtttagtttgagttttttagtagaatatattaattattggaatttagttataggaaattagatatgaagaaggttttgaggattatgtagtaaattttattttatatattgaggttgtttgttgagatttgggagagttaagttttttttagtatattatgggatttataagtgtgatttttataaagttgattattaggttaattttggttatttttttttttgttttgtgttgttttttagttttttatttattgtaatttttgtatattatttattatgattttaaatgattattattttattgatttatttttgtttgatttttttatagaatatgtgttgtttgagattaagagttttttttatttaatttgtttttttttttttggtgtttggtatagtggttggtatatagtgggtgttttgtgttggtttaatgtatttttggttgtgtgttagtattaatgatgttaggtttgatttttatttatttagtagttttgtgtggttttttagaattatatggattaattatattattttttgttagaagtaaagaggatatttgaagttattatggttagtgtttgataatgtatagtgtgggatgttttgttttggggtattgatggggaagtgtttaataaaagtttttattattttataataagtgtaataataatggtaatagttttaatgtgtttagtgtttagtatattttaggtattttatagaggaggaatgaggtttagtaagttaattaatttgatttaggttatatgatggtggatgatggttttggtttgtggattttggtggtttatggttatgttgtattgtttattattttttaatgggaaaagtgtaggttgtggtttttagtgaggggttttggtatttataagtgtgattttaatttattttttttttagtaatattatggaataagtttattaaaattattttatttttaatggtattgtgtttaaattttaaagtatttgtttaaaaagtttttgttattttgttttattagataaaatagaatatatttggaattgttgtggtttttgggtagtttgagtatttgggagtaaatttgtatatagtgtttaaatgttgtttttatagatataaggttatgagtttatttttagaagagtggttttttgatttgagttatttgttgttttagataaatgaagttgatattttggtgttgatggtgtttatttggatgattttatagatatggattttgaagtggtggttttgtatttttttaaaaagtaaaatttttgttaattttttatattattttttataatttgaatattattttgtgtgagattagtttttttttatgtttgattagaaagtgtgtaagatagttgggtgtggtggtttatgtttgtaattttagtattttgggaggttgaggtgggtggattatttgaggttaggagtttaagattattttggttaatatggtgaatttttgttttattgaaaatattaaaattggttgtatgtgttggtatgtatttgtaattttagttatttgggaggttgaggtaggagaattgtttgaatttaggaggtggaggttgtattgagttgagattatgttattgtatattagtttgggttatagagtgagattttattttaaaaaaaaaaaaaaaaaaaaagtgtgagagagaggtagtgggaggtttttattgttttgtgaaatgtgtttgttttatggatataagggtgtgggtattgggtggtgttttatttttggataggggtgtagtattgggttgttttttttgtaaagtttgaggttatgttgtttatagtggttgtggtttatagtttagtaagtggtagttgtgtagttttttttttttttaggagggttttttgtgattttggggatttatttttagtttttttgtgatttagggtagggttggtgtttggaggggaagggtagggaatagggaggatagtttgttttttttttagtatattttagggggatatagggagatgtagttagttgagaagtaatggtttttttttttaagttaaggtgtttaatgtttttttttttgttgtggtgttttaataaatatttgtgttgagatgtagttgtttgtggttttgagggtggttgtgtgttagagtattattggatggtgatgtaggattttgaattgggatagtttttagttggtttttgttgttttttttttttttagtggagatttttttggatttgtaaaatatgtaagtgataatggagtttggttagttaattagtttttgtagttggtgggtagtttgggtgtggatagtggtgtggagagtattttggatgggttgagggattttttttttattgttatttttttttgtgggggttttagtgattattgggagattatgaaaggtattgtgggttttgtgtgggtgttttttggtggttgttggttagaaggtgtagaggtttaggtttttttaaggagtgtgtgttaaggtagttttttttttggttgtggttaatgatagtatagatgatagtattgaatttataattttgatgtttttggtttgtagttagttggttttagagttttgtgggttatttatggtttgggttattgttgtgtgttttttgtgttttaggttagtattgtagagatggtttttagaggtttgtaggttagagggggtgttagtttaattaaattagagggtgttggtagtgagagagaagtgtgttggtgttttggaatagggaggtttgagtttgttggaggagggttgggaattttttttagttggatttaaagggtgttaattgggtgggtttaggtgatttatttatagtatttgttatatttgtagtaatgtatttttagggttttttgatagttttatggtagggtgtgtttatgttttttagtgggtgtagttagtagttattagttggggattagatatagtggttttgtattttttttgtttttttttttattattgttttttttttatttttttgtggtatttttagtagggaaggggttgaggttgtgtattttttttttttattttttaggagttatttttatttttttttttaattagggttgttatgtgagatttttgtttttattttggtttttttaaggttttgggaatttttttttttgtaaagattgagatttttttgtttttatgtttgtgttagttagttttttgagagtggaaataagattgtgtgttgggttttgttggttttatttatttatttagtttttttagggttatatattaatatttagttttattgtgtttttgaagttatgggggttttttggatattggtgtgaggagttttttgggtgttttttttttgatatatatgagttggtgggggtggggtggtagtattgataaggttgggtattgttatttgagtgttattttatggggttaggatttgtagttgtttagtttttataggtgaggttagattgttatagttaggagattttaggagagtttttggaggttttgattagggttttgagggtgtatgttgaagttagttaggttggtattaagatttagggattttttttttggatggaggagatttttagtgtttgatgtttgttgggttttggtttggtttagggtaaataggagtttttagggaaggagtgggtgtggttttgggttagggagatggttagaattgtggttaaggtttaaggtatagtttagttgttagagtttgttaaagaattgagggtttggggttgaggtttgggttttttgattttgttatttttttttttgttttgattttggtggggttgttttattatgatgagaatagtgttttgtttgtttttgattgtggtggaggtagttttatttttgaaagggttttgtgttttttatttatgatattattagtttttatgattattttaggaagtagatgtggttattatttttatgttagaggagggaattggggtttgggaggtgaattgtttgtttagggttatttttgtaattgtgattttagttgagggagtttggtttttgtgttatgtgtagttatgattttgtttgtgtagatgtatgtgtgtgttgtttttatttttattttttgtgtgaatgtatgtgttttaattaaggtatatgttttttaatatttttagttttgttttggtttttttgtattgttgtatagatgttgttttttaggtaaaatggtgtggtttttataaatatattttataggattgtttgtatagttggaatgtataaatttttagaaaatatttgtgagtgagtaaatgaaaggtaggtttaattttgaattgaattttttttttgtttttttttgattttttgtaattgttgttatagatgtatttttggagtaagttgtgttatattaatagtttgtggataattttgttattattgatgattttaattttgtggtaaagattgggagtaagtaagtattttttgaaagttattttggtagtagtatgatattgtttttgttttatgtttttaaatagatttagatattaagttttagaaatatataaaataaagattttgttatattgtattattgtattatttttattgtggttagggttttatgttaatagaattggtaatatagttgataggtttagatagtttttagttttgtgagtttttttttttttttttttttttttttttttttttttttttgtgataaggtgtagttttgttttttaggttggagtgtagtggtgtagttgtagtttattgtagttttgaatttgtgggtttaagagatttttttatttttgttttgtaaagtgttgggattttaggtgtgagttattatatttagtttgatgtttttattgaatgtgaatagttatattttgtagtatatgggtatgttagagtagtttatatttttatttttttgaaaaattttattattggttgggtgtagtggttggtgtttgtaaatttagtattttgggaggttaaggtaggtggattatgaggttaggagattgagattattttggttaatatggtgaaattttgtttttattaaagatataaaaaattagttgggtgtggtggtgggtgtttgtagttttagttatttgggaggatgaggtaggagaatggtgtgaatttgggagttggaagttgtagtgagttaagatagtgttattgtagtttggtttgggtgaaagagtaagattttgttttaaaaaaaaaaaaaaagaaaagaaaaattttattatttgagggtaagggatgtataggtatttttgtagattgttagtaagttttttttttttaagttatggatgttttatatttagttgtttttattttgatatgtggtaagaaatattttaagtatgttgtggtttggtgtagtagttgtatggtgggatttgggttgttggtatgtttaattgtttgttttgttggtatggttgttgttgggtttttaattggttgttggggtgaggtggggggagtttttgtttaggggtgatatggaggagggttgggggttagtaagagtattgagttttttaagggttttgttggagttttgagttttttttgattattttatatgatattggaaaggtttttagtttgagttttggttttttgatatatattttattgttttgtgttagatattataattggataatagtagtatttttttttttggtaatgtaggttttttagaaatttttgttaaaggtgagttttaatatgagaaagaaaaggggatgttagaaatgatgggtagtttaatttggggtggttggaattttatttttattttggaaattatagagttaattttattgtgtttttttgaagtttatgagtatataggttaggagtttttgattttttttttgtattttgtatgtggttgttttttttttttattaaggtaaaattttttaattatggttgagtggattgaagattttttttttaatatttgttatgtaaggggtataggtggaggttgagtagataggtgttaggattttagagtttagtgaggataaagggagatgattgttattttggaaaggtggagtaggtattagggttaggtgtaggtgttttgtgttaagtgttaagtgttagtgttaagtgttgtttagttaggaagttagttttatgtttgagtttttgaggttagagttagtatagggtttggatagtttttagtttgtaggggagagtaggtaagtggttgtagggaggagttaggagggtagttatgttatttgttagtttgtagtgtttttattttattttaaataatttattagatagttagtttggagttgttaatttttttaatgatagatttttttgttagattatatgttttttgttgtagagattgttttaggtttgtttgtattttttgtgtgtttagtaagtttttgtatggtttaggatgttgttgttggttagttagtttaaatatttgagatttttgaaggtttaattggattttgttgagtttaggtttgttgttttttgggtttgtgtgtgtgtgtgtgtgtgtttgtgtttgtgtgttagtgtgtgtttatgtgtatgtgtgtatatgtgtatgtgtatgtatttgtatgtgtgtgtgtgtgtatgtatgtgtgtgtatgtgggtatgtgtgtatgtttgtgtaggtgtgtgttttatgtgtgtgtgtgtgtgtatgtgtatgtgtatatgtgtggatgtgtatgtgtgtgtatgtgtggatgtgtatgtgtgtgtgtgtgtgtatgtatgtgtggatgtgtatatgtgtgtgtgtatgtgtggatgtggatgtgtatgtgtgtgtgtgtgtgtgtgtgtgtgtatgtgttgtgttttgaggattgtagttttattttgggtggtgttttatttgattatttttgtggattgggttgagggtatgttttttagagtggtttttattttgtttttgttatggtatttatggtttgggatatatttttatgttattgtttttaatatttataaatttgtaagaaaaaaggttattgtaatagtaatatagttaaaggatttatttatttattgaagaagaaatttatatgggttttgaaatttaaaagatattagtttttgtgatatgtatgttaaatttttttataagttagtaatttttgattatatatggtatttttttaatatagaaattatttttaaatgtagaatttgtttattttattttttatggttgttgggttttgtattatatataaaatggttttgtttttttatttttaaaatttgtgaagataggttttatattttttttttgtgtttttttgtatatggggtatatttttataagttttggaaattttgaaagattttaaaattttttatttatttagattttgttttaagtgtaatgagaggtattaggaagtaaattagttttttttttaggaagttattgaattggtgaagatgatttttgttttaggaaatagaatgattaaaagtggtttaagtaatgattttatatgatgaggattttagaggttggtagttttaggtttgatgaatttgggttagtttttttgtgatttttttagtttttttttgatggttataaggtgattgttgtatatattgtttgtttagattgttgtatttgaaatgggagggtaggggtagtttttttatagtttaagatttggttatatgattattattaaagtattttttggtaaagtaatgaaatgattgtgaatggttttgattattgaggtgtattttttggagttgagttagttttttttgtatgtattgtagtttgatttttgaatagagttttagatttgttagtaagaaaggggaggtagatgagttgtttatagggtttgatatggttattgaattattttaggattgtgtattaattaattttattttttatttagaggtagttataattttattttttgttatgtgtttttgtgaatttagatttatttttggattttgttttttgtttttgtgatatgtgtttttgtatattaatattgtatttttttagttattatatattttggtatattttaatatttagtagtgtttgttttatttattatttttttgtttgagaattttttgggttatttttgtttgttttttaaatgaatattagaattagtttgtgaaggattgaaaatatttttgtttgttttttttttttttttggtttgttttttttttttaaaaaaaatgtggttttgttatatttatgagtggatttaggggaaatagggttatttatagttttgttaattgttttatttatgagttggatgtgagtggtttgtattttagtgtagttgggtttttttttgtgttagatagggattttttaagttatatagtaaattatttatttgtttgttttttttagattgaattttttagtttaaattttttttttgttattagttgaggtgttagttttttgaaagttttgtaaattgaggaagggatattatttaatttttattttggttttggaattaattttaagatagataggtattttgttttttggaaaaatgtagaaaattattaatttatatttaatttttttattaaatttatttatttaaaagtatgaattttttttttaatatttgagattttaaattaaatgtatttattaatgtaaatgtttagaaatttatttttagtaaaaattttatgtattttattttttgttgaaaattgttttattttttattttatattaattattttatattttatttgataattattatattgagagtaatgatattttaattagttagttattttaatttgaaaatttttagttttattaattattaatgatttttaatgttttttttttttgttgttgttgttgtgttgtattttatttgttgtttgtttatttttttaatatttttttaagtttttatgtttaagttatttttatgtaattttggatgttattaggttttgtttttttaaaatttttaatgtataaatagtatgttgtgttttttttgatttttttttaaattttattttaatttgtatgtatgttttttttggtttgaatgtgttaagttgatttttttttgttttattatttatgttattatttatttaaaataggttattgtggaatttattatgagggataaaatgtttaaaaagggaggaagatggtggtttttatggaggggaagaaatattataattaaggaggtaagtttagaagataaagtagtgtttatatttagtaagtgttggttttgtgtagtgagattggtttttatgtatttatattagagaaatgaagataggttttagtgttgagtttttatgagttagttttgttatgaagtagggtgagtgtttgtggaatgtggggaaggtggggaggaaggttaggagttagtagtataggtgttattttttggttttgtaattgttgggagattgtggtttagttatttttttatggtaagattttgttatttataaaagaagggatttagtttgggaatttagttttttaagaaattaaatattttttttttgtttgtggagataattttttttttttttttttttttttttttttttttttttttttttttggagatgggtttgtttagttatttaggttggagtgtagtggtgtaattttagttttttgtaatttttgttttttgggtttaagtaatttttttattttagtttttagaatagttgggattatagttatgtattattatgtatagttaagttttgtatttttagtggagatggggttttgttatgttgtttaggttggttttaaatttttgggtttaagtgatttgtttgtttaggtttttgaaagtgttggtattataggtgtgagttattatgtttaggttgtgaggataattttaatgaggtatatttatagtagttgattaattttttgagtttttttattgaaatggtatgtttaaaggtttatggttttggtgtttatgtttatgagtgtttgtgattttttttagatttttgttgtttttttttttattttttgaagtgtttgttttgtttggtttttaggtttttgtgtttatttgggttttttttttttagtaggttgtttttgttttggtttagttatttttaggagggtttttaaagtttatgttaggttattttttttttttttattttttattttttttttttgtttatgtgatgattttatttttgtttttaaattagatatttttttttattttatatttatttattaagtagttgattaagtagatattgttttgtggatgttttaatgtattttaaatttaatgtttttagaattgaatttatgggatttttgtgagtttttttattattggggttatagttagaaaatggtattattgtttatttgtgggtgagatttatgtttttagttttatttttatattaggttttattagttttttatttgaaatatttttttgatgtgtttatgtttttttagttttgtttttataaatttgtattattattattttttttagaggtgtttttagatggtttttttgtatttatttttatttttgtttttttattttttgtattgtagatgtattggtttttttaggggattgtttttatttttgttgttttttaaagttttattgtggttttttagggtttttataatgaaggtttgtgtttttattatggtttatagtgtttgtgtgttttagtttttgtttgtttttttaattttatttttgttgttttttgttttttgtgtattagttttaatggttgaaggtattttttattttgggggttttgtatatgttatttttattatttagtattttgtggattttttttttttgttttgtttagttaattagtagatttagtagttttttttttgtagatgagtttggtttgttgttttttgtttgtgaattttttttttataaattttgttatagttgataattatgtaattattagtgtgattatttgatgaattttttttttttgtttagatttgaaattttatgaggtagagattatatatggttttgattgttttggtgtttttggtttttatattggatttagagtaggggtttagtaaatatttgttgagggtatgttgattattttgggaaagtagtatgaagaagttatagggataatagttaagttggttattttaattataaattgttatgaattttatttatgttattagttgaaagggaaaatgtttgttggaagagttttattaagatataattgttttttgatattttttgttagtatatttgaggtttatttattagttttattaatttttaaaggttattgataaatgagtttaaatatatatgttttatattagaggttttaaagtatgaagggtttttttggtttttttattagagagtagaatgttttagaatttaagatggaagtatattttagtgatttttttgtagaatatttaaatttttattagtttgtattaagtggagtgttgttataaagtaaggaatagttatgaaattaaatgtttttttaaaaatttgaaatatatttattttagttagatatatatttgggaaatagtttaagaagaaattgttaatagtgatggttaagttatatgataaatagataaaatataattggatatattatattaattatttgtgtggtaataaaaaaatttaaaggatatttgaatttagtttatgttagttatatgttaagatagttagtttattatatagtttgtattgtttattttttttattaaaggattgtagatttttttttttgatgaaatgagtatagagaaagagatttagttgtttatttttggttttttggtatttttttttggttttttttgtttttggggttagtgtttatttttgtttttttttgtttgttatgtgtttggttttgtggtttagatatagttttttttaatttttatggtagtgttaggagatggagaattttatttgttttatagatgaggaagtgaagttttgaatagttaaatgatttgtttaaagtttgtaagtaagagaaataagattgggtttaggtatttttttagaaatttaaggttttttttagtatattaatagaggattttttattaagagtatgttattttggaaaagaagaaaatgtttttatattttttttaagtaaaatatggtataaaaatatttttaagtgtttttattagtaattataagaaaatattttgaaaggtttttagaatttaagtagtttttgattaagtatttgtataagttatagtgatgatggagtttggtttggtgttataaatatttatggataatagatttgtttttgttaaaaatattttttggtttaattgtatattttttagtaaagttgagattaggatttattgaaataaatatagttagagttttttgggtgattgttagggtgggtgttattggggaatggtttatttttaggggttttgttttaaggaagtttatgggaaaatattggttgtttgtaagttttttttttgtggtatttttgtgatttttttttttttttttttttaggaaagtaagttagagtagtgtttggttggtaaggtttatagtattggagagtaattgttgtagtttagtttggttattaggtgtggtaggaggttttttgggatgtttgtagtttttttttgtatttaagtttatggtgtgtgttgtttggatgtagatagggtttattatatagttttaattttggttttgtgatttatttggtgatttggagtaatttatttaatttggtttttttatgagtaaaatgtatgtagttgtttttttagatagttaatttgtaaaataaatgtgagtttttagtgagataatataattagagtattttttatggttttggtatgtaatagttttttatatatagatgatgatgatgataataataatagtgagaataatgatagtgatgataggaataaatagtagttttaataataatatggaaataagttttatttttgaaggaatttgtttttttttgtaatttaaatattgattaggatttatgttgatatttttaatatggatttatatttatttggtataggagaggttagattttgatgatattgatttgtatttgtggtgttttgtttttaggttaattattttgtatgggattggaggtgattttgaggatagttttgttatatattaattatgatggtggtattatatattgatattgaatgatttgtgttgtattattttttattttttattttatgtttatagtatttttgtgtttaagaaatttaggattttattttttatttagtagatagaaagtgttaatagattaattggggttagatttatattttatttatttttgtattttggaggttattgttttatagagtagttgtttttaaagtgttgtttaattgttattgaattattgaggttttttttatgtgttgttgatttatgggagaggtaggtgtggatttttatttttttgaattttggttatggttttgtgttttaaataattttatatttaggattttttgttataaatagaaatttatgtgggaggtaggtgggaaatgatttgatttttttattgttttttgtggagaagaatagggtggagatgagtgtgtgggatttggtaggggtgagtttgaatgtgattgtgaatggtttggtttgtttttgtttgggatgtttttgaaatttttttgttttttttggtggtgttttaggtgtttttttttgatttattgttggtttgtgttttataggtataagaaagaataggaaggtattagggtattgatattttttagttgggaattttgagtttggttgtgagtgtgtttggaagggagaaggtaggtgtgttgaggatggagtttaggttaaggatatgttattttttgagtagttagtatggaaagtagatattttaaaataagtggttgtttattgtataagttgtagtggaagtagttgatattggagttaggtaagtgtggtttggaattttagttttgttttttggtaattattggattttggggaagttttttgatatatttgagtaaaggtgttagtgttattgttagtgtttagataggttgggatggagttggtttggaggttgtatgggaggtatgttattttaaaagaggtatatataataaagatgtgaaattgtgtgtttttagtaatttaaattaatttaaatagttatattagaaatgttttgtttttttggaatttattttaataattttttttgttttggtaataatttttaaatataagaggtagtatagagtaggatgtatagtagggattttgtttaatagtttttagtgtgatttttggtaaattaatttattttttagtgtttttatttgtgaaatggggttaagaataatattgatgtggtagattttgttttattgggtttttgaggtaattttatgagaaaatgatttagagtgtagaaattaattggggaggatggttttgtggttatttggaggatatgtgtttaattttaaattatatagtttttgttggttgaatgtaggatgtttgttaaatttattttgttttttggtagtgtttaaggttgtgggagtttattttttatattagtgtgatttggatgtgagatatggagttaaaggagattattttggaatttttaaatttaatgattgttttattggattttatatttgtatggggtttgtagtttttttgttttggttaatttgttttaatggaaataggtgtatttatttaatgtttgtattttaattgtatttaggaagtaatttatttgtttttgattttattggtttataggtagaggggatttgttttagatgagattttggattgtggattttgagttaatgttgaaatgagttaagattttgggggattgttgggaaggtatgtttgattttgaaatgtgaaaagatatgagatttgggagggtttaggggtagaatgatatgttttggttttgtgtttttatttaaatgttattttgaattgtaatttttataatttttaggtgttaagggtgggattagttggagggaattgtattatggggttgttttttttatgttgttgtttttgtgatagggagtttttatgagatttgatggttttataaatatttggtatttttttggtttgtatttattttgttttgttgttttgtgaagaaggtatttgttttttttttgtttttagttatgattgtaagttttttgaggtttttttagttatgtggaattgtgagttaattaatattttttttttttataaattatttagttttgggtatttttttatagtagtgtgagaatggattaatatagttagttttagatttaggggaagatgggtttgagggttagagagttaggtttataagggagggaagaggatagtaattgggaggggtttgtatatagtgggtatagtggtattgttggtgttagtattgtttttatttttattttttttagatatagtaggtaggattttaggagagtgtggagagtagtgagatatttttgtagttttttttatgttggaattttagtttttgtagtttatttggggtgttatggatttttttattgtttgatataattatatttaaatggggtaaaaaatgtttttttttattaaatagaaatagttggattatttgttattttgagttagttatagtatggttttttattaaatttgaaaaattaagaattgatttttgtgaaaatttagattttgaaaagaatataaagtttttttgaaaaatgtaaattttttaatttatattggtattttagattttgagtttttttattagagttatgtagttgattaaaaaaaaaaaaaaggtgttagaatgtttttttaattgatagatgtgattgatagaatagtttttgaagttttataattgagtaaatagtttgttattatataaataattaaaatagtgtttgaaaaatgtatattgataagtgttaatttagatgttgtttatagttatttttttgtgtatatatttttaaatgatatgagtttttttgttttgttttgttgttttttgtagatattgtaaagtaagtaatatttaatgagttattgtaaggggtggggtgggggtttttgaaaaggaggtattttattttgtgtagggtggtgtaatttgagatgtggtagttgtaaatgattgtgtatttgttttaagttgaaattattaatagttaattgtgtattttgtattttagtttttgtatttgtgtttttttttttgtgtttttttaaatatggtatgttgtataaatttagtggattttttttttaaagtagtagatggaaattatagttattttgttttgtttttttattttgttggtagaggtatatattaatttgttgttattaagagttttgttttatatttggattttattttattttaaattgtttggttggaatataaatatttttttatttaatgaggggtttgtagttttgttttttttttgtttgataaggaaatttgtattatttttttttttttgtttttagtagtatttgttaggttgtattagttttaggattatatttattttatttgaaaatttttagattgttggtttagaggaattagtatggtttataggatttgtaggtgttagaattggaagggattttggttggattaggttattttatagatgagtttattgaggtttagggaggaattttttaggatgaggtttttgttggggtttatgtttgggttttttagtttaggtttttttagtttgttatttgtttttattttgaagttttgggtggatgtgatttagttgtttttttgtattttaagataaagaaattaaggttgaaagataaagaaatgatttttttaaggtaatgtagtttgaagttattatgggttggaaatttgtgttttttagagtttaattgttgtattatttttattttatttagaattaggattagtttttaatgttatggtgttgttttatttatgtgtagtttagttttgttatagattaattatagttttagttgatgttttgtttttttttaatttagttttttgtttttatggtgtatttttttagggttttgttttagtgatttttaaatttttgtttttagtttaggtttttgtgttgtgatttagatataagttttgtgtgagtgggaataggttgtttgttgtgttattgatgtttggtatggtatgtttgagtgttggttgaatgaattttgggttattattttaaagtttattgattttttttttttggggtttagggagtaggtgtttagggaggggttgtttattttaggattggaaggagttgggtttttatataagtgtggtagaaataatatagaagtggaggtgttgtgggatattatttttttttatgtttttttagtattgggtagtattgggttgtagggatttttttttttttttttttgagatagggttttattttgttatttaggttggagtgtaatggtgtatttttggtttattgttatttttgttttttgggtttaagtgatttttttgttttagttttttaagtagttggattataggtaagaattattatgtttggttaatttttaaattttttgtagagataggttttgttatgttggtgaggttggggattattttttaaatgaatatttatggggttagaaagttgtaggttgtataggagattttaagggaggtaggggtgggggaaataggaggtagtaaggtgagaggaagttagtattgagaggagagagtttattgagataaaaagataaagataattttggtatttttttttttatgaaatttagattttttttttatttttaaatgggatgattggtttttttgttgttgagttgtttgagttttttgtatatatattgggtattagtttttttttgaatgaggagtttgtatatatttttttttatttaatgggttgtttttttgttttgttgattgttttttttgttgggtagtagttgttgagtgtgatatagttttatttgtttaatattattaattaggaaagtgtaaattaaaattatagtgagatagtattttattttagttagtatggttattattaaaaagataaaaaataatgaatgtttataaggatgtggatagaagggaatttttaaatattgttggtgggaatgtgaattagtatagttattatggaaaatagtatggagattttttagaaaattaaaaatagaattagtatataatttagtaattttattattgtttatttatttaaaggaagggaaattaggatgttaaagggatatttgtatttttatgtttattatagtattatttataggagttgaaatatggaattaatttaagtgtttattaatggataaatgaatgaagaaaatgtgatatatatataatggagtattatttagatataaaaaagaatgaattttgttatttgtggtaatgtgggtggaataggaggttattatgttaagtgaaataagttaggtatagaaagataaatattatgtgtttttatttatatgtgggagttaaaaatattgattttatggaggtagagagtagaatggtggttattagagttgggaagggtagaggggagaggaggatgaagagaggttggttaatgggtataaatatatagttagatgaaaggaataagttttagtgtttgatagtatagtagaatgattatagttaatggtaatttattataaattttaaaatagttagaagagaagatttgaaatgtttttaatataaagaaatgataattgtttggggtgatggatatgttaattattttgatttgattatggtatgtatgatattttgataaatgtaaatatatatgtttattagaatattatatgtattttataaatatgtataattaatatgttaatagaaaaataaaaaatatgaaagatagtaaaaaaaaaataagttggagttttgtgtatattttaattttgtttagaggaaggtgttgagttagaggttttgtaggaaggtaaagtattggagggtttgggatgtgttgttttgggggttatttagttttttttatttagtttaaggtatttattaagtgatttatatagtattgaggtatttttaaagatagtggttttgggaggtagagttgatattattgggttggggattatgttatagtaggatttttattgagtgaatagttaattatagatatgtattatgtgagttatttaaagaaaatgagtttaatttttattttgtattttttagttttttattaaataaaaaagtttagaagagttaggggtattgatttgtatattttgagtagggaagtaaggtgtattttttgtttatgggatgattttttgggggattttgagagaagaattggtgagttttttttgtttttattggtatttgtttgtaagttttagaaaggttttaattgtttggagttgtatatttggtgagttttatatagggaattgatggatgagtgtggatttgtagaaatttggatttttagtgtttggtatgtagttttagataggaagagaagagagatagagaagatagtatttttttaggttaagagggagtttaattttgtttgttatgagtaggaatttgttggtttaaaatagtggtggtagtttattaataggtaagtgaatgaggagaggtagtttttatatgtgtaatgtaagagatgtatgaatggggatgtagtgagagtttattgataaatttaatgttttatggtaaatgattatttgagagatgggatttaggagagattggattgatttagttattgattaaaggttaatgtattttttatggttatttagatgtattttttaattggtgatgatattattgtgtgttttagggtaaagtatgaattattttttagtgatgaggagtgtgtagttgttaagttattaaatgtaggttattttttttttttgtttaatgttagttataagaagattttttggttgatttttgagtagtttgtgagttttttatgtttggtgtggttgtgttgtgagtatatgaggtttttgtagatttttaaggttgtgtgatggttgggatgtgtttgttatttgttattttttattttagggggtttgtaattttttaattgggtatttgttgtttttattttaattttagtattatttaggttgggtttttaatatgattttgttttttgttttttttttttgttggtttggttttggaggatttagtttattagagttaggaggaaggtagtttggtggagttaatttgttttaaggtgttaattatagatagatttgaaaattatttaagggtgtttttgttttaagagagagatgtttgttaatttaaatgtattttttaagttggtggaaattaagtagttgtgatagaatttagagaattttaggtaattaggggtattatttggttatggtgtttttttatttttttgtgtgtgagattagttttaattaaaagtttttttttggattttgttggttatggttagtgagtatttgtttttgtttttttgtgaattaagttttgtgtattttttttaagagttagtggggagtttggtttaagtgtgagggtgtttattaggaaaagataaggaagaggtttagatatttatttaggttatgtgtgggattttgtagtttgggggtttttgtgtgatttattgtttttattggtgatattggggatatttgtagttaggtagtttgggggtttgaatggttagttggtgtgtattaggagttttggtatagagatttaaaattgtttaaaagttattttgtattttgaatttggtgtgatttttttgggtttagattatatttttttggatatgaggtatgattgataattaagatttttttttttttaatttgtgttagtataataataatttaaaaatatggttatttagggaaatgtatttttatatttggtttaaatttgtttttttgaatgatgatttttttatttagttttagagtggtaagtgtattttattttaaatttgtgatttattatgttgtgtagttttgttattgaattttggttaatgattgtaatttgaaaatatttgattaaattagtattattttgggaagtagaataattttgtagtaagtaggtaagttgtattataagggggtttgagagagttgaggttttattttgtttgtttagttttggaaagaattagaataaggaagggtggggaaagaaagaattatataagggtttagggtagttatttgtttttaaagttgaattttgttttttatagaatagaagttaaatgtttattaattagggttttttttttaagtagataaatattaatggtttatgttttttagaaaagtttgaagttgaagaatggttttaatgatgtggtttttagtgttattatgtagtattaaggtatgtgttgttgtgagggtattatttatttgtggaattgggatgataaagttattatttttgatattgatgggataattattaggtaggttttgttgatttggggtttatggtagatttttttgttttattgtgggggtttttgggtttggtgttggtatttttgttttttttatgggatttgtatggtttgaattttggtgtagttggagttttttatgtagttttagttttttggtggtaattattgtgtttagggtttagttgtttttttttggggtattattatttttttgatttggttgtttttgtgggggttttttaagaatgtttttttgaatggtttttatttttgattgaataagttggttattttgatgtatgattagattggaggtgtttttttgtggattatttgtttttttgttagtattaattttgatgatttgagttttgggttttttatttagaaagaaagttgtgggttttgtttgtgttttttttttttttttatgaggtatgaatggtgtaatgaatttgaaagggatttttattttatttttttttttttttttttatttagattagatatttttggttatattttgtttatttttgggaaggattggatttattagggtattgttaagttgtattataaagtgagttagtgagtatagagtttttgttttttgttttttgtgaatgttggtgtgtgtattgtattttgtatatggaattttttttgttttagtatggggtgatttgtagagagggttgtattttaattagggaggggtagtgggggttaggggtagtagtggagtttagagtgaaagtgaattttagtaattttaaatttgaatttaatattaagaaataaggggtgaagtataggggaattgattattaggagaatatagatggtggtagtattaggggtgagattgaggtttagtttattttgagggatggtagaggtagttagttgaagaaataggagtttatatgttatatatgttaagtgattttttgtagattaaaaagttgtagattttaggtaagttttggtggtgttgtagattttgtgagttaattagtagggtatattatgtttatttggtttgtggagtgttttagtaagtggtttaaaatagaatagtgtttattgtgggatttttagttttagatattagatgggagaggggttttttgattgtttttttgtgttgggtatatgggttattttatttatattttatagagattttgaaaagtatataatattatttttgtatttagatgagtgaaattaattaggagaattaaagtgatttatttaaatttttattgtttttgtttgtttttagggtttagagttttgtagggattttttatgttttgttttttttgaaatatttttattttagtttgttaggtttaagttttttttttgtttagttatgttttttttagttttttgtggtttagagttttttatgtgagtgaaatttttttttttatagtattttgttttttagttagttagagttggaaggtgtttttgtttgaattaggatagtgtggtttttttgtgggtgaggtgggtgagtaagttatatttatatttagtgagtgttaagatagtgttaagatggaagtgttaggtttatggtttttaattttgtttgtttatttttagtttatagtggtgatggtagggaatgggttattatttagagttgtttttagaattttgtgaatatagatgaatgaattgtatttttttgttttgtatttgtttatttatttagtattttttgagtgtttgttagtgttttattttagggtaggtgtttgggattgttatgaattaggtaagtttttgatttgggattttatgatttagtagaaaaatggtggtttggagagagaattttaattttggtgggattaaaagttttagattttgttgggtatatgttgatagttttagttatttgggaggttgaggtgggaggattgtttgaatttaggagtttgaatttagtttgggtaatatagtgagatttttttttatttttttaaaaaaataagtatgtatattaaaaaagttttagatgttattttagatgtttaagtttattggtttgattttatttttttagattttatttttaaaaaattattaatataaaagttatgtatattttttaagatataaaaatattaataaaagaggttgagattatggaaatagtaaagtgtagaggttgtattatttttttgtttgtttttgttgtaagttatttttttttttaaaagtagaattattatgaatagtttggttttattttgttgaattttaaaaatttatttatatttttatatatatatatttatattatttaattatttattatattttttttgttttattttatgtaatatttattttattttttttgttattgggtagaattttgttgtttagatatattatattttttttaatttgttttttattgatgaatgtgtaggtagttgttatttttttttttattgttaatagtgatgtagtaagtgtttatagataatgtttatgatatataatgtatgtataaataaataaagaaggtatatatatttagggaagttttgttgtaaagtagatttttaggagtagaattgttgggttaaaggatgagtatatttaaagttttgattaatattgttgaattgtttttttaaaaggttattttagtttgtgttgttgtaggtggtgtatgtgtagtgttgtttttttatagttttattatgggttgattttttatttagaaggattaatttatttatgaggtgttttgatttgtgtgatattgaaaattgtatttatttttagttgaaggaaagaaatttttatgggttaggatgttgagtagtgtatagttgatttatttggtttttggaatataaatttatttttgtttttattgtaatattaaataagttttgttgttttttaattttttttttttttttggttttgatttgttttttggtttttttagaagagagatttttttgaaaaataaagttgtgtggtttattgaagaatttttgattatttttttttttgattggttggtttagaatgagtgaaatttgtttgtttggatttgtagatattgtttggagtatgatgtgatgtggagatttaaatttttgtttgtttattgagttggatatgtgtgttgtttgtgtatttagttaggtttgtgtgatttgtaggatggttagggtttttgaaaatttatttttagggtagttttttataatttttagggttttttgtttagtattgtaggaggaggtgttagttttttgatgtggtatttgaaatttggtatttttaggttttagttttttgttaagtttttatttttagttgttgttttttagttttttttgttttaatttagtgattttgttttttttttgtattttatttttttttttttgtttttgtttatgtggtggttttagtttgatatggttttttttttgatttttgtttttttatatttttatagtttttaatgtttggtttaaatgttatagtttttaggttataatttgtgattttagttagttttggttttttttttgtttttggatttgttggattttatgtggatattggagggtttgggtttggtttgttggttttggtttttattatggaggatagtttggatatgatggtagtttttagagttaattattgatgaaagtaatttttattttagtaggtttttttaagtttttttatatgagggttttagtagttattattgggagatttgttaggttaagaattgattaaggtttgtgatttattgttttagtgatttttattatatttttgaatttgtattgtgatttttagagaaatagagaaatgatttttatgttagggtattagggaaaagatgttgtttatatgagggtttgtggatttttttttgattttgttttttttaaatttgggtatgatttatattttatgtattgtagtatttgtttaatgaaaaagttaatttttagttgggtatagtgattaatatgaatagtttgagtattttgggagtttgaggtaggtggattatttgaggttaggagtttgagattagtttggttaatatgttgaaattttatttttattaaaaatataaaaattagttagggatggtggtgggtgtttgtaattttagttgtttgggaggttgaggtagaattgtttgaattttagaggtagaggttgtagtgagttgagattgtattattgtattttagtttgggtgatagagtgagatattattttaaaaaaaaaaaaaaaagagagagtgagagagagagaaaaagttaattttgtagttagttatttgtttgaaataatagtgaataaggataattttgttttttgttgaatttaatgatttgtttggatttagttagtttatgaggaatgatttataaggttaattgttattttgtttatagagagggtataaagttggtttgagtattgatgaaatagaataaatgtaaatggaagatataggaattttttttagatttaggtgtatttaaaattagaaggaaagttaagaaggattgttgtttaaaagatttagattatttagttaatgggttttttgaggtttaaatttgggtaataattgtttgaatttttgattttattttatatatgtttttatatttatgtaattagaagttagtgtttttgtgatttagaaaaaagaatatttattgtgttttttgaggtttgttagttttgttggggtttaggtatgtggtgttttaagttagtggattgaaaatgagaggtatttgtagtagatttgttagggttttttttttttggagatggagttttgtttttgttgtttaggttggagtgtaatggtatgattttggtttattgtaatttttgttttttaggtttaagtgatttttttgttttagttttttaagtagttgggattataggtatgtgttattatgtttgggtaattttgtatttttagtagagatggggttttattttgttggttaggttggttttgaatttttgattttaggtgatttatttattttagttttttaaagtgtggggattataggtgtgagttattgtgtttggtttagattttttttttttttttgtttgtagtagttattttttttatgttagtatttttttgtttattgtagttattgttttttgttagtaagagataggatgatgtgagatgataagagataggatggaaggtttgattaggagttgggttaggattttagaagtggtagttattagtttattttgggttttgggattgagtattttttttattttgagttttgttttttttttttgtaaaatgagattaggttagatgatttttgaggttattgttaatttaggaatgttttgtttttggttgtgtggattgtataagggtgtgttttgtttttttaagttaaattttagtttaaatttagagggagtttttagattttggttgtattaggagttgttttaggtgttgttgggggtgttgagtagtttttttttttaagaagtttgtggttttgtgggaggagatatttagggttttttgtaataaggtagtgaggggtagattgagtgtgaaagatgttggtttttgttggatatatattaggaagttaattttgattgattagaggtgttagaggaggtttttgtgagaaggtggtatttagttgagtttttatggaggagtagggttttaaaggagaggaaagtttattataggtggaagtaggagtgagaggggaggttgggagatgagtaggtattgggtgggtttattgaaagggagattttggtgtagatggtggggtgggtaaaagatgaagtaggaaagtaggtaggagttaggttgtagagtgtttgggaggtaatttattaagtttgagtggtgttgagttttttttttttaaggtggtttgtgattttttttttttttaggatggtagatggggttatagagttttttttttttatagtagtggtttttaattgatggatatatggtagtgtttagagatgtttttgatggatataaaggggtatgttgttgatttttagtgggtggatttgggatggtgttgtatatttgatgaggtggtattgtgggggttttggtttttaatagatatttttttaattttagatgttagtgttgagaaattgtagtttagaagtttgtaaaatgtttttgaaggtaatttttttaaattatttaaatttttttgagttagtgttttaagagggatgtagagattaggtagaggagaaaatttgtattaagtttgggtatggattttttttttttttttttttttttttattttggtgtttttttagagttttgttttagttgttgagaatgttagaggaataggggtgatgtgtgtattgtatttttatttattgatattttttatttttgggttttatttgtttttttgggtattgttggttttttttaagtattttttgtttttgtggggtagggttgtgttatgttttgtgtgtattttaagttttgtgtgtagtttggtataggagtgtttagtgagtgagtgtgtattgaagggattgtggaaggagtttgtgggttgagtagggatttgggttgggttggtttgtgtggtatgttttgttattggttgtttttttgagtgaggggttttttttgtgaggggtattatggagatttagtgttgtttgagtatttggtggggtatttgttggtattgtagatagtttttgttgaaggtaggagggaaggtttttttattagtagtaaatattttttttattaggttatttttgagttggttttttagttaagtttagttaggtaagaaggttggtatgttgatagtaatttagtggtatggtttaattgtgaaatatatttgataatttagttttgagtgagattagtattttagatttttgtaggtggtagtttttaggattttgatgtgaagagttatatatggaaatagtgatttttttttaaagattgtatgaattagatggttaaaatataaagatatttagaaattaaaaagattggttgggtgtagaggtttaggtttgtaattttagtattttgggaggttaaggtaggtggattatgaggttaagagattgagattattttggttgatatgatgaaattttgtttttattaaaaatataaaaattagttgggtgtggtagtgtatgtttgtagttttagttatttaggaggttgaggtaggagaattgtttgaatttgggaggtggaggtagtagtgagttgagattgtgttattgtattttagtttggtgatatagtgagattttgttttaaaaaaaaagaaaaaaaaagaaatttttaattttgtttgatttttagatgtatttttgtattttagataagttgatatttttagattttttttgttttaaaatttttttattttttagttttaaagaatatgttattgagtaatttttgaaataaatttattggttattataaaatatttatggtagaataatatgttggataggaagtgggtagtttatttatttatttagtaaatatttattaaatgtttgttatatgttaagtattgtttttggtatgggggttgtagtaaagaatgggataaagtttttgtttttatggagtttatggatgaatgagagatatagttgaatgaaggattataatgttatattagtgattagtgttaggaggagagggaaggtagagtaagggttagtgtttgggtgaggagtgagggggtgtgtgttttattgtatgggggaggttaagggaagggttttttggagaggtgagatttagtagagatttagatgaggtgagggtataagtagtttttgtagattgggggaaaggtgttttaggtaggaggaatggtatgggtaagtgttagtgtagatgagtgtggtgagttggaggaaggatgggaatatttgtgtggtttgttaggagtgaggagttggatagttattgtagatggggttggggttggagagaaaggtgggggttaggttttgttggttttataggttatagtgaagggtttggatgatgtttgtgagaggttgtagttttaggagggttttgagtgtgagtgggttatgttttatatttttttagagtattatgtggagttgggatagtagtagggaggttatttaagattgttgtagtaatggaggttaggaggttatgtggtgtggatgtggtgggagtattgggtggtgttgagggtggagtagaggggatttgttgattgtgtggtgtgggggttgggggtaggtagatattaatggggtttttgagggtttgatgttatatttgggttaggagagtgttatttgttatttgtagtgttatttgtaataggggtttttgaggagttttggggtgagttggggaggagttgttgtggtgtgtgtggttttggaggtatttattttggagtgtgatgagtattgtggggtttatggtgagtatgtattgtgtagtgggtgtaatgtggagtttatagtagtttgtagtttgggagaggggtttggatggggtttatgtatttgggagatattagtgtatagatagtgtttaaaatttttgaataatatgttttatttaatttaatatatttaaaatgatattatttagatatgtaattaatatgaaaatgattaatgaaatatattatattttttttttttttaattaaaaagtaaattttaatgttgaaaatgtaaatttggggaagatagaaaaggttatatatagggttgttattttatatttggaaggttgtatagtggttgggtagaggtgttttttattttttagatagggtggtgtatatttttttttttttataatagattttgaaatttggtatatattttatatttagagtatattttattttagatattaaatttttgatagttaaaaaaagtgaaatggggttgggtgtggtggtttatgtttgtaattttagtattttgggaggttgagatgggtggattatttgaggttaggagtttaggattagtttggttaatatggtgaaattttgtttttataaaaaatataaaaattagttggtgtggtggtgtatgtttgtaattttagtaatttgggaggttgaggtaggagaattgtttgaatttgggaggtagaggttgtagtgtgttaagattatgttattgtgttttattttgggggatagagtaagattttgttttgaaaataaataaataaaaaaaaaaagtgaaatggatttgttaatgtaataaagttgtgtttatagattagttgtttttttagtttagatatggtatttggagttgtggaagtgggtgaggtttttaggttttttagggagtgtggggggtgtggagaaatgaggtttgagaattttgggtgtttgtgtgttttgaggttggtagagttgatgggagtaggtgagttgttgtgtttgggaagtggtggttgttgaggaggagaatatttggatattttggagttttgggagttgagtgatttaggtgttttgggagaaggaatgagtttttgaggtagatgttattggggagtttatttttataagaattgagagttgatatttgggtttggtaagatgggtattagggtgatttgtgtagggatagtaaggaagggaataagagaataagagtttgttaggagtgtgaggagaggaaggaaagtgaagaagtggatttaatgtttgtagttagttttttggaagaattttgttataaaagggaatagagaaatggtattttagttagagagagattaaggatgttttggtgtgtgtgtatgtgtgtgtgtgtgtgtgtgtgtgtgtgtgtgtgtgtggttgttttggtttggtttgttttaaggatgaaatgagagattgtagaatatttatgtgttgatgtgaattatttaaaagagaggaggaatttgatggggtgtgtgtaggggtgaatgaagtaaatgttggagtaaagtgtgtgaattggtaggtggttgtggttttgttgtaggggttttagttaagagttgggattagggggagtataaggggtttaagtgtaggtaggtgagttagttttatttatttgaattttagtttttatagtagtaaaattaggggaaaatatttatttagttatgtttttttgaggattaaataaagtggggaatgtaaaagtatttagtgaattatagtgaaatgtatttaagtttattttttaattgtaagtaagattttgtagaatgtggatttttgtatgtgggggaatttgaaatagtgttattttttatagaatagatatggattaggatttatgaatgtagaaaggttttattttttgatgttatgaaatgtgaatgttttatgttttttaggaatggatataaatttttttattgttttgtttgtgttattgggatggtggatatgatgtggggttatttgtattgggttaatgagaggggtatggtgttgttttaggggtttttgttgttgagttttagtagttttttttttgttttgtataggtattaggtttgttttttgtatttttatttgtgagtttgtttagatttgttttttttttaattgtaagttttgtaagaatagtttttttattggttttttgttttaatatttatgttttatagtaggtattagaaaaattattttaaatataggtttatatttgtattggttttttatggtttttaggttgagtttagatttaggagtttggtgtttggtggttttttatggtttgtgtttttttttttttttaggtgtgttttttttgtttttatattttagtttgtgttttttagataattgtttttgtttggagtttttgtatatgttgttttgtttttttgggttatttttttgttttatttttttttgagtggtttggttgaattttaatgtttgttggataatgagtttttattttatttttttagggatttttaagtggtttgtttgtgaattattattatttatttggtttttgatatttattatatttgttattttttgttttagatttttgggaatattgtttattttatgggttttttaatagattattggttagtttttgattatttttttttttttatttatggggttatattaaggtagttaagttagattaattttggttttttggagttggaggaagaaaatattggatgtttttgtagttggaggtttagggtaatttattagatattttttaaagtaaaagttattgtggttaattataggatattggtttttgttgaaggttgattgtaaatattataaatttggtttttatgaatgttattgatgtgattttgtttgaatttgaagattagatgaattgtttgttgttgttaattatgtaaatagtggaagaatttagatgggttttaaatgttgtgttgatttttgtgtatttttttttagttttgtaggtattttttttattatggtgttgttttgtgtaagtagtagttttttttttgtagtaaaagatgttaaattgagatatgtatattttaggggagaaaagttaggtataatttagtgtattttaagtttttagagttattataatagtattgattttaatagaaattttgatattttagtgaaattgtgtttttaagttatgttgataatttgtaataagttatttattagtttgtgttaagtagtaaggttttgttaggttaagtaaaaagtttatattgttattttgatattttaatattaattatgtatttaaagtgattttttttatttttttatttaaatattattgtttaaggtgtattgttttttttttgggaggaattattttaaaaattttaaattttatagttgatatgtttttttggaaggttaaggtgttttagtggtagatggttattggtttggttttttttagggttgttattaagttagagttgttttatgtgttagttgttttgtggagttttttagaattgttagtgaaggttgttttaatataaatgattttttttttttttttttttttttaattttattttaagttttgggatttatgtgtagaatatgtaggttttttatataggtatatatgtgttatagtggtttgttgtatttattagtttgttatttaggttttaagtttagtatgtattagttatttgttttaatgtttttttttttttttttttttaattttttgattggttttggtgtgtgatgtttttttttttgtgtttatgtgtttttattgtttaatttttatttatgagtgagaatatgtagtgtttggttttttgtttttttgttagttttttgagaatgatggtttttagttttatttatgtttttgtaaaggatatgagtttatttttttttatggttgtatagtattttgtggtgtatatgtgttatattttttttatgtagttttattattgatgggtatataaatgattttttttagtataattttttaattgggtgtagttttgattttattgttaggttttgaattaggatgaaggaggggaaggtagtgggtggatatgtgtgtggtgtagttggtaaaaataagtttttagtataggatggtgattatttagtttttgttaggagtgttgtgaatgtttttttttagtttatagtttttaatgaaaataaatttagttttatgttattgaatgtattgttttttttgtagttgtgttttttgtgtattattaaagttttttttgatttgtgggtatgaagatagtttttttggattttatttgaaggtgttgtttttatatttaggtttatagtttattaagaatggatttatttaggtagaatgaagtaggggtgtagtttaatttttttttttttatatggatatttatttgtttttatattatgtgttaaaaagattgttttggttgggtgtagtggtttatgtttgtaattttagtattttgggaggttaaggtaggtggattatgaggttaggagatggagattatttggttaatatggtgaaattttgtttgtattaaaaatataaaaaattagttgggtatggtggtaggtatttgtagtgtagttttagttatgtgggaggttgaggtaggagaattatatgaatttaggaggtggagtttgtagtgagttgagatagtgttattgtattttagttttggtaattagtaagattttgttttaaaaaaaaaaaaaaaaaaaaaaaaaaaaagattgttttgtttttgttgttttgagatgttattgtggttataaagtaagtatttgtgaatgtgtggttttgttttggggttttttgttttgttttattggtaaaggtttggatgaattggttaaggttatagtgttttagtttttatagttgtagaagttttttatttttttagtattggaagtgttaggtttggttttttgtttgtttttgtagtttttagatttaaattttattaaaatatttaagattttgttatgagtttgattgaaattgtagtgaatttgtagagtaatttaggaagaattaatattttaaaattatattggattttttaatttaagagtatagtttattttttatttgtttaggttttttttaatatattttagtaaagttttataattttagttgtaaaggtttggtatattttttgttagatttatttttagatattttatattttaaaatttgatttaaaatattatttatataattattttttttgtttgtttttaatgtatgaaaatgatgtgattaatttttgtattttttttttttggtatattgatttgttaattttattagagtttttttaattttggtaatttatgtgtaggtttatttttttaatgtgtatatttgttttttgtgatgataatttttttttttaattttttttagtatgtataatttttatttattttttttatattattgtatttgataggataggtaatatagtagtgaattgttatgatgatatagattatttttattttattgttaataagatgtttattgtaggtttttttagtatttttttttatttttggttggagtttttatttggattagatgttaaattgtattaaattttttttttaaatttaagtattttaaaaaatgaattttaatttgggaggtaattggtattaaatattttttttgtatttattgagatgattatgttttttttttttaatttgataatgtgttatattgattttaaatattaaattattattttatttttggaataaatttagtttttatatattgttataatttgtatatatatatatatatatatatatatatatatatatgtgtatatatatattttagaatttttgtatgtatatttataaatgagattggtttatattttgtttatattttttttttttaggttttgtttttaaggttatgttagttttattgaattaatttggagatgtttttttttgtttttatgttttgttattttttgttttttggatgattaggataatttttggtgaaatggtttatttttggtgtttttttttgtagaaagatttgaaagtatgggtttattttttattttgtgtttttttgggatgttttagttgtttgatatatattaaatttttgaagatttgagtttttttagtgttgtggtagttttgttagttaaaaatagtttgatgttaaaggaagtttagttttttatgttaatttgttatttatttgtttaatagagaagtgattgaaaagaagttagaaaagtttaaagtttagtgtttgatagatattaaaaatttgtttttttttaatatagaatttttttatgttgtttttggaaattgattagttgtaagtagtagattgggtatagaagaatttttgaaatgattgttttttttggttgttgttatttgaaagttttatttgagaattatatgtagagttagatttttattttagaagtagtagtttggtgaagagttatttgtttatatttaaaggtaaggggattataaattattttatggtttttagggttttttgaaggttggtgggtgggttaaagtttgagatatgggatttaaaattttaaattttaaattatttattaaagtagtaaagtaagaatatttaattggattagtttttttttattagaagggaattgtaaaattagttttaattataatggtgaatttagtattttatgttttaagtgtttagtgttgttttgtattatgaaagaagtgttttgagattttgtatgtattgtttgtatttattggaaagttaagtattttagagaatgtagttgggtattaattgttttattagaaagttttatttttgaaagttatgagagatttttatgaagtaggaatatgggttaaagaataatttgaaggaatgttagaattgtggggatgtggtaggttgttttttttttaatttagtttttgaatagatgagggaattgaggtttagagagtaaaattaattgaatagttttttattaaaggatatttttttattgtattattttgaggtagagttttggttaatgaaaatttgatattttattaaattagaaatattatggatttgtttttataatgaatttttttttaatgaatattttaaattatttttattaaatataggatgtgtatttatataagtaagtaggagtgtttttgaatagaatatttattgttaattttaaaggagagttggtataggaatatgtaaagattaatatttttttgtgagtattgtatatattttatgtgattatgatattagtattattattttaaaatggtgttttttagtttgtggtgtatttttttttttttgttgtttatatgttaatttgtaatttttataatgaaaaaatgtattttaattttttgtattttgtttaaaatataatttttagataattggaattaaattagattttttttgggtttaaaatttaaatttgtggttagagtttgttatagaatggaattgaatgaatttgaaaattagtagtttagatttgttaagttaggtttgaaagtttagaatgtgaatgagaaatataattaaattgaaatatgtgaagttatatttaaagatgaggaattgtatatttttttatatattaaatgttttttattagagatattgttgtgtaattgttaagaattttttttatatttttggttaaagtttagtttttttgagttggtgggttaaatgggattattttttttaatgaggtatttttgtgtgtttagaattatttttgattttattttgttttttttgggtttttaatttattaggatggagagtatttttttattttatgttgttgggaggttggtttattgggtgatattagtttaggttgatttttgtttttttgttttgtttattttagagattatattttttttggtttggtttgtgtagatttggaaaagagtttttggtaggttaggtatggtggtttatgtttgtaattttagtattttgggaggttgaggtgggtggattatttgaggttaggagtttgagattagtttgattaatatggagaaattttgttttttttaaaaatagaaaaattagttaggtgtggtggtgtatgtttgtaattttagttatttaggaggttgagataggagaattatttgaatttgggaggtagaggttgttgtgagtttagattgtgttattgtattttagtttgggtgatagagttagattttgttttaaaaaataaaagagtttttggttttagtggttttagatagtttgaggggtttttttttatttggaggagttagattgggggagtttggttttaggagatttttaaggattggttttttttatgtagtttttgtggttttagatagagagataagttttttttagggtagatttttatttttaagatggtttttaaattagttggattttaattgagtgttaatagggtagttttaggttaataggagttttggggttgttttataagattttttttattttgtagttatgttagtatttaagtagtttttaaggtttgtgtagagagaggggaggttggagttaaggttttgtttttttttgtagaaggtgaggtagtgttaggttgttttttgattggtagaaaaatagtaggaatttgattttttttttaatttttttttgtggtttttgttatttttattgttttaagtggttgattgtgataatgttttgtttttattttttttttattttttaggttggagaggatttattgggtttttatttaggatttgtgttatagtttgtttttatgttgttaataaagatatggatttaaggttgggtaatttatataggagaaaggatttaggttgggtatgatggtttatgtttataattttagtattttgggaggttgaggtgggtggattatttgaggttaggagtttaagattagtttgattaatatggtgaaattttgtttttattagaaatgttaaaaaaaaaaaaaaaaaaaaaaaattagttaggtatggtagtttgtatttgtaatttaattatttggaaggttaaggtagaagaattatttgaatttaggagatggaggttgtagtgagttaagattatgttattgttttttagtttgggtgatagagtgagattttatttaaaaaaaaaaaaattaaaaaaaaaaggggagattttataattatggttaaaggaggtaaggaggattaagttatgttttatatggatggtagtaggtagaaagagagtttgtgtagggaaatttttttttataaaattattagattttatgtgattttattatagggatagtatgggaaagatttgtttttatgatttagttaatttttattgagttttttttataatatgtgggaatttaagatgagatttgggtggggatatagttaaattatattaggattaaaaagaattttgaattaatgagatgttgtttaggaatgggaaagtggtaggttttgttatgtatgtatggaaagagggattttagtatttgagagggtttggttaggtggtttttgtggttattgtattgattgaggttttagggttaaaatgtatattttgtttatggtttggtttagggtggagttttgtagattttatttattgttaggggatgttgatattttatatttggattggaggtggggttgtttttgtgagagagtaaatttttttttttaggaagtttatatttttttggtgttgaatttggtatagttatttttgagttaagtagatgtttgttatttagaattgggatagttatttgaaatgtttttagaggttggggttatatagtgggagtagtttagtttttttttttttttgtttgtgagtgtttgtgtgtaagttttgtttgtttgggaggagtattgtgtgtggaggttggtttgggggaggtgtgtagatggaatttggtttggttgtttagggagtgtgagagtgggtttggttttagtgtattgtggttttgtagttaagtttgtagggaggggttttgttgttgtagttataaattttagataaataagttttaaagttgggaggtattttaaaaatttgtttgtttgtttgaattttaaggaaagatataatttttggttttgtattaggagatgttatttttttattttgtgtaagtatattgttttttataagttttttggaggttttttattaaatatatatatttggttttatttagtatattattttatattttagaatatgtatatttttggagtttggattttggaagtttttttaggtttttagtaatttggaattagatagtgattagtgattgttaaggaggaatttggggatggttggtagtgggttgggtgtgttagaattttagtttggaggtgtttggaggtttgaatatgtatatttaatatagtaatagtaattttttttttatagtataagttatagaaattaatatgtaatatatttttgggtatgtaaataaaagagagtaagagaatgttgtaggaagtattgggaagttttgttttaatttagttttatagattataaagatgaagggttttaagagggtaagataattgtttaaggttatagtaagtaggagagtttgggttttttgattgttatgttaattagggtttttttttttaagatgtgttgataatttgttatttagatatatttgagtatttagtatatattattttaatgttgtatatgttattttatttaaattatttttaaaattgtggtatagtttttatttttttttttttatagtggaggaaattggtttagagaggttatgttatttgtttatgattatgtagttagtaaatggtagagttgaatattaaattaatgtttttttaattttaggatttagtttttttttattatgtaatgaagtaatttttgttaggtgttttaaagatgtgttttgtttgtgattttttttttgatgttttatatgtgatttttgtagtaggtgttattttatggttatggtgatttttttttgttgttttttgtttggttgtattttttttatttgttttttaagtgaagttaggttttatttattttttttttagagttttttttgatgttttgtttgtatattttttatttttattttttatttttaattaattgataataaattattttagaatgatttgagttgtgttgataagtaggtggtttgttttttgaggttgtagattttttttgatttttatgtgtagttttgggtgtatagttggtattgtttagtgttagtgataatgtttttttttttttaggtatgtgagattttgtgaagtagttgattatgtttttttgttgttgaaaagaagttattttttagattttttttgtttggatatttttagtaattttattttttggagagagttattgttattttttgaaaattaggatatttattttgttttagtgtaaaatgttttaagtagttttttgttagtagtgtagagtttggttgttatttattaaaggataggtttttttggagtgtatagttttatttgggagtttggtgtgttattattggtttgatagtagagagaattgagaagtattttttttttgttttattttggggttgatatttttaagtaagataggaagggagtattttttaggttaggagttgggtgtatttgtattgtgaaaagtattttttagttgtggtttaatgttagttatgatgttgtttttttggtttgttttagtaagtagttattggtttatgtgtagtttggggttgtgaaatttaggtagaaggtggttgtttgagggttgtttttgtttaggatagggttaattgaggaatgttagatgtgtatggtttttggtaaagtagggggtatatttttattatagtaatgttagtgttattattttttgaatatagtggggagggttgtgaaggtttatgtgatttggatttgaggtttttgatagaaatttggatgttattgggtttaggtttggttttagatttggttttgtggatgggttttttatagtatttgttgattagttttatttttaggtgataaatttttttttaatttttttggttaaagatagtttattttattggtatatttttttttagtttttgtggtttaaggttggaatatttatgttttaatatatttatggtagatatttaagaatgtgttttatttagtttatggtaattttgtaatgttttagattaaaatgatagtaaatattattaaggtagtattttgaatgagtttgatattgttggtttttttttatttagtgaggtggtgttgatagtgtggatttgagtatatttatgttaaatgataatgatattgatttttgttgggagttttttaaagaaattggttggttttaagaaaatagttttaagaagtttaattatatttttttagatattatgtattgttttattttgattaggttattgtgataggtatttatttatattttttttatattattgttattaatatattaaaaagatgtatgtgttagattattgaaagggttttatttttttttttttatagattgatttttttttggaatttttgagttatttattttttttagttttttttatttaaattaagggtaagtgaaaaagtaataatttggtattttttaagtttatagaatgtgatttttttatttgtttattatattggtttgtggatagaataatttgaaaagtgaaagaattattttggtaaaagattttgttttattttttgaagtattatttttttaaagagtgttttattttaatgattgaaatatttttttatttaaattttattgttagaattataggaggtaaaaaatggaatggttgaatgaaattttattttttttgtgaaagaaaatttatagagttgttgtttttgttgtagttggtgggttttgttagtattggatgtttttgttaaatggtttatgtggatatataaaggtaaatagatttgttattgattgtagatttttgtagaaatatggatgtgtatgtgtagatttttttttgtaggtattaaaaataattaaaaatagttttgtttgaggttgtagtgagttgagtttgtattattgtattttagtttgggtgatagagtaagattttatgttaaaaaaaaaaaaaaaaaaaaaaaagttttgttttaattaatttttttgtgtttgtttattagtaatttaaagaggttatatttattttttatgtaatgagggtatttttgagtgaattttaattgttttgaattaagtataagtttatgggtttgtaaaggtttagatggttttttttttgtatttaggaggaattttggttgtgagaatggggggatgtattttttatgtagttggtatttaggtagttttttgtagtagtatattttgtaggtggagtttttagaggatgtaattttggattttgaattttgatgtattttaaatttttatattattgtattttgaaatagagtatgttttttagaaagttatatttttagatttgtgttaagtttaatgtgagttttggtaaggttggtatattaatatttgttttttggtttttgaaagtgagatttgtatatgggttgtatttatgtatatatgagttggtttatttttgtgtatatgattataatttagtgatgttgaggttatgtgttggaatgttgtatttggattatatattttaaagttgttttatggaaatgaattttatttagtgataagttattaaatgtttgttatatgtgatgaagataaatatgtatatttggtatagagaaaaatatatatttggtatattggagaaaaataattatatttttaaagagaattttttttgtaattttatgtttggattattattgtaagtatattttatttgtatttgatttgtatttgtatatgttgatgtaatgataaaaattattgtaatattttattgtgttgtattggatgtaaagttagaaaatattgtaataaatgagattgatgaaagatttttttgaaaattaggtgtgtgaattttaaatagtttttggtaagttattaagttgttgatttttttggggtgtgttattaagtatattttaaaaaaaatttttaggttatgaattgtttattatttggaataaatgttttttttgatgttttagatttaaatgggtaaaagattagttttttttatgtatttgttggggatgggag

SEQ ID NO: 62 - DNA, 5334 bp, Homo sapiens
tggagagttttagttgttgcgtttttggtcgttttttttttttttcgggtatttggcgtcggttttcgcgtttttttaggaatttacgttcgtttggaatttgtattttaagtttggagtttttaaggaattttttttgattttgaatttttattttagttttaagttttttagttttttttatatatatatatttagttttttaggcggagagtattttttttttggttattcgggtattttttagggggagtacggggtttaaaatatttttttggaaaaataaaggtggaagtaaattttaggaagtaaaattttttgaaataaaataaaatatcgaatgttttgagatttatatatttttaggtttttttaattaaagtaattattttttattatttttttaatttggaattattaatttgattagagaaattgatttttttttttttttttttttttttaaaagagtatttttgattattttagtttgtaattaatgatagagatattagggttagttaattatagttttataagattttttttttcgcgtgtgggttattgttatgttggtgggcgtttcgtttatttgaaaggttttttcgtttcgattggggtttgttgttgaagaaggagaattttcggaaaggttgagtttttagtttaaggttaaaacgtttaaggtcgaaagttttttagttttttttggacgttttgtttttgtttttgttacgattttttggggaaaacgaattttttattttttttttaaattgttattttcgttttaggagatgaatgtttttttttggttgttttggtaatgattttgaattaaagcgatgttaacgttttttttttttttaattgttaaaagttatggattgtaggaagatggttcgttttttttataggtatgagttaattttgaatgtgaattttttttgattgttagagattgttagtttaggaagtaatgttttatatttgttatttgattttttttttgtttaagttttaaaagagttgttaatcgtattgttgttttttttgaaagatttggaattttatatggttatttttaattttgttattggtttttaatattttcgtgttaatgttaatttttattttatgttaatgattttgtttatgaaatagtgtttttttatttttgtataaataaaggttagtattataattaaatttaaaatttttcgaaaagattaaaggtataagtagatttaatatttggtaaaattattaagataatagtaaaaaaaaaaaaaaaaatttatattttttatttaaaaattttttaagtgattggttaaaatagtttggtcgggtgcggtggtttacgtttgtaattttagtattttgggaggtagaggcgggtggattatttgaggttaggagattagtttggttaatatggtaaaatttcgtttttattaaaaatataaaaattagttaagtatggtggcgggtatttgtaattttagttattttggaggttgaggtaggagaattgtttgaattggggaggggaggtagtgagtcgagatcgtattattgtattttagtttgggtgaaaaatcgaaatttttttttaaaaataaataaataaatatagtagtttgtaaaatgatttatcggtaatatgggatgtagttattttttaatttttatatgaaaattgtatgtaggggaaaatatgtgaaatagaagataaaagatatatatttatttaaaattaggtatttatgtgaggatagggtttaagaaataataatatatattaaaaagatttggatattggtgatttttttttaatatttttttttgttatatgaattagttattaaaaaaagaaagatggtgttttataatttttttttagtgatttgtggttttgtttttgtgatgagaggatttgggtgttaatttgtaaggttttattttttttgtttggttaatttatgtttgattttttttttttagtgtgatttggattatggttatttttaaagtttttgaattgggattagttgtcggtgagagattttttgtttttttgattatttttaatttttatgtggtttaaaatatagattttatgaattgattttgtcgttaagggttgggttattaggaatttgttcgtttatttcggggatatttggtttttagagatgatagtatttggttttaggaggagtttgtaattcggtttcggtttttttagcgtgtgtcgtttatggggatatagtatagtaagaattgtttgatttcgatgtttttgttttggttttttatgtgttttttgagtatttttttaatatttttttatttaaaagggtatttggttttggaattgtgtaggtgttggattgtttttggttttggaagtgagataaggattgtgtattttatttttttagagtgtagttttttttttttgagtttattttatattggggaatttagaattattattggtttatgtatgaaaatgatttttttgtttaaaggtatagagatttattttgatataatatattggtgttgtattaattttcgtttataggaattgtttttgtatttttttatttttatatttttagttatttgtttttattttttaggtaaggagttaaatagaatttgttgtttgaatgggggaatttgtatgttggggtttttttgtgtttgttttttttttttttacggacggaattgtgagtacgatgtgcgtaaagagtaagtaatttagaggggcggggagtcgtggagaggagagagaaagggaagtggaaattttagatttaaggttatcgttttatttgtttatttttaggaattgtgggtttgtgttttatgatatttggttgtttaagaagtgttttttgtgtaaatgttggtacggttagtttcgttgttttttttaggtatttttattcggttgtggtaagcggaggttttttttttttttttgttttttgaagttacgtagttgttttggggggtgtttagttagtaggttttttttgtattttttgttttgttagagtttggtagttaaagttttgtttataaaagtatcgtagatttttgatgagatagttgttttggtttttttgatatttattttttcgggaatttggttagttttgttgttttttagatagagatgtattttaagtttatttgatattttatggtttgaatttttattgaggaaaataaataagtttcggttttttgttaaattaagagatgttttttggtgttttttttttttgggtagggggatttaaattaggatgggtagtttatttagagtttattttgacgataaattttattagaggtttggttttttgttagttttttagaaatttttagagttttaaaagtttttggtaattttttttttatattttattatgattggttatagaatttttattatgattggttatagaatttttttatttttttgatttttattgatttgaggaatataatgaaaagaagggtagtatttggagaggaaaagaggcgatagttttttttttattttagtttgagttaggtttttagggttttttaaatttagagatttattatagttttgggttttggagatgttagaaatggaaaatatttaagtttaggaagtaaatgaaagtaaatattttattgagaataggaaggaattttttaatttagatagggattgtgtttttgttatttgtattttgggtgttaggtttaggataggtgtttgataagtgtgggttgggtgattggatgtgtagggaatatgttttttttttggaatatggggtttaattagaatttaattaggttgtgtttatttttgtaagtgaaggtattattattgggttaggttttaggtgtgagtgttttgagaagagtaggtttatagtagcgtatagatatgttatatttgtgggtagtaggatgaattgttagagaggtttgttttaatgattaagtatttttattttttagatggttttgtgatggatgagtatttcgtggtttttaggattttagaattattatcgtttgtacgtattattatttttatgttagttggtatttgtttttttatataaagttattattaatcgatattgatttatttttagaaatataattttagatattatgtaaattttatgattagtaaaggttgttgttataatgttttaattgaaagatgattatttgtagttgttttaaaataatgaatatatttttaaaatggtttttaatatttttttatagaattattttttatttttttgttttgtttttttttaaaaaattatttttttttttaaaagaaagttagttatatttttattgtgtttaagtttagtgtttttttttttttttttttttgagacggagttttattttgttatttaggttggattgtaatgacgcgattttggtttattgtaattttcgtattcggggtttaagttatttttttgttttagttttttaagtaattgggattataggtatgtgttattatgtttagttaatttttttgtatttttagtagagatgggggttttattatattggttagtttggtttcgaatttttgattttgtgatttattcgttttagtttttcgaagtgttgagattatatacgtgagtaattgtgtaaggtttggtgttttttgatatatgtaattttattaaggtttttttaatatgtttttttaaatgattgaattatatgtttagattattggagattaattttaatgtggattttagaatatagttttgagtagagttgattaaaattaattaaaatagtttttttaaaaggaaagaaaatatttttaaggggaggaattagagtgttgaaggaatggaagtttatttgcgtgtgtgtagggagattgggtaggaaagaggaagtaaatagaagagagaggttgaaaaataaaatgggttatttgattggtgattaggtggtggtagagaagtaagtaaaaaggttaaatggaagggtaagtttttattatttatagaaagttatataagataagaattttttttttttttttaaaggtattataaaaagaatgaagtttttttagaaaaaaaattatattttaatgtttttaataagattgtttaataaattgtgttttttttaagttatttaatttttttaattgttgtagaagataaaatgtttataatatatttagttgtaaattaagtgattaaattatatattgtaaagtttatttttaaaatatattgtata

SEQ ID NO: 63 - DNA, 5334 bp, Homo sapiens
tggagagttttagttgttgtgtttttggttgtttttttttttttttgggtatttggtgttggtttttgtgtttttttaggaatttatgtttgtttggaatttgtattttaagtttggagtttttaaggaattttttttgattttgaatttttattttagttttaagttttttagttttttttatatatatatatttagttttttaggtggagagtattttttttttggttatttgggtattttttagggggagtatggggtttaaaatatttttttggaaaaataaaggtggaagtaaattttaggaagtaaaattttttgaaataaaataaaatattgaatgttttgagatttatatatttttaggtttttttaattaaagtaattattttttattatttttttaatttggaattattaatttgattagagaaattgatttttttttttttttttttttttttaaaagagtatttttgattattttagtttgtaattaatgatagagatattagggttagttaattatagttttataagatttttttttttgtgtgtgggttattgttatgttggtgggtgttttgtttatttgaaaggtttttttgttttgattggggtttgttgttgaagaaggagaatttttggaaaggttgagtttttagtttaaggttaaaatgtttaaggttgaaagttttttagttttttttggatgttttgtttttgtttttgttatgattttttggggaaaatgaattttttattttttttttaaattgttatttttgttttaggagatgaatgtttttttttggttgttttggtaatgattttgaattaaagtgatgttaatgttttttttttttttaattgttaaaagttatggattgtaggaagatggtttgttttttttataggtatgagttaattttgaatgtgaattttttttgattgttagagattgttagtttaggaagtaatgttttatatttgttatttgattttttttttgtttaagttttaaaagagttgttaattgtattgttgttttttttgaaagatttggaattttatatggttatttttaattttgttattggtttttaatatttttgtgttaatgttaatttttattttatgttaatgattttgtttatgaaatagtgtttttttatttttgtataaataaaggttagtattataattaaatttaaaattttttgaaaagattaaaggtataagtagatttaatatttggtaaaattattaagataatagtaaaaaaaaaaaaaaaaatttatattttttatttaaaaattttttaagtgattggttaaaatagtttggttgggtgtggtggtttatgtttgtaattttagtattttgggaggtagaggtgggtggattatttgaggttaggagattagtttggttaatatggtaaaattttgtttttattaaaaatataaaaattagttaagtatggtggtgggtatttgtaattttagttattttggaggttgaggtaggagaattgtttgaattggggaggggaggtagtgagttgagattgtattattgtattttagtttgggtgaaaaattgaaatttttttttaaaaataaataaataaatatagtagtttgtaaaatgatttattggtaatatgggatgtagttattttttaatttttatatgaaaattgtatgtaggggaaaatatgtgaaatagaagataaaagatatatatttatttaaaattaggtatttatgtgaggatagggtttaagaaataataatatatattaaaaagatttggatattggtgatttttttttaatatttttttttgttatatgaattagttattaaaaaaagaaagatggtgttttataatttttttttagtgatttgtggttttgtttttgtgatgagaggatttgggtgttaatttgtaaggttttattttttttgtttggttaatttatgtttgattttttttttttagtgtgatttggattatggttatttttaaagtttttgaattgggattagttgttggtgagagattttttgtttttttgattatttttaatttttatgtggtttaaaatatagattttatgaattgattttgttgttaagggttgggttattaggaatttgtttgtttattttggggatatttggtttttagagatgatagtatttggttttaggaggagtttgtaatttggttttggtttttttagtgtgtgttgtttatggggatatagtatagtaagaattgtttgattttgatgtttttgttttggttttttatgtgttttttgagtatttttttaatatttttttatttaaaagggtatttggttttggaattgtgtaggtgttggattgtttttggttttggaagtgagataaggattgtgtattttatttttttagagtgtagttttttttttttgagtttattttatattggggaatttagaattattattggtttatgtatgaaaatgatttttttgtttaaaggtatagagatttattttgatataatatattggtgttgtattaatttttgtttataggaattgtttttgtatttttttatttttatatttttagttatttgtttttattttttaggtaaggagttaaatagaatttgttgtttgaatgggggaatttgtatgttggggtttttttgtgtttgttttttttttttttatggatggaattgtgagtatgatgtgtgtaaagagtaagtaatttagaggggtggggagttgtggagaggagagagaaagggaagtggaaattttagatttaaggttattgttttatttgtttatttttaggaattgtgggtttgtgttttatgatatttggttgtttaagaagtgttttttgtgtaaatgttggtatggttagttttgttgttttttttaggtatttttatttggttgtggtaagtggaggttttttttttttttttgttttttgaagttatgtagttgttttggggggtgtttagttagtaggttttttttgtattttttgttttgttagagtttggtagttaaagttttgtttataaaagtattgtagatttttgatgagatagttgttttggtttttttgatatttatttttttgggaatttggttagttttgttgttttttagatagagatgtattttaagtttatttgatattttatggtttgaatttttattgaggaaaataaataagttttggttttttgttaaattaagagatgttttttggtgttttttttttttgggtagggggatttaaattaggatgggtagtttatttagagtttattttgatgataaattttattagaggtttggttttttgttagttttttagaaatttttagagttttaaaagtttttggtaattttttttttatattttattatgattggttatagaatttttattatgattggttatagaatttttttatttttttgatttttattgatttgaggaatataatgaaaagaagggtagtatttggagaggaaaagaggtgatagttttttttttattttagtttgagttaggtttttagggttttttaaatttagagatttattatagttttgggttttggagatgttagaaatggaaaatatttaagtttaggaagtaaatgaaagtaaatattttattgagaataggaaggaattttttaatttagatagggattgtgtttttgttatttgtattttgggtgttaggtttaggataggtgtttgataagtgtgggttgggtgattggatgtgtagggaatatgttttttttttggaatatggggtttaattagaatttaattaggttgtgtttatttttgtaagtgaaggtattattattgggttaggttttaggtgtgagtgttttgagaagagtaggtttatagtagtgtatagatatgttatatttgtgggtagtaggatgaattgttagagaggtttgttttaatgattaagtatttttattttttagatggttttgtgatggatgagtattttgtggtttttaggattttagaattattattgtttgtatgtattattatttttatgttagttggtatttgtttttttatataaagttattattaattgatattgatttatttttagaaatataattttagatattatgtaaattttatgattagtaaaggttgttgttataatgttttaattgaaagatgattatttgtagttgttttaaaataatgaatatatttttaaaatggtttttaatatttttttatagaattattttttatttttttgttttgtttttttttaaaaaattatttttttttttaaaagaaagttagttatatttttattgtgtttaagtttagtgtttttttttttttttttttttgagatggagttttattttgttatttaggttggattgtaatgatgtgattttggtttattgtaatttttgtatttggggtttaagttatttttttgttttagttttttaagtaattgggattataggtatgtgttattatgtttagttaatttttttgtatttttagtagagatgggggttttattatattggttagtttggttttgaatttttgattttgtgatttatttgttttagttttttgaagtgttgagattatatatgtgagtaattgtgtaaggtttggtgttttttgatatatgtaattttattaaggtttttttaatatgtttttttaaatgattgaattatatgtttagattattggagattaattttaatgtggattttagaatatagttttgagtagagttgattaaaattaattaaaatagtttttttaaaaggaaagaaaatatttttaaggggaggaattagagtgttgaaggaatggaagtttatttgtgtgtgtgtagggagattgggtaggaaagaggaagtaaatagaagagagaggttgaaaaataaaatgggttatttgattggtgattaggtggtggtagagaagtaagtaaaaaggttaaatggaagggtaagtttttattatttatagaaagttatataagataagaattttttttttttttttaaaggtattataaaaagaatgaagtttttttagaaaaaaaattatattttaatgtttttaataagattgtttaataaattgtgttttttttaagttatttaatttttttaattgttgtagaagataaaatgtttataatatatttagttgtaaattaagtgattaaattatatattgtaaagtttatttttaaaatatattgtata

SEQ ID NO: 64 - DNA, 8757 bp, Homo sapiens
tgtatgtgtgtgtgtgtgtgtgtgtgtgcgcgtgtgatgtttatttatttatttatttatttatttatttattttataaatatttatttagatttttttggtattgtattaggtgttaggggtagaatagtaatttggaaagatgaggtaaatggttgattttagatttaaggttttggattttagttgttttgttatttagtttaggtaggtttttataatcgttttaattagggagaatataggagagtttttttggggtgtcggtagtttagaggagatttaaatattaggagattttttttttttatgttttttagttttttagtttattttttttaggagggagggagataagatttaggagttagggttgtagtggttgggcggtttaggtaagtttgtttgttataggtatttgtgttaggataggattttttttagttttatatttattgaattgtttttttttgggtttttgggggtggtgttggagtgggttttagggttggaacgggtttttgggtggcggtagttttttgttgtttttatttgagttttgttcggaggtggtaggtgacgggttaggtttagttttttttgggtttagttatttaggtacgaggttttttttttttatttttcggggttgggattttttttataaaaggttatttttgagagttttttttattaagaagtagttttttcgttttttttaggattttcgtttggttcggttcgtttgtttttatttttgtttttattatgtttattagggtgatttagaagttttataaggtgtttatttttggttttcgggtttttagtagtcgtttttatacgagtgggttcggttttcgtattagtttttcgagtttttttcgagtgggtagtagtaattttcgcggtggtttgggcggcggttatggtggggttagcggtatgggaggtattatcgtagttacggttaattagagtttgttgagtttttttgttttggaggtggattttaatatttaggtcgtgcgtatttaggagaaggagtagattaagatttttaataataagtttgttttttttatagataaggtgagggttttttttgcgtggttgattgtgttcgtagttttttttttttggtagtttcggtttttatgtatatttttagtttttagttggcgttttgttgggttttattcgttttggcgatatttttttttttatttttcgatttatttttttcgtgtattttggtttgggttgggtgagggtggggagagggtttggatagtcgggatgaattttggggtttttttttttttttttaaattggagggttttggaagagagagataatttaagggtatagtttagtttttattatttttttttataaatttcgtttttttttaggttattttgtttttaaattataaaaaataatagcggttattgtttttattttaattcgagttttgatcgttttttaagttatcgttttgcggtagttttagttgttcggggattatttttttttaggttcgttttttcgttagtattattttaagggttttttagtggtgtttttgtgattttttttttttttttttttttttttatataggggtttggtgtgattttagtattttaggagaaggaagtgggtgtttcggtttaaacgggtaaatattgattgaggtttttggcgttcggaggtttgagtgcgggggttatagaatgagttatatttcggtttttgcgtcggtagcgtgggcggggtcgagggcggggtgaggggttgcgggtagtagtttcgggacgtttttttttatttggcggagttcggcgtcgggggcggtgtgggtggggtggggtggggtggggtgggttggggtggggtggaggaggcgttagggtttggtttcggaaagtttatgtaggatttaaagtttgcgggcgtgggacgtttcgttcggggtttacgttttgttaagtttatggttttagataacgcggtcgtttattaacgtttttcgtttatttagttcgtgtttttttttcgcgttttgtttttgtttcgttttagcggtttggttttatttttatatagtaggagttaggtcgggttttgtagttttgggatttcgttgtttgaggggtttcgggttttcggcggtttcgaggattgggttttttacgttgattggtttttgggaggtattgtgggaacgggaggagggaaattttggggtagagtaagtcgggaggaatcggagttttaggaatttagtggtcgggggtttttggcgttttaagcgtttggatttgatttgttgattgcgttttgttagttttggggtttttatagagagtagttaagtataggttttggaatttgaatttttggttcgtattgttttgtcggtttttggttatggatttttttgttaagttttatttttttatttataaaatgaatatgagagtttttaaatttatataggtaaaagtttttgtttatttaaatttatatatgtaaagagtttagtagtgtttggtttatattttattaggataagatgttataattatttttttttaaaaaataattttggggtagaatgatttggggaagaaagcgatttgtagagagtggtggagggaattaggttgtatttttaaaagatttttgttttttttagtttagaaggagttataagtttttttgtttgtttgagatagagttttattttgtcgtttaggttggagtgtagtggtgtgattttagtttattgtaattttcgttttttgggtttaagcgatttttttgttttagtttttcgagtagttgggattataagtgcgtgttattatgttcggttaatttttgtattatttgtagggatagggttttaatatgttggttaggttggtttcgaatttttgattttaagaaattcgtttgttttggttatttaaagtgttgggattataagcgtgagtttttacgttcggttttttttttaattttaatatttttagaaaggttggttatttttggtcgggcgcggtggtttacgtttataattttagtattttgggaggttaaggcgggttaattataaggttaggagttcgagattattttgtttaagacggtgaaattttgtttttattaaaaatataaaaaaattagtggggcgtggtggtaggtaggtgtttgtagttttagttattcgggaggttgaggtaggggtaggagaatggtatgaatttgggaggcggagtttgtagtgagttgagattttgttattgtattttagtttgggcgtcggagatttttaaagaaagtttggttatttttattgatgtgtaatatataatttatgtaaatgaagttaggtttattggtttgtaaatgtagttttaatataattattttatttgttttttttttttatttaatgttgagggatattgttttttattttattattatgttatgttttttttttttggttataggtgatttttttagaatagttaattaggtgtttggggtttggagattttattgtttgaggagtgaattaagagaaaagattgtttgtttttttttagattttgagttttggtttgatgtagatttttttgtttttttttttttcgtataggtacggtttttggagtagtagaataagatgttggagattaagtggagttttttgtagtagtagaagacggttcgaagtaatatggataatatgttcgagagttatattaataattttaggcggtagttggagattttgggttaggagaagttgaagttggaggcggagtttggtaatatgtaggggttggtggaggattttaagaataagtgagtaatttttattttttatttaattgaagttatcgtgtttttttttattttttgggattttgggattaagtttttatggttttttgttgtgggaagtgtagttttatttaattagggtgattatttgatgaggtttgttcggaatagtttgtgtttatgtttaggtttttagtataattgttgatagtatttatttttttttaattttaattgtttggatttgaagaataaattatgtgttaatgttgatatggtaaatttgagacgggagagataggtagtttgtgggttttatttttgtatttaatattttggtttttttttagttttgatttttgatttttagtaaattttagaaagttttgtttgaggttttatgttaggttttgttgttaatatttttaaggtgtttaattcgatgtgtatttatggatttggagagagattttttgttttttacgggttaagggaggggtgagggtggagagggtagttggggaaggtagaaggattagtttttttatattttgtatttttgtgaattgaatttttttgatttttataacgtttttgttttttaaaagattaagggtaattttttttttgtttttattttttaattgtaagttttttttttataggtatgaggatgagattaataagcgtatagagatggagaacgaatttgtttttattaagaaggtgagggagtttttttttttttatttggatattggaggttggggtttagagatttagattaagaagttttttgggttttgtttttaaatatttttaagtagtgggataaatttatttatgtaaatatttgggtgtatagaaaggtagataaggatggagtggtaggtgtatttggatagaatttttgatatcggtgttgggatatggtttagaaaatagagtagtagaattggagatttggttttagaaggttttttagagaaggaggtggaagagggtgtgttgtaggaagtagaggtgaaggtgtgtgggttgagaatgtatatgtgatgggtagaggttgggttggaagattaatttataaagtgggtaattagaaagttttgtgattaggttattgggtggattttgggagttttttggttggggttgggtgtggaaatttagtttaggtttttttttttttattttttaggatgtggatgaagtttatatgaataaggtagagttggagtttcgtttggaagggttgatcgacgagattaatttttttaggtagttatatgaagaggtatgtttttggtcgtaggagagtgagggttttttagttttgttagcgtttttattttgagatttaattagaggttttttttagtttttagtatattaataagataaaggtttattgttgattaattatagttattaatatttgttcggttagtatttattgggtttatatgttttgtttttcgtatgagggatgagttattattttattttatagacgagaaagtgggtttagagaagtgaaataacgtatttaaggttattatagggtgtggtgatttagtagtaattttgtttttaaagtttttgtttttaatttttgagttgtattggatttttttgtgtatttagtattggtgtatttagttttttttttaggaattttgttttttttttgattttgatttttatttgttttttttttttgttgtttttgttttatattttaagaaaggttgttgtggaaaagggggttttttgtgtgtagagatagggttttattatttgttttttttttttataggagattcgggagttgtagttttagatttcggatatatttgtggtgttgtttatggataatagtcgttttttggatatggatagtattattgttgaggttaaggtatagtacgaggatattgttaatcgtagtcgggttgaggttgagagtatgtattagattaagtatgaggagttgtagagtttggttgggaagtacggggatgatttgcggcgtataaagattgagatttttgagatgaatcggaatattagtcggttttaggttgagattgagggttttaaaggttaggtatgggtcgggttgggggtgggaggggttttttggatatattttggtgagaggagataatgtaggaagagtgaagtttttgggagtcggggaaggaattttagattagggtttaggagttggaggggtagttatagtttagttttttagtttgtttttgagaagtaaagggatgtagggaaggttttttgggttaggatagaggtgaaaggggattggggtaggtatgttggggttcgtgatatatgtttttaagtttgttttaattagttatatgtattagggtaaggttgagttttgttgttttaaggaaagtttagaatttagggatttagtttagttagggtagggggattttatagtgtcgtaggtgagaagggtgtggaggggaagtatttggaaattgtttatgtttttttgatttgtttttttagtttcgtttatttatttatttatttttgagatagagttttgttttgtcgtttaggttggagtgtagtggcgtgatttcggtttattgtaagtttcgttttttgggtttatattatttttttgatttagttttttgagtagttgggattataggcgttcgttattaggttggttaattttttttgtatttttattagagacggggttttattgtgttagttaggatggtttcgattttttgattttgtgatttgttcgtttcggttttttaaagtgttgggattataggtatgagttattgtgttcggtttttagttttatttaatttgagttggggggagttagtttaggtggtggtggggaggattttgagggagggtgggagtacgggagaagagaaggtatatttaatttgatttatttatttgttttttattttatagagggtttttttggaggtcgttattgtagatgtcgagtagcgtggagagttggttattaaggatgttaacgttaagttgttcgagttggaggtcgttttgtagcgggttaagtaggatatggcgcggtagttgcgtgagtattaggagttgatgaacgttaagttggttttggatatcgagatcgttatttataggaagttgttggagggcgaggagagtcggtgggtgtgggtatttttgatcggatttgtttttttatttttgggatttggggtggggacggtgggagttttttgaagttttttgggatttggggttttgttgttttgggttaagaagggttaggagttggttttgatattttatttgtttgggtataggttggagtttgggatgtagaatatgagtatttatacgaagattattagcggttatgtaggtgggtgttttagggttttgggatgagggcgggaggtagggtttagggaggttttagttttagggagggggttgtgtttagtcgtttatagtgattttagtttgagtatttatgtttttgggagaattttagggtggggaggtatatatttaggattttagtaataattttattatttagtaattttattattagaaagtatttaaataaattatagttgtgtgttaggtattgtgttaagtattttataggttttatgtgatttattttatttattaatttaatttaatttttttgagacgaagtttcgttttgttatttaagttggagtgtagtggcgtgattttagtttattgtaatttttattttttgggtttaagagatttttttgttttaggttttttaagtagttgggattataggcgtatattattatgtttagttaatttttgtatttttagtagagacggggttttattgtgttgggtaggttggtttcgaatttttgattttgtgattagtgttgggattataggtatgagatattgggtttggttgtaatttattttttatatgatatttgtaaacgtttttagttgaggaagttgaggtgtagttaaatgtttaaggttatatagttatatatatggtagttgttttttattttgtttttggttttttttgatagttttggagtagtgaattatgtaattattgattaggtagagttgggttaattttttatttttggggttatgttgggaatgagtagggagaaggggtatggagtttgttatggggtgggtttttgtatttatgtggttatttttgttttttattaggtggtttgagttcggtttatgggggttttataagtttcggttttagttatagtttgggttttagttttggttttggcgcgggttttagtttttttagtcgtattagtttttttagggtcgtggttgtgaagaagatcgagatacgtgatgggaagttggtgtttgagttttttgacgttttgtttaagtgaatagttgcggtagttttttttagtttattttttttgcgttgttttagagtttgggaaggaggtcgttatgtagggtagtattgggaataggagatttatttgaggtttagttttagtttttagtttatttggggagtttattatttggggattttttttgtttatgtttttagttataaaataatttaattgttttttttttttggtttaaaataaaattttagttagttttgttaatgtttttgtttgtgtgtgtatttgatgtttattggggtgggagggaggtggttaggaggtttttttttgggattgagaagttgggaggggtttaggaagtagggggtgtatagcgggaaagtttgatttttttagttgtttttaaagaggtttttttattgaaatttggttgaaattttgtttgttgttatagatatt

SEQ ID NO: 65 - DNA, 8757 bp, Homo sapiens
tgtatgtgtgtgtgtgtgtgtgtgtgtgtgtgtgtgatgtttatttatttatttatttatttatttatttattttataaatatttatttagatttttttggtattgtattaggtgttaggggtagaatagtaatttggaaagatgaggtaaatggttgattttagatttaaggttttggattttagttgttttgttatttagtttaggtaggtttttataattgttttaattagggagaatataggagagtttttttggggtgttggtagtttagaggagatttaaatattaggagattttttttttttatgttttttagttttttagtttattttttttaggagggagggagataagatttaggagttagggttgtagtggttgggtggtttaggtaagtttgtttgttataggtatttgtgttaggataggattttttttagttttatatttattgaattgtttttttttgggtttttgggggtggtgttggagtgggttttagggttggaatgggtttttgggtggtggtagttttttgttgtttttatttgagttttgtttggaggtggtaggtgatgggttaggtttagttttttttgggtttagttatttaggtatgaggttttttttttttattttttggggttgggattttttttataaaaggttatttttgagagttttttttattaagaagtagtttttttgttttttttaggatttttgtttggtttggtttgtttgtttttatttttgtttttattatgtttattagggtgatttagaagttttataaggtgtttatttttggtttttgggtttttagtagttgtttttatatgagtgggtttggtttttgtattagttttttgagttttttttgagtgggtagtagtaatttttgtggtggtttgggtggtggttatggtggggttagtggtatgggaggtattattgtagttatggttaattagagtttgttgagtttttttgttttggaggtggattttaatatttaggttgtgtgtatttaggagaaggagtagattaagatttttaataataagtttgttttttttatagataaggtgagggttttttttgtgtggttgattgtgtttgtagttttttttttttggtagttttggtttttatgtatatttttagtttttagttggtgttttgttgggttttatttgttttggtgatatttttttttttattttttgatttattttttttgtgtattttggtttgggttgggtgagggtggggagagggtttggatagttgggatgaattttggggtttttttttttttttttaaattggagggttttggaagagagagataatttaagggtatagtttagtttttattatttttttttataaattttgtttttttttaggttattttgtttttaaattataaaaaataatagtggttattgtttttattttaatttgagttttgattgttttttaagttattgttttgtggtagttttagttgtttggggattatttttttttaggtttgtttttttgttagtattattttaagggttttttagtggtgtttttgtgattttttttttttttttttttttttttatataggggtttggtgtgattttagtattttaggagaaggaagtgggtgttttggtttaaatgggtaaatattgattgaggtttttggtgtttggaggtttgagtgtgggggttatagaatgagttatattttggtttttgtgttggtagtgtgggtggggttgagggtggggtgaggggttgtgggtagtagttttgggatgtttttttttatttggtggagtttggtgttgggggtggtgtgggtggggtggggtggggtggggtgggttggggtggggtggaggaggtgttagggtttggttttggaaagtttatgtaggatttaaagtttgtgggtgtgggatgttttgtttggggtttatgttttgttaagtttatggttttagataatgtggttgtttattaatgttttttgtttatttagtttgtgttttttttttgtgttttgtttttgttttgttttagtggtttggttttatttttatatagtaggagttaggttgggttttgtagttttgggattttgttgtttgaggggttttgggtttttggtggttttgaggattgggttttttatgttgattggtttttgggaggtattgtgggaatgggaggagggaaattttggggtagagtaagttgggaggaattggagttttaggaatttagtggttgggggtttttggtgttttaagtgtttggatttgatttgttgattgtgttttgttagttttggggtttttatagagagtagttaagtataggttttggaatttgaatttttggtttgtattgttttgttggtttttggttatggatttttttgttaagttttatttttttatttataaaatgaatatgagagtttttaaatttatataggtaaaagtttttgtttatttaaatttatatatgtaaagagtttagtagtgtttggtttatattttattaggataagatgttataattatttttttttaaaaaataattttggggtagaatgatttggggaagaaagtgatttgtagagagtggtggagggaattaggttgtatttttaaaagatttttgttttttttagtttagaaggagttataagtttttttgtttgtttgagatagagttttattttgttgtttaggttggagtgtagtggtgtgattttagtttattgtaatttttgttttttgggtttaagtgatttttttgttttagttttttgagtagttgggattataagtgtgtgttattatgtttggttaatttttgtattatttgtagggatagggttttaatatgttggttaggttggttttgaatttttgattttaagaaatttgtttgttttggttatttaaagtgttgggattataagtgtgagtttttatgtttggttttttttttaattttaatatttttagaaaggttggttatttttggttgggtgtggtggtttatgtttataattttagtattttgggaggttaaggtgggttaattataaggttaggagtttgagattattttgtttaagatggtgaaattttgtttttattaaaaatataaaaaaattagtggggtgtggtggtaggtaggtgtttgtagttttagttatttgggaggttgaggtaggggtaggagaatggtatgaatttgggaggtggagtttgtagtgagttgagattttgttattgtattttagtttgggtgttggagatttttaaagaaagtttggttatttttattgatgtgtaatatataatttatgtaaatgaagttaggtttattggtttgtaaatgtagttttaatataattattttatttgttttttttttttatttaatgttgagggatattgttttttattttattattatgttatgttttttttttttggttataggtgatttttttagaatagttaattaggtgtttggggtttggagattttattgtttgaggagtgaattaagagaaaagattgtttgtttttttttagattttgagttttggtttgatgtagatttttttgttttttttttttttgtataggtatggtttttggagtagtagaataagatgttggagattaagtggagttttttgtagtagtagaagatggtttgaagtaatatggataatatgtttgagagttatattaataattttaggtggtagttggagattttgggttaggagaagttgaagttggaggtggagtttggtaatatgtaggggttggtggaggattttaagaataagtgagtaatttttattttttatttaattgaagttattgtgtttttttttattttttgggattttgggattaagtttttatggttttttgttgtgggaagtgtagttttatttaattagggtgattatttgatgaggtttgtttggaatagtttgtgtttatgtttaggtttttagtataattgttgatagtatttatttttttttaattttaattgtttggatttgaagaataaattatgtgttaatgttgatatggtaaatttgagatgggagagataggtagtttgtgggttttatttttgtatttaatattttggtttttttttagttttgatttttgatttttagtaaattttagaaagttttgtttgaggttttatgttaggttttgttgttaatatttttaaggtgtttaatttgatgtgtatttatggatttggagagagattttttgttttttatgggttaagggaggggtgagggtggagagggtagttggggaaggtagaaggattagtttttttatattttgtatttttgtgaattgaatttttttgatttttataatgtttttgttttttaaaagattaagggtaattttttttttgtttttattttttaattgtaagttttttttttataggtatgaggatgagattaataagtgtatagagatggagaatgaatttgtttttattaagaaggtgagggagtttttttttttttatttggatattggaggttggggtttagagatttagattaagaagttttttgggttttgtttttaaatatttttaagtagtgggataaatttatttatgtaaatatttgggtgtatagaaaggtagataaggatggagtggtaggtgtatttggatagaatttttgatattggtgttgggatatggtttagaaaatagagtagtagaattggagatttggttttagaaggttttttagagaaggaggtggaagagggtgtgttgtaggaagtagaggtgaaggtgtgtgggttgagaatgtatatgtgatgggtagaggttgggttggaagattaatttataaagtgggtaattagaaagttttgtgattaggttattgggtggattttgggagttttttggttggggttgggtgtggaaatttagtttaggtttttttttttttattttttaggatgtggatgaagtttatatgaataaggtagagttggagttttgtttggaagggttgattgatgagattaatttttttaggtagttatatgaagaggtatgtttttggttgtaggagagtgagggttttttagttttgttagtgtttttattttgagatttaattagaggttttttttagtttttagtatattaataagataaaggtttattgttgattaattatagttattaatatttgtttggttagtatttattgggtttatatgttttgttttttgtatgagggatgagttattattttattttatagatgagaaagtgggtttagagaagtgaaataatgtatttaaggttattatagggtgtggtgatttagtagtaattttgtttttaaagtttttgtttttaatttttgagttgtattggatttttttgtgtatttagtattggtgtatttagttttttttttaggaattttgttttttttttgattttgatttttatttgttttttttttttgttgtttttgttttatattttaagaaaggttgttgtggaaaagggggttttttgtgtgtagagatagggttttattatttgttttttttttttataggagatttgggagttgtagttttagattttggatatatttgtggtgttgtttatggataatagttgttttttggatatggatagtattattgttgaggttaaggtatagtatgaggatattgttaattgtagttgggttgaggttgagagtatgtattagattaagtatgaggagttgtagagtttggttgggaagtatggggatgatttgtggtgtataaagattgagatttttgagatgaattggaatattagttggttttaggttgagattgagggttttaaaggttaggtatgggttgggttgggggtgggaggggttttttggatatattttggtgagaggagataatgtaggaagagtgaagtttttgggagttggggaaggaattttagattagggtttaggagttggaggggtagttatagtttagttttttagtttgtttttgagaagtaaagggatgtagggaaggttttttgggttaggatagaggtgaaaggggattggggtaggtatgttggggtttgtgatatatgtttttaagtttgttttaattagttatatgtattagggtaaggttgagttttgttgttttaaggaaagtttagaatttagggatttagtttagttagggtagggggattttatagtgttgtaggtgagaagggtgtggaggggaagtatttggaaattgtttatgtttttttgatttgtttttttagttttgtttatttatttatttatttttgagatagagttttgttttgttgtttaggttggagtgtagtggtgtgattttggtttattgtaagttttgttttttgggtttatattatttttttgatttagttttttgagtagttgggattataggtgtttgttattaggttggttaattttttttgtatttttattagagatggggttttattgtgttagttaggatggttttgattttttgattttgtgatttgtttgttttggttttttaaagtgttgggattataggtatgagttattgtgtttggtttttagttttatttaatttgagttggggggagttagtttaggtggtggtggggaggattttgagggagggtgggagtatgggagaagagaaggtatatttaatttgatttatttatttgttttttattttatagagggtttttttggaggttgttattgtagatgttgagtagtgtggagagttggttattaaggatgttaatgttaagttgtttgagttggaggttgttttgtagtgggttaagtaggatatggtgtggtagttgtgtgagtattaggagttgatgaatgttaagttggttttggatattgagattgttatttataggaagttgttggagggtgaggagagttggtgggtgtgggtatttttgattggatttgtttttttatttttgggatttggggtggggatggtgggagttttttgaagttttttgggatttggggttttgttgttttgggttaagaagggttaggagttggttttgatattttatttgtttgggtataggttggagtttgggatgtagaatatgagtatttatatgaagattattagtggttatgtaggtgggtgttttagggttttgggatgagggtgggaggtagggtttagggaggttttagttttagggagggggttgtgtttagttgtttatagtgattttagtttgagtatttatgtttttgggagaattttagggtggggaggtatatatttaggattttagtaataattttattatttagtaattttattattagaaagtatttaaataaattatagttgtgtgttaggtattgtgttaagtattttataggttttatgtgatttattttatttattaatttaatttaatttttttgagatgaagttttgttttgttatttaagttggagtgtagtggtgtgattttagtttattgtaatttttattttttgggtttaagagatttttttgttttaggttttttaagtagttgggattataggtgtatattattatgtttagttaatttttgtatttttagtagagatggggttttattgtgttgggtaggttggttttgaatttttgattttgtgattagtgttgggattataggtatgagatattgggtttggttgtaatttattttttatatgatatttgtaaatgtttttagttgaggaagttgaggtgtagttaaatgtttaaggttatatagttatatatatggtagttgttttttattttgtttttggttttttttgatagttttggagtagtgaattatgtaattattgattaggtagagttgggttaattttttatttttggggttatgttgggaatgagtagggagaaggggtatggagtttgttatggggtgggtttttgtatttatgtggttatttttgttttttattaggtggtttgagtttggtttatgggggttttataagttttggttttagttatagtttgggttttagttttggttttggtgtgggttttagtttttttagttgtattagtttttttagggttgtggttgtgaagaagattgagatatgtgatgggaagttggtgtttgagttttttgatgttttgtttaagtgaatagttgtggtagttttttttagtttattttttttgtgttgttttagagtttgggaaggaggttgttatgtagggtagtattgggaataggagatttatttgaggtttagttttagtttttagtttatttggggagtttattatttggggattttttttgtttatgtttttagttataaaataatttaattgttttttttttttggtttaaaataaaattttagttagttttgttaatgtttttgtttgtgtgtgtatttgatgtttattggggtgggagggaggtggttaggaggtttttttttgggattgagaagttgggaggggtttaggaagtagggggtgtatagtgggaaagtttgatttttttagttgtttttaaagaggtttttttattgaaatttggttgaaattttgtttgttgttatagatatt

SEQ ID NO: 66 - DNA, 32123 bp, Homo sapiens
  misc_feature (12425)..(12425): n is a, c, g, or t
  misc_feature (12661)..(12661): n is a, c, g, or t
gtaggtttggagggtggtagtatgtaggtggtatgtatagttggggatgtgtgttgagtttgttatgttcggtgagttttttagtggagatgtttaatgggtagacggatatttatatagagagtttatggtagattcgggttagaggaaagtatttgaggtttggttagagacgtttagaggaatagagtttggttaatagttatttttggtgttttagatattttttgtttagtttacgtttttttttttatattgggttatttataaagtttttatagatatttttggggtatttattggatatatgtttttagggttttagagtaaggagttgtttgtgggtttattattgttgtttttatatgtttttaattgttttttatttttttttttatagtttggttagatatggcgttattattaatggaattttttttgttattttttttttgtcgtttaatagtggtagtgatagtttgatttttgatttaagtttgattttgtttaatttttttttttgattttggtatttttattttgatatgttttttgagagtttggggggtggggaatttagttttagttggtgacgtttggggtcggtttaggtttagggtgtggaggagttttgttatcgggttttttgtttttttttatttaagtacgattttgtagaaggaataaagtattttttttattgggtttttggttgtagagttttaagtttttatatagatacgtttgtttgagaagtagcgggtaagaaagacgtaagtttagaggtaaggtggttagattcggttttttttttcggagttgagagggaggggaacgtggggtagatgtataggaatgtgttttgtttagttgtttgtttatagttttggttatttttttttgtattttttttggaattggttatgagtagcgattttttattggaattgtgagtttttagaggttagagattgtgttagatttttttttgtagttttagcgtgtatagtttagtgtttagagtaatgggtgttttttagaggagtagtgatttaaatagtaagattagagagggagtgaagattggagattattttaggttgggaaaggcgtggaaggtaattagtcgtgggtagttgaggggagaagattggaagaggggaaaagaggagaaaaagagtgaagaaggggagggaaaaaattagaaagaataaataaatataaggtgggaggaaatttataaaaaagaaatgatgaggaaaaatataaaaataagaaaaagagtaaaagaagtggaatttagtttagagaaaatttttgtaaaattaattttttttaacgggataatttttaaaaattgatattaaatattatatttgtagtattttataagtcgtatgatttatgtaatagttttttttaattattttttgtgtttttgtgtgtatttttaaatttttgtttgtttttttgtttttttaagatttttgaataatgtttaaaggtatttttattttagttagttttaaaatgatttatgaaataggaaagttaaaatttttagaaagtgttgaaattgagtttttgcgtatgaattgttttaaaagttgtagatatatatttttagataaatatgttatttaagaaacggattcgaaaagaattggtggtaggggttttatgaggtcgggagagttatagaaggatgtgtagttttttttgggtttggtagggtgtgagggagagtgaggatttattgttttttttgaagggaagttttgtgttattttagttttttcgtttttagatttttttagtttttgagattttatggttttgaagtcgtgttatttttagtgttttttgttttttttttataggttttttttgggagagaggttttttggggtacgttttgattttttaaaacggaaaggttttgtttttaataatttaaagattttattttgagtgggatagtgttttttgaatgttttgtttttgtggtggatatttttatcggggtaaggttaagagtagggtttgatgggggaagttattgttattttatattttgattaataattttttgtgttgtattagatgttgtaggttgatataaaatggtcgtcgtttttaaagttagatgaaagagtttttgaggatagcgttagagatattcgggagatgattttttttttttaatgtgggagtatttatataggagaggtttatatttagataaaaattttttttattattggtgttagatagagtttgggggtagttttaggttttgattttggtcgtaatggcggggtggtgttgagggtaattggttagattaattgttttgtacgttttattttttattattatttttgagacggagtttcgtttttttgtttaggttggagtgtaatgacgtgatttttatttattgtagtttttattttttgggtttaagcgatttttttgttttagttttttgagtagttgggattataggagtttaatattacgttcggttattttttgtatttttagtagagattaggttttattatgttggataggttggttttaaatttttggttttaaatgattcgttcgttttggttttttaaagtgttggtattatagacgtgagttattatattgggttagttttgtatattttagatatttaataaatgtttgttgaatgaaatatttgtgatgggtcgggcgtggtggtttatattagtaattttagttttttgagaggtcgaggtaggaggatggtttgaatttgggagtttgagattagtttgggtaatatggtgaaatttttatttttataaattttataaaagttagttgggtatggtagtgtgtgtttgtggttttagttatttgggaagttgaggtgggaggattgtttgagtttgggagacggaggttgtagtgaggtttgattgtgttattgtattttagtttgggcgagagtgaggttttgttttaaaataattttgatgaaggtggggaattagaagtaggtgggtaggggtttgggtttgtaaggttttgagtttgagttttgttttgtatttttgaggggatgagggaaggagggtgggtacggttttttcgatgtgggtgtttgaggcgaagaagaggatggcggaggttgtagttattaattataagagttttttagaggggttatagtttttaggaagtttataggaagttagttagtagtagagagggtgaacgcggtggggtatatttcgcggttgggtttgagtgggttgtttgggggttatggggagaagataaaagtgtttgtgggattatagattttcgttgtggtggagttgggtttttttatttttttaagtttcgttttttattttatttttgggggttaggggtgagggcggtaggaattttaaggttttgagaaagtgcgtggtgtgtgttgttattttggtttttttttttttttagtttttttttgttttattttggatttatgttttgtgtatttgttttgttttttagaattttttttttttttttttttttgtattattttgcgttttgtgtgtgattgtggattgtgtgtgtatagttgttgttttaataagttgttttaggttttttttttttatattttttttttttttttttttttgaggttttgtgtattttggggaattttgtttatttttttttgtttatgtgttttttttattttgtagtcggtttttttatatttattttgggttgtaggcgtgttcggtaggttttttatagattaaagtttgtttagggtttgtattgttgttaaaggttaggaggattgtgtatagatcggaaggagttagagtttagtggtagtttgagaggggaagttgaaaaaggagaagaggtaaggggtattttaggggagttcgggagagttagtacggtcgtttggtatatgaggtaaagaggaagatagatatagatatagggagttgtaggttgggggtataagttgggggttgggaagtatagatatagaaatgtatagatgtgagttgagaagtaaggagggagagagagagatagaaagagagagagagacgtgttagggtttgagggattagagagtttttttagtttttttcggagtgttggtatataggatgttatcgtattagggtaagatatttttgggggcgttgagtatgggaattaaaggttagatttttggggtggtagcggaagtttaaagtattaaagtaagtatgttggaaatttatagttttttttatttagtagagttttggggtgagatgaggtagaatagggagttggaggtagggaggtggttgtttgtatatattttaggattatggagttgggggagttaaaatagttattatatggggaagggttaagaatgtttttagttttttttaggtattttattagggtaagttgaatttggattttagagaagggatatcgtttatggagatttttttttttttattttttgtttattaaggatttagttagtttgggatgggggatagtgggaattattttttggtatgaggttatttttattttattttttttattgtagtttttttttagatgttttttatttgtatgttaatttgtaaatattttattattattggtggttagtttttttttttttttttttagaaattttttttttgattttttttttttttattttttcggtttaaataaaattgtatttatttattatttatttatttatttatttatttatttatttatttatttatttatttatttattttttttttttttgagataaaattttattttgtcgtttaggttgtagtgtagtggtattataagtaattttaagtagttgagattataggcgttcgttattatttttagttaatttttttgtatttttagtagatacgggggttttatgatgttggttaggttggttttaaatttttggttttaagtgatttgtttgtttcggttttttaaggtgttggattataggtatgagttattatatacgatattcggtttttatttatttatatttatttatttatttatttatttatttatttattatttatttatttaatttatttatatttgtttatttatttttatgtatttattttatttattgatttatttatttttttttttttttgagatagagttattttgttatttaggttggagtgtagtggtacgatttcggtttattgtaattttcgtttttcgggtttaagcgatttttttattttagtttttttagtagttgggattatttattattatttttggttaatttttgtatttttagtagagatagggttttattatgttggttaggttggtttttaatttttgatttaaagtgatttatttattttggttttttaaagtgttgggattataggcgtgagttatcgtgtttggatatatatttattttttttttttttgagatggagtttcgttttgttgtttaggttggagtgtagtggcgtgatttcggtttattgtaattttcgtttttcgggtttaagtgatttttttgttttagttttttaagtagttgagattatagacgtgcgttattatgtttagttaatttttgtatttttagtagagatgggattttattatgttggttaggttggtttcgtattttcgattttaggtgatttatttgttttggttttttaaagtgttggaattataggtgtgagttattgtattcggttttatatatttattttgtttgtttgattgtttaatttaatttatttattttatttgtttattttatttattatttatttatttaatttatttgtttgtatgtttgttttttttttgttttttttttttttttgagatagagttttgttttgtcgtcgaggttggagtgcggtggcgcgattttagtttattgttgaattttcgttttttgggttttaagcgatttttttgttttaatttttggagtagttgggattataggttcgtattattgtgttcggttaattttgtatttttagtagagaagggttttattatgttggttaggtttgtattgaatttttgattttaggtgatttattcgtttaagttttttaaagtgttgggagtataggtgtgagttattgtgtttgtttttaaatgtttgtttttatttatttatttatttatttatttatttatttatttaatttatttttttgtttaatttaatttattttatttattttatttattatttatttaatttgtttgtatgtttatttaatttatttatttaatttattaatttattatttaatttatttaatttgtttatttaatttattttatttatttatttatttgtttatttatttatttatttatttgtttattttaagtatttattacgtattaagttttggttatttttttttttaggtagatggagtaattggaggtagttaataaagatggagttattttttttatttttttttaaattatcgtaagaggattaagtttttatattttttgagtgttttatttttttttatagattgtgttttagtgtttagtaggaaatatagtttattttttatggtttaagagattgtagaaagggggttatttatataggttaagggaattaattaatttgaagtatagatattattaatagtaggaagagttttgaagaagtgaaaatggtgtttttggaatttagagagtgtttgtattttggataaggggttattttatagaagttgtggaggggtagggttgtaggtgaggatgaatatatagttattgatagaaaatatgtttagggtagggatagagtaggaaaaatattttagttttttttttttatttttttattttatttttgaaaggtattttttattggttagtttcgattggtgttggagggtaagagagtttatgagttatgtgtggttgttagttttttggtggagagttatagataggatggagagtggttggtagggtttcgtggggatgaatagtttggattggggcgattgggttttatttaggttgggttggatgtgtgtatatattttagtgattcgttttagaaatagaattaatatggtgaatagagaaagaagaaattagtgattttcgtttttttatataatttaatttggtttaagttagttaaagttatattaagttttttttttatgttttagttgttgttaggtttgtggtggttatatagttggttagattgttatttttgtttttaaggggtttaagttagaggaggagagttgagaaattaaattattatatataaagtagaaggtggaatatatttaggagtatgttaacggggtgttgtgggattttagagtaggtagatcgttattaagttttaacggtaaagatgttattgggggaaagaaggattaagtttggaagatagagtaagtttggaggtaagattttgttttattagtaggggttaggtttatggtgatattttttttaggtagttatttttttgagtttattttatattttaggtttggatttaaagatatttgagttttgttttagtttttttttgaggtgttattttggtgttttttttataattattgttttagttttatgttatttggtttttagttattatattaagtttttcgaagttttatatagattatgttatatttttattaaaaaattagtagtgggtttttttatttttaggataaagttttagtttttcgatttgtttgttaatatttgtaattattgtttgtataaattagttgggtgttgttatgaaaggattatttgagtttaggagttttaggttgtaatgatttatgattgaattattgtattttggtttgggtgatagagtggatttaaattaaaaataaaaagatttatagttaagttttaaaggttttttttatatttttttttattattatttttttgagttttttttttttttcgaagttttttcgtatatttttattatttttgtatattttagaatggggatatttttttttttttttttttatttaatttatggtttttaaatttgagcgtgattagttatttggagatttgtgaaaatttagatgattagatttatttttagtttttgatttagtaggtttggggtggggtcgaggatttgtatttttaataagtttttaggttatgttgtcgttgttattgatttaggattttgggaatcgtttttttaatttatagttgtttattttttatggtttatttagagtttttttgttttgtttttattatttttagtttcgtttgtttgttaagcgtataggaaatttttttttatttaaattttggattaacgttttttgtttggtttatttagaggttttgtagggttggtttgatattggatagagaaatggttttttgtttttttttttttgatttttttgaagggggtttgtttttttatatttgtgggtatttttcgtaaggtggagataagagattgagaaaagaaataagatatagagaaagtatagaggaataaaagtgggtttaggggatcggcgtttagtaagtgaggatttgtatcggtgttggtttttgagtttttttagtatttattgattattatttttattattttcgcgaggggaatgtggtggggttatagggtgaaggtgaggagagggttagtagaaaaatatatgagtaaagattttgtgttataaataagtttaaggaaaggtgttgtgtttggatgtgttagatttatgtttaattttatataaatattttagtgtagtaaagagtaatagagtagtattgtcgttatgatgtttcgtttttagatataaggtagttttttttttttttaaaatagaatgtatgatcggttttatatcgggttattttatttttagggacgagtaggagatagatgttttttttttattttaatcgaatagaggttttttttttttattaattttttttagtatagattttttacgggtgtcgggttggggggttgtaaggtttttttttttttatgaggttatattttaggttgttttagtggggggaaatttggataatatttaggttttttcgggtaggggtttttgcggttttttatagtgtattgtgtttttggttaatagagaacggagaatggtgatgatttttattaagtatattgtttgtaagaatttttttttttttttttttttgagatagagttttgttttgtcgtttaggttggagtgtagtggcgcgatttcggtttattgttatttttgtttttcgggtttacgttatttttttgttttagtttttcgagtagttgggattataggcgttcgttattacgttcggttaatttttttgtatttttttagtagagatggggttttatcgtgtttattaggatggtttcgattttttgattttatgattcgttcgttttggttttttaaaatgttgggattatacgtgtgaggtaagaattttttaaaagtgtattttgcgtagttttagatttattaaattttgatttaatataggatatgtttttgtgagtatagggttgggataaaagttatagattaatagtattttaaagtagaataattttttttagtatagattaaaatggagttttttatgtttttttttttttatatagatatagtaataatttgattttttttttttttttttatattttttacgttgtattaggttttaatttttgggaacgttattttagaattgttttatatatttttatagttatttggtttaggttttttgttgattaggatggttgtagttttgtttttggtgtttcgttttttttagtttttttatttagtagttgtaggggtttacgtggtaaatttaataatttttttttttatagaaaattttttgttggttttttagtgtttaggatttagttttagtattttagtacggtttttaagtatttttacgttttggtttggttttatggttttttcgttaatttgttattttttttatgtatttttttttgattttttttttatttattttagtaaagaatttttttttggtttgagtatagtatttcgtggtgtgtattttagagtatttagttaggggtgtgtaagtttattttgttattggttgatgttgtgaagttttaagttgttggtgtcgtaaataaaaaattggatatgatatatataaatagtaaagtagtaaaagtttattaagtatagtacgatttattatggattaaggatgatttgcgaatggtattagtattattttgttatattttatggttttttttatgtgttttttttttttttttttttaagttgtttaagttttagttagtatgtgttttttggttgataggtgggttgtttagttttttggtttttgtgtgtttacgtgttattttttttttatagttttaagtatatgtatgatatgtattttgtaggtatgaattttaagtagttaattattatacggggttattttgaggatattttttttttgtagtatatgtgtatttttttttgtagtggtgtaattttggtttattgtaatttttttttttttggtttaagtgatttttttgttttagttttttaagtatttgagattataggtgtatgttattacgttcggttaatttttgtatttttagtagagatggggttttattatgttggttaggttgatttcgaatttttgatcgtaagtgatttatttatttcggttttttaaagtattgggattataggtatgagttatcgtatttagtttagtatatgtttattttttaggagttgtttttaattggtttggtttggatttagttagttatggggttttttatttatttatttattttttgtttttgtttatttgttttttttttttgtttttgtttttatttattttttttttaatttaatttttaattttttttgttatttttttgttttaagtttattaggttggttgtaagggttttgagggagaggttgtgtatcgtttttgtatattttaggtttagtaaatgtttgttgattaatgattggtattttttttaggttttgttatttttgtgggtttaggtttttattggtttaggtttttgtttttttcggtaaggttataatgaatcggggagttttttttaggtatttgtttttggtgttgtaattgggtaagtttttagatttggggttttaatgtagatgacgtgggaggaaaggtaaaggtggaggatggggtagagggggatagcggcgatattgagatttgattttttttttttttatttagcgttttttttagtagttatttagggaaagaaagtggtgttgggtaaaaaaggggatatagtggaattgatttgtatagttttttagaagaagagtatataattttattggaaaaattttaattagataaagattttgggaaattagggtttttttttaattaaaggtagggttgtttggttttttatttagggaggaaaatatattatggagtgaaagtttttggtgtttgagatttggttttagttaaattttgggattttagagggtttgggttgatagaaatttagtggtatttttatttagagtttttttatattaattgttggtggtttagggaaaggtggtatgtgaattttaatattttaatatttaatatttatgaatttattttagtgagttttagaataattattattatttaaaattcgtgattttttgagtattgttgttatagatttatgtagataatattttgtatagtgatttatatgtataattttagtattgtgggaggttgaggtcggaggattgtttgagtttaggagtttaagattagtttgaataatatagtgagattttgtttttatgaaaaaaaatatatatatattttttttggagataaggtttagttttattatttaggttttagtgtagtggtgtgatttcggtttattgtaatttttattttttaggtttaagttattattttattttagttttttaagtagttgggattataggtatgtattattatgttaggttaatttttgtattttttatagagatagggttttattatgttggttaggttggtttcgaatttatgagtttaagtgatttatttattttggttttttagagtgttggaattataggtgtgtgttattatgtttagttaaaaaaaatttttttaattaaaaaaaaaaaggtcggttgtagtggtttatatttgtaatttagaattttgggagtttgaggtgggtagattatcggnggttaggagtttaagattagtttggttaatatggtgaaattcggtttttattaaaaatataaaaattagttaggtgtgggggtgtagttttgtatttttagttatttaggaggttgaggtaggagattcgtttgaatttgggaggtaaaggttgtagtgagttgagattgtattattgtattttagtttgggtgatagagtaagattttattttaaaaaaaaaaaaaaagttgtanatttattattattattattagtttatttatttatttttttgagatagagtttcgttttgtcgtttaggttggagtgcggtggcgtgattttggtttattgtaatttttatttttcgggtttaagtgatttttttgttttagtttttcgagtagttgggattataggcgtatgttattatgtttggttaattttttgtatttttagtagagatagagttttacggtgttagttaggttggttttgattttttgatttcgtgatttattttttttggttttttaaagtgttgggattataggcgtgagttattgtgttcggtttagaattatttttttttatttttttttttttgaggtaaattttcgatttgttgtttaggttggagtgtagtgggtatgattttggtttattgtaagttttgttttttaggtttaagtaatttttttgttttagttttttgagtagttgggattataggcgtgtgttattatgttcggttaatttgcgtatttttagtagagatcggtttttattatattggttaggttggttttgaatttttgattttaagtgatttttttattttagttttttaaagtgttgggattataggtatgagttattgtatttggtttttttttttggttttaaaattattatatgtttattataaaatatttggttaatgaagaaaagaatatggaagaaaattaaatgtatgtatatttttattatttagagatattttttgttaatattttgattgatttttttttaatttttttttttttttttttttttgagatagggttttattttgttgtttaggttggagtatagtggtatgattataatatattatagttttaagtgatttttttattttagtttttttagtagttgggattataggtgtacgttattatgtttatttaattttttattttttgtagagatgagattttattatgttgtttaggttggttttgaatttttaggtttaagtgattttttcgttttggttttttaaagtgttgggattataggtatgagttattgtatgtggtttatttttttttattgttgttcggcgtggagaatattatatatataattacgtaaatgatattatattgtatatatttttttttttattttttttttaagttatattataatgagattattaattattagatttttttttttttttttgagacggagtttcggtttgttatttaggttggagtgtaatggcgcgattttagttcgttgtaatttttgttttttaggtttaagtaattttgttttagtttttcgagtagttgggattatagatacgtgttattatgtttagttaatttttttatttttttattagagatagggttttattatgttagtaggatggttttaatttttcgatttcgtgattagttcggtttggttttttaaagtgttgggagtataggtgtgagttatcgtattcggtttagattaattatttaaagtaatttggtaatgtttaacgaatataaaattttaaaatttttggatttaataatagttattttggaaagtttatttgatagaaataaaattgtgaatatttttttttgttgtttttttgagatagagttttatttggacgtttaggttggagtgtagtggtatgatttcggttaattgtaatttttattttttgggtttaagtgatttttttgttttagttttttgagtagttgggattataggtgtgtattattatgtttggttaatttttgtatttttagtagatggggttttattatgttgattagggtggtttggaatttttatttttaagtgatttatttattttggttttttaaagtgttgggattataggtgtgagttattacgtttgattagtgaatatttaataatatttatggaaaggtgttattataagaattgtttgtggggtcgggcgtggtggtttacgtttgtaattttagtattttgggaggttgtggtaggcggattacgaggttaggagattaagattattttggttaatacggtgaaatttcgtttttattaaaaatattaaaaaattagttaggcgtggtggcgggtatttgtaattttagttatttaggaggttgaggtaggagaattgcgtgaatttaggaggcggaggtcgtagtgagttgagatcgtgttattgtattttagtttgagtgatagagtgagattttattataaaaaataaataaataaataaataaaatataaataagtaaataaaggttaggagtggtggtttacgtttgtaattttagtattttgggaggtcgaggtggatagattatgaggttatgagattaagattattttggttaatatagtgaaattttgtttttattaaaaatataaaaagttatttaggtgtggtggtatatatttatagttttagttatttgggaggttgaggtaggagaattatttgaatttaggaggtagaggttgtagtgagttgagatcgcgttattatattttagtttaggcgatagagtaagattttgttttaaaataaataaataaataaataaataaataaataaataaataaaataaaaagtatatatatatatatatatatatatatataatgtaaaagatttattttattataattaatattatatttaatggtgaaaaattgaattttttttttttaagtgtaggaataagataaagatgtttgtttttattatttttatttaatataatattgtaattttttgttagtgtaataaggtaagaaaaatgaaataaaaggaaaattgattagaaagaaagaaataaaattgtttttatttgtggatgatatgattatatagaaaattttaaagaatttgtaagaaattttttagaattaataaatgaatttattaaggttgtagaatataagataaatataaaaaatttattgtatttttatatattagtaaggaatatgtgtatatagaaattaaaattataatattatttataattgtttaaaaaggttaggtatggtggtttatatttgtaatttttgtattttgggaggttaaggtgggaagattgtttaagtttaggagtttaagattagttcgggtaatatagtgagattttgtttttataaaaagtaaaaaattagttgagtatggtcgggtgtagtggtttatttttgtaattttaatattttgggaggttgaggcgggcggattatgaggttaggagatcgagattattttggttaatacggtgaaattttgtttttattaaaaatataaaaaattagttggatgtggtggtaggcgtttgtagatttagttattcgggaagttgaggtaggagaatggcgtgaatttgggaggcggagtttgtagtgagttgagattgtgttattgtattttagtttgggtgatatagtgagattacgttttaaaaaaaaaaaaaaaaaaattagttgagtattatggtgtatgtttgtagttttagttattggggaggttgaggtgggaggattgtttgagttttaggagggtaaggttgtagtgagttatgattatattattgttttttagtttcggtaggagagtaagattttattttaaaaaaaaaaaaaaaaaaaaaagaaaagaaaagaaaagaaaagaaaaagaaagagagaaagaaatatttaggtgtaaatttaaaaaatatgcgtagggttaggtgtagtggtttatgtttgtaattttagtattttgggaagttgaggttggcggattatttgaagtcgggagtttgagattagtttggttaatatggtgaaatttcgtttttattaaaaatgtaaaaattaggtaggtgttgtggcgtatgtttgattttagttattttggaggttgaggtaggagaattgttttaattcgggaggtagaggttgtagtgagttaagattgttttattgtattttagtttgggtaatagagtaagagtttgtttttcgaaaaaaaaaaaaagaaaaaagaaagtattgaattgtatgttaaaaattatacgatgttgattaaagaagttaaagaagatttaaatatatggagagatatgttgtatttatggattgatggattggaagatttaatataagatagatattaattttttttaaattaatatataagtttaatttaatttttataaaaatattagtaagattttttgtagatataaataagttggttaggtgtagtggtttatatttgtaattttagtattttgggaggttgaggtgggaagatcgtttgagtttaggtgtttacgattgtagtgagttatgattgtgttattgtattttagttggtattttagtttaagtgataaagggagattttgttttaaaaataaaaataaaattaaaataattttgttttgtaaaatttttattaagaagaagaaaagaggttgggtatagtggtttatcgttgtaattttagtacgttgggaggttgaggtaggttgattattttagtttagaagtttgagattagtttgggtaatatgaggaaatttcgtttttattaaaaaaaaaaaaaggtatatatatatatatatatatatatatatatatatataagtatatatatatatatatatatatataggtgaatagatgtatatatatttatttattgtgaatatatatttatatatatacgtgtgtgtatatatatatttaaaatttatttttatttatttatttatttttgagatagagttttgttttgttatttaggttgggtgtatttgtatttttaacgatataggaggttgaggtgggagaattattgagttagggaggtagaggttgtagtgagttaagatgttgtttggttgtttgggtaatagagcgagattttatattaaaaaagaagaataataagaaaagatagtttatagaatataagaaaatatatttataatttatatatttagtaaaggattggtatttagaatatgataaataatttttaaaatttaaaattaaaaaaatgaataatttaattagaaaataggtcgaaaaggatatatagttggtaaataagtatatgaaaagttgtttaatattattaattattagggatatgtatattaaaattataataggttattattaaatttattagaatggttaaatataaaattggaatattattaaatgttgatgaggatgtggagaaattgggttatttttttaatattggtgggaggttaaaatggtaaagttattttggaaaatagtttgatagttttttataaaataaaatatgcggtcgggcgcggtagtttacgtttgtaattttagtattttgggaggtcgaggcgggtggattacgaggttaggagatcgagattattttggttaatacggtgaaattttgtttttattaaaaatataaaaaattagtcgggcgtggtggcgggcgtttgtagttttagttattcgggaggttgaggtaggagaatggtgtgaattcgggaggcggagtttgtagtgagtcgagatcgcgttattgtattttaatttgggagacggagggagatttcgttttaaaaaaataaaaataaataaataaaaaatatgtaataatttagtaatattgtatttttaggtatttattttagagtaatgaagatttatgtttatataaaaagttgtatataaatgtttatagtagttttatttatggtagttaataattagaaataatttagatgttttttaattggtgaatgattatatttatattacgaaatattttttagtaataaaaaggatgaattatagtatatattataatttggatgaatttttagggaattatgttgagtgaaaaaaagttaattttaaaaggtaatatattgtattaatttatttatataatatttttaaaataattaattatagaaatggagaatagatgagtgattgttaggggttaaggggtttagggatggggaggggaaggggtatggttataaaaagtaataattttatggcgtcggaaatgttttgtattttgattgtgttaatgtgagtatattggttgagatatagtgttatagttttgtaagttattattattagagtaaattggatagagggtatataggatttttttgtattattttttataattgtaagtgaatttataattattttaaaataataagtttagtttaatgttaggcgtggtggtttatatttgtaattttagttttttgggaggttgagacgggtggatggtttgagtttaggagttcgagattagtttggttaatatggtaaaatcggtttttattaaaaatataaaaattagttgggcgtggtggtaagtgtttgtagttttagttattcgggaggttgaggtaggagaattgtttgaattcgggaggtggaggttgtagtgagtcgagattacgttattatattgtagtttgggcgatagagtgaggtttttttttaaaaaaaaaaaaaaaaaaaaaaaagtaggtaggtagggttaggaaagcgtataatttttgtagtttaaatgattaatttaaaaagtgaagattggttaggcgtagtggtttacgtttgtaattttagtattttgggaggttaaggcgggtggattacgaggttaggagattgagttattttggttaatatagtgaaatttcgtttttattaaaatataaaaaattagttgggcgtggtggtattcgtttgtagttgtagttatttgggaggttgaggtaggagaattatttgaatttaggaggcgaagttgtagcgagtcgagattatattattgtattttagtttgggtgataaagtgagattttgttttaaaaaaaaaaaaaaaaaaaaaaaaaaaaaaaagtgaagtttatttttttttttaaatttttttttttttttttttttattttgtgagataatttttttttttttaaaaagttaagagtttatttttgtaagtaaagattattttaagataatttagaaatgtatattattagtattttttattttattgtaagttatttgtaaatattggttttggtgttaatttagaattttattaaattaattgttttttaatatatggttattattattttgtttaatattgtattttattaataatgttgtaagtattatttttgtagttaaattatggtttgtattttaaaattattgttttaaggataaagttttagaaatgaaattaaggatatgaattttttgagtatattttgttagtattgagtagtattatttaaaatttttggggggggtaattttataattgaaaaatatattattgttttaatttgtattttttttattgtttatgagattaaaataatgtattattttttaaaaatttttaagttttttgtgttgatgtttttgttttgtttttatggattttatttttttttagaatagtttttttttttaattttttgatttttaataataatagtattattttttttgtttttttaatttttgaaatatagagttatgtttttttttttgttttaatttttggttttttatcgttattaattatgatttttttttgttttgaaagtgttttgggtcgggtatgatgtttgttatttattgtaattttagtattttgggaggttgaggcggttggatgatttgatttgaggatttcgagattagtttgggtaatagggcgaaatttcgtttttataaaaaatataaaagttagtcgggagtggtggtatatgtttgtagttttagttatttggggggttgaggtggtaggattttttgagtttacgaggtagatgttgtagtgagtcgtgattgcgttattgtattttagtttaggtgatagagtgagattttgttttaaaaaaaaaaaaatgttttagttttttttttttttttgtttttatgggaatgttattattattagttaaggtttatatattttttatttggattatagtgagtttttaggtaatttggtttgttattagtttcgtttatttggattttttttttttttgttgtagtattgttttttaaagttatgttttgtatatgttatattttagtttattagattaagtttagaagtttttgtaggacgtttatttttttagcgttattgtttagttttttagtggaaatttttgtatttaggaggtttttttatagtttgtttgtgttgtttttttggagtttttttttttttttgtaatgtttttgttgtttttcgtttttagtttattgtttatatttttttttttttttttttttgagatggagttttttttttttatttaggttggagtgtagtggcgcgatttcggtttattgtaatttttgttttttgggtttaagggatttttttgttttagtttttcgagtaattgggattataggcgtgtattattatttttggttaatttttgtatttttagtaaagattgggttttattatgttggttaggttggttttgaatttttgtttttaggtgatttatttgtttcggttttttagagtgttgggattataggcgtgagttatcgtatttgttataggtttatattttttttaagtttttatttaatattagttgttttatgaatttgttttagatttatttatatgtttagattttttatattattttgttatagtttttttaaagtatgggatagtatggataagtaggttatggtttttttttgaagagaagtaaggaggtagagttattttaggaggagggttatatattttattttgaattaattgcgtttggggtgatggtaggatattaatataaatttattttttggattattggaaatgtgtgtttagaattgaggagagaggttagggttggtagtaataatttggttataatttgtagagttgattggggatgaggtggaatttagaatgtttgtagaaacggggaagagaattaaagatagagtttgggataatatttaaatgtagatgttagagtaagagtttaagacgaagaaaaacgaattatatttagaaatggaggggaggaataaaagaggcggagtaaagtggggtagaattagagtaggttacgtttttaagaagtttggtaaaggaattgtgaaaggaatgtagttgaattttagggtaagttggggaattaaagtagtgtgtagatttagggtaaatagtaagtagggtaggaattattgaaggaataaataaagggggaggttgggtttaggttgttttgagtagggaagtttttttaaaaagtgtgaaattgaaggtgtggggtggattgggtgtttgtcgtgttttgaggaagtttggggtaattgtgtgttgaggttgtgaggttgtttggaaggggtttttggatagtaagagttgagtagtggggaagaggattgtgtggtttggaagaggagagaaaggagagtgagtgattgaattggtatttaggtttttatattaaggtagaaagagggagaggatttgggtattttagggaggtagaggtagtattaagtagggtgagaggttttagttttagttatttttgttttatttttttaaatatatattttaagtaaaaataaaataaaatagaattgtttgttatgtaaatttagtttttaaagttttgttttatagagattttggagtttttattgtatttagaaaatgtatagttaaagagaaaattttttttggtgatggttattagattttataagaagaggttaaaggagatatatatttatgttagaagaattttttagagatagtattgtatagcgaaatagtttgaattatttttattttttaaaatatttttttttttttttttttttttttttttttttttttttttttttttttgagatagagttttattttgttatttaggttggagtgtagtggcgtgattttggtttattgtaatttttatttttcgggtttaagttattttttttttttagttttttaagtagttgggattataggtatgcgttattatgttttggttaattttttttttttttttttttttggtatttttagtagagatggggttttattatgttggttaggttggttttgaatttttgattttaagtgatttatcgttttggttttttaaagtgttgggattttaggcgtgagttatcgtattcggttaaaaattttttttttttaagatgaggttttattttgttgtttaggttggagtgtagtgttataattatagtttattgtaattttgaatttttgggtttaagtgatttttttgttttagttttttaagtagttgggattataggtatgtgttattatatttagttaattttttttaaaataattttttttagagacgagggtttcgattggttgtttaggttggttttagatttttgacgggttgtattttaattttagttttattatttacgggagttaaaatttaaaagatagaaaagggtatataggttgggtgtagtggtttatatttgtaattttagtaatttgggaggttgaggtgggcgggttgtttgaggttaggagttcgagattagtttgggtaatatggtaaaatttgtatttattaaaaatataaaaattagttagatgtggtggtgtatatttgtaattttagttatttcgaaggttgaggtaagagaattttttgaatttaggaggtagaggttataatgagtagagatcgaatattcgattttataaaaataaataaataaaaaaagaaagtaggttgggtgtggtggtttacgtttgtaattttagtatttcgggaggttaaggcgagcggattatttgaggttgggtattcgagattagtttgattaataaggagaaattttgtttttattgaaaatataaaattagtcgggtttggttgcgtatgtttgtaattttagttattcgggaggtagaggtaagataattgtttgaattcgggaggcggaggttgcggtgagttaagattatgttattgtattttaatttgggtaataatagcgaaattttattttaaaaaaaaaaaagtaaagggtatatagtgaaaagttttttttttatatatgagtatttattttttttttttagaggtaattaaggttatttttgtgtgtgtgtgtgtgtgtgtgtgtgtgtgtgtgtgttttgggatagttttatttttttattaaggttggaatgtagtggtgcgattttattgtaaattttgttttttagttttaagcgattttgtgttttagttttttagttttttttttttttaaatggggttttattttgtcgtttagggtggagtgtagtggtatgattatagtttattgtagtttcgattttttgggttaggttatttttttattttagttttcggtatagttggggttattggtatgtattattatatttagttaatttttttttttttttgagatagagttttattttgttatttagattggagtgtagtggtgttattttatttgttttattgtaatttttgatttttgggtttaagtgatttttttattttagttttttaaggcggttaattaaaaaaaatttttttttttttttttttagagatggggtttcgttatgttgtttaggttgatttcgaatttttgggtataaataatttttttatttcgattttttaaagagttgggatgagagatttttattatgtttggttttatttttttttttaatttttttttagatattatagttttttttaatggttttatttttttatgtttaattcgagaattattttttttatatataaagaatatattttttttatttttaaaaataaatagtagattgtttaatatttcgttttatttagttagtgatgttttttagatacgggtttaaattagtatataaagtatttttttattttttttttacggttgtatagtagtttattgaatgggtgagttatgatttatttaatttattttttattgatggatatttggttttgtatatatatttgtaattttgtatagattataaattattatttaaagaaattgtattggtttatttttttataatgtgtgagagttgggtaattatttaattttaatatgtgagagtttaggtagttatttaatttttttgagttttagtttttttatttgtaaaataaataaaatagtgttgatagtatttatttttcggaattattgtggagattattgagatgatgtttgtaaagtatttggtatgtaggagttggtgttttttaaataaggatatgattttatttgtatttgtgagttattgttttagttaggtaaatggatatgatgagatttttttgttagatcgggtttttttgattagaacgaggagtagatgttgtaggaaattagtaattgatattagaagagtcgtgggtatttttttgttagaggtgttttgtttttagggcgttttagtttttttttatatgttttttgtttttaggtttatttaagttgaatgatcgcgttgatttaagaagaagtttttgggattaaggaaatttttttttgattattaagaattttaagatagaagatttagatatttatatttgtgaagtggaggattagaaggaggaggtgtaattgttagtgttcggatgtgagtggggtaggtggggatgaggatattttttgtttggtttttttttttattatttttatttttgtattaaatttagtttgagttggtgatatcgtagtagttttaagaggattaggttgttaaattggtttttaaatgttttaaaattttttttgattaggtgagggatgttggtgggcggaggagggaagaggttttgggaaaaggaaagaaaagggaaggaggtaagggaaggagggagagagattggggaagagaggatgaggggagaggaggaaagaagagagagaggaggggagagggaaattttattttggttgggggtgcgtagttgggtgttgggaggaaggagatgttgggacggcgataatggagagatgttgttggttttttgttgtttgtttttttttttggggatggtatgtgtgtgatatagttggtttttttttttatagtgattgttaattttgatatttatttgttttaggggtagagtttgattttgattttggagagtttttttggtagtagttttttagtgtaatgtaggagtttaaggggtaaaaatatatagggggggaagatttttttcgtgttttagttggagttttaggatagtggtatttggatatgtattgttttgtagaattagaagaaggtggagtttaaaatagatatcgtggtgttaggtaagggaagttttttttcgcgtagttttttttttgttttaggggttgatagtttttttttttgttttgattgttttgtttttggttttggtgttgggaggttaggagtggagaagattaggttttttagagttgaggtttgttttgaaggatttattggggtttttatttttagggggttgattggtagttattttttagtgtggtggatatggagaaaggaaaggttggggaaggtaaggatgttagaggttcgagttttttttggaggttttaaaggaggaatgttagggagtttattttttttgttgttttagttttatatttttattaagttggtaaatttatttatttagggatattaatattagtaagttaattttgatgatgttttatgttgtatttttggatttttaagttaggttattgtggggagattaaggttttattttagattttgttttttgggtgtttatgtgatttaaggtagatataaggtagtgtgttagtttagtgtatgtacgttgattgaaattttggttttgttataattatgtgattttgggtgagttattaaatttttttgtattttggttttagtttttgtgaaatggggatgatgttaattgttatagtgattatttcgtattaagttgaggattgatatacgtaaggtattgaaaatggtgtttggtatagagtaagttttagttaagtgttcgttgttattttgtgaagggtgatgaatacgtttttaaggagtggaggttaaatggtttttgtggtttaggaattttaaggatagtaaggattttttgtggttgggttgttttgtgatggttttcgggaggagggaggtggtttgttgtaggaaaatgttgggtggaagaagggagagaaggttggagaggtaggaaggaattgaagtatttgaagtgataaggtgggtgtttggattcgtcgggtttttttttatttttttgttgtttttatatgttaattttattcgtgtatttttatttttttatttttttatttagggtttttttttttttatttttagttttttagaaggtttttagtatagtttataagaaagagggggaataggtggagtttttttttttattcgtttttatagttgaaaagttgacgggtagtggcgagttgtggtggtaggcggagagggtttttttttttaagttttggattatttttgatttgaagaataaggaagtgtttgtaaaacgggttatttaggattttaagttttagatgggtaagaagttttcgttttattttattttgttttaggttttgttttagtatgttggttttggaaattttattttggtttttgaagcgaaaataggaaagttgtattaggaagtgaatttggtggtgatgagaggtgaggggttaggttagggaggggtgggtaggggaaggagttggaggggtttggtttagggttttttttgaggtaagttaggttttaagaggggatgtttaggttttggttatttggatgaagtgagggagggttttttgggtttggggttggttttgaattgagatatttatgagttagtttggggttggttttattgaagatttttaaagtatttgggttaagaattagggttttagttttttttataattaattttttgtgattttggttaagtttttttttattgtaggtttgttttttgatttgtttaataaggataatgaaatttgttttttgtgtgatagtaatgatgataatgttaagttttaaattgagtttttggtttttttatttttttattattataacgattttgtaaatagtaatggttaatatttgatgtttagtacgtgtcgggttttatttaaatattttatatgtatgtttgtttttagtattatttgggtgtaggttgttaagttatttgtttagagatatatagttgttaagtagtggagttgggatttaaatttaatattattggattttaaacgttgttttttttcgtaggattgtatgaaaatttgttttaaaaggttaaaagaaggttatttatatagagtattattttaattgttttattgaattttaggtttttgattttagtttttcgtttttttgtagttatttagttttagaaaaatttgatttgtgaggtgtggggatttattttttttaagttgatgttgagtttgaaattggagaataaggaggtaaaggtttcgaagcgggagaaggcggtgtgggtgttgaattttgaggcggggatgtggtagtgtttgttgagtgattcgggataggttttgttggaatttaatattaagggtaaggatttaggttttaaggtttttgttttttgggttgcgggatttttttgtggttggtagagattatttagagtttcggttttttaatgtttgagttggggggttatgggtatggtgttttttgtggttttagggtgttttggaggttttaaaaggaggtatagaagtgatgaagtgaggtgggttgtggttttgggttttaggttgttagttgtaattttataagtttttatttttttaggtttatagtttagggatggggtttatttgatcgagagtttttttttttggtttttggtttttttttaaatttagacgtatttatatatatatttatatatatatatttttatatatatgtatatatttttatatatttttatatacgtatatatattatttatatattcgtatatatttatatatatattatatatatatttatatttatatttatatttttattttatgtatttatatttatgtatttatatattgttatatatttatatatatatatgtatttatatatgtatgtatatatatatttatatatttacgtatatatttttatttatatattgtcgtatacgtatatttatatatttatatatttatattcgtatacgtattatttatatatgtgtatatacgcgcgcgtatatgtatgtagttacgtatatatatttatatacgtatataggtatatatttatatatatgtatatacgtatatatatttatatatggatttatacgcgtatacgcgcgtatatatatatatttatattatttatatacgtatatatatgtatatatttatatatgtatatatatatgtatttatatatatagtttaggagttagattatagtttttttttttttagagtgttttggatatggatatgtttaaatataaaatcgattttttagtattggcggtttttgagagtttttaggtatttttttttttttttttaattttagggttaaattagagattggttaggagggattgtagggtagtttttagttttttggttcgtggaggagggcggtgtattgagtatattttttttttttgtagttttgtttatatggtttatttcggtgtagttaatggttttgattgtgttggggggcgtcgtcggttttttgttttttattgggttaggtatttttttttgtgttaggtgtcggtatcgaagggtgagtaattttatatttggtttttataaggtttttaaatttttgagttttttattaggagattttgtatatgggaattgattttggtttagttttttttgtttattcgtaagtttttttgttgttttgttttagattttatttaagggagagataggaaggagtagagagttaattttaggatagatggtttgggttatgtaattgttttttttgtcgtagttttttttattttttttattaaggggtattttttttttggaggtttgggattttcgtgatttttttttttgtttttggatagcgttaagtagagcggatgttttagattaagagattttttagtgagaagaagatttgttagtgtttttagtaaggatttgggaggaggggttgagagaggggaaagggggagggggagggagttagagaggagggggaggaaggggagtaaaggggggtaggaagggaggatggagaggaggaaggagttgaggaggaagagttgggaggggtggaggtgaggagatgggggttaaaggggtgtggtggagaggatagaggggtgggaaaagatggttaggagttagaaggaggtagaagtgggaggatggagttgaaggagtagtaggttaggaaaggttttgttggaaagttattggagttgtgttgcgttggaaaggttattggaggtgttagaacgtaaaggggttgtagtggggatagatttgtttttttttttttttgtttttgtagtcggttttagaagatatgtagttttatttgaggtacgaggttaggtagattttatttgtagtttttttaggtgtttgtttcgcgttttttgtttgcggattagatgaatgtagtagatttttagtttttggttttttgttcgttttttttataatttgttattgttttttttgggttaggtttcggttttattggttgagtgttgttttttagtttttagaggtttaattatatcgttttttacgttattttttttttttttaagtttagttttttttttattatttttttttgattttttttttattgtttatttggattttaggggagtgtttagggttagttttggttggtatggagggtgaggttgggtgtttggaagtatggagtatgggattgtttttttataagataggattttgggattatagagggtaggaatttgtataaaattatatagttaagttagttaaggatggatgtagatttagaggtttttggtagttagtattttttgttttatgttgttcgttttttattttatgtgggtgggattatagatttatattttgattttgtataaatagtttttttggatatagttttatgtatacggttttaagggatgttttatattttttgtttatttgagatttagaaaaattttataaggttggtagtgatagaattaagatgattatttttagtttatagattagaattagagtttagagaggttagatgattgattattaagtgtcggattagtaagtgttggagtcgggattaatttaggttttttgttttaagttttattgttgttttttgaatgtagggataaatgttatacggtttttattagtggttagtggtgggtatttaatgtgtatttttgggtttatagaagtatagtatttatgggaagggtttattttagagaatttacgagtagggatgaaggtttttttgtttaaaattttttttttatttttcgttggtggtagaatttgttattagaggataaagtttttggtttttttaattagagcgtaagttgggagtataggtattgtaggagagaatgtttagtgattagttattgattttgtgtagaattttttggaagcgagttttgttgggagagggggtagttagtttgagagggaattttttaagggattttaaaggtgattgtgttaggttttgcgtttgttttatatttttttttatttttttttagattatttaggatatagggaaattagggttataaatttttttgatttattttttttaggattttttttttttttatttttttttattattttttttagttttaattttttttttttatttttttttttttttgtttttaaagtttgttttttttaggaagatttttttattgttgttggggttttttatttgtttattttgtatttgtgtttattttttatttttgtttttttgagttgaaataaaaatataataaatttattataaagatgtttttcgtgtgtgtgtgtgtgtgtgtgtgtgtgtgtgtgtgtgtgtgagagagagagagagagagagattttttttttggggattaggaattttttggtttttggggtcggatttagaggagaggttgttgggcgtgttttaggaaggagatgaagtttttttggagagggaaaaattttgtggaggttgg

SEQ ID NO: 67 - DNA, 32123 bp, Homo sapiens
  misc_feature (12425)..(12425): n is a, c, g, or t
  misc_feature (12661)..(12661): n is a, c, g, or t
gtaggtttggagggtggtagtatgtaggtggtatgtatagttggggatgtgtgttgagtttgttatgtttggtgagttttttagtggagatgtttaatgggtagatggatatttatatagagagtttatggtagatttgggttagaggaaagtatttgaggtttggttagagatgtttagaggaatagagtttggttaatagttatttttggtgttttagatattttttgtttagtttatgtttttttttttatattgggttatttataaagtttttatagatatttttggggtatttattggatatatgtttttagggttttagagtaaggagttgtttgtgggtttattattgttgtttttatatgtttttaattgttttttatttttttttttatagtttggttagatatggtgttattattaatggaattttttttgttattttttttttgttgtttaatagtggtagtgatagtttgatttttgatttaagtttgattttgtttaatttttttttttgattttggtatttttattttgatatgttttttgagagtttggggggtggggaatttagttttagttggtgatgtttggggttggtttaggtttagggtgtggaggagttttgttattgggttttttgtttttttttatttaagtatgattttgtagaaggaataaagtattttttttattgggtttttggttgtagagttttaagtttttatatagatatgtttgtttgagaagtagtgggtaagaaagatgtaagtttagaggtaaggtggttagatttggtttttttttttggagttgagagggaggggaatgtggggtagatgtataggaatgtgttttgtttagttgtttgtttatagttttggttatttttttttgtattttttttggaattggttatgagtagtgattttttattggaattgtgagtttttagaggttagagattgtgttagatttttttttgtagttttagtgtgtatagtttagtgtttagagtaatgggtgttttttagaggagtagtgatttaaatagtaagattagagagggagtgaagattggagattattttaggttgggaaaggtgtggaaggtaattagttgtgggtagttgaggggagaagattggaagaggggaaaagaggagaaaaagagtgaagaaggggagggaaaaaattagaaagaataaataaatataaggtgggaggaaatttataaaaaagaaatgatgaggaaaaatataaaaataagaaaaagagtaaaagaagtggaatttagtttagagaaaatttttgtaaaattaattttttttaatgggataatttttaaaaattgatattaaatattatatttgtagtattttataagttgtatgatttatgtaatagttttttttaattattttttgtgtttttgtgtgtatttttaaatttttgtttgtttttttgtttttttaagatttttgaataatgtttaaaggtatttttattttagttagttttaaaatgatttatgaaataggaaagttaaaatttttagaaagtgttgaaattgagtttttgtgtatgaattgttttaaaagttgtagatatatatttttagataaatatgttatttaagaaatggatttgaaaagaattggtggtaggggttttatgaggttgggagagttatagaaggatgtgtagttttttttgggtttggtagggtgtgagggagagtgaggatttattgttttttttgaagggaagttttgtgttattttagtttttttgtttttagatttttttagtttttgagattttatggttttgaagttgtgttatttttagtgttttttgttttttttttataggttttttttgggagagaggttttttggggtatgttttgattttttaaaatggaaaggttttgtttttaataatttaaagattttattttgagtgggatagtgttttttgaatgttttgtttttgtggtggatatttttattggggtaaggttaagagtagggtttgatgggggaagttattgttattttatattttgattaataattttttgtgttgtattagatgttgtaggttgatataaaatggttgttgtttttaaagttagatgaaagagtttttgaggatagtgttagagatatttgggagatgattttttttttttaatgtgggagtatttatataggagaggtttatatttagataaaaattttttttattattggtgttagatagagtttgggggtagttttaggttttgattttggttgtaatggtggggtggtgttgagggtaattggttagattaattgttttgtatgttttattttttattattatttttgagatggagttttgtttttttgtttaggttggagtgtaatgatgtgatttttatttattgtagtttttattttttgggtttaagtgatttttttgttttagttttttgagtagttgggattataggagtttaatattatgtttggttattttttgtatttttagtagagattaggttttattatgttggataggttggttttaaatttttggttttaaatgatttgtttgttttggttttttaaagtgttggtattatagatgtgagttattatattgggttagttttgtatattttagatatttaataaatgtttgttgaatgaaatatttgtgatgggttgggtgtggtggtttatattagtaattttagttttttgagaggttgaggtaggaggatggtttgaatttgggagtttgagattagtttgggtaatatggtgaaatttttatttttataaattttataaaagttagttgggtatggtagtgtgtgtttgtggttttagttatttgggaagttgaggtgggaggattgtttgagtttgggagatggaggttgtagtgaggtttgattgtgttattgtattttagtttgggtgagagtgaggttttgttttaaaataattttgatgaaggtggggaattagaagtaggtgggtaggggtttgggtttgtaaggttttgagtttgagttttgttttgtatttttgaggggatgagggaaggagggtgggtatggtttttttgatgtgggtgtttgaggtgaagaagaggatggtggaggttgtagttattaattataagagttttttagaggggttatagtttttaggaagtttataggaagttagttagtagtagagagggtgaatgtggtggggtatattttgtggttgggtttgagtgggttgtttgggggttatggggagaagataaaagtgtttgtgggattatagatttttgttgtggtggagttgggtttttttatttttttaagttttgttttttattttatttttgggggttaggggtgagggtggtaggaattttaaggttttgagaaagtgtgtggtgtgtgttgttattttggtttttttttttttttagtttttttttgttttattttggatttatgttttgtgtatttgttttgttttttagaattttttttttttttttttttttgtattattttgtgttttgtgtgtgattgtggattgtgtgtgtatagttgttgttttaataagttgttttaggttttttttttttatattttttttttttttttttttttgaggttttgtgtattttggggaattttgtttatttttttttgtttatgtgttttttttattttgtagttggtttttttatatttattttgggttgtaggtgtgtttggtaggttttttatagattaaagtttgtttagggtttgtattgttgttaaaggttaggaggattgtgtatagattggaaggagttagagtttagtggtagtttgagaggggaagttgaaaaaggagaagaggtaaggggtattttaggggagtttgggagagttagtatggttgtttggtatatgaggtaaagaggaagatagatatagatatagggagttgtaggttgggggtataagttgggggttgggaagtatagatatagaaatgtatagatgtgagttgagaagtaaggagggagagagagagatagaaagagagagagagatgtgttagggtttgagggattagagagtttttttagttttttttggagtgttggtatataggatgttattgtattagggtaagatatttttgggggtgttgagtatgggaattaaaggttagatttttggggtggtagtggaagtttaaagtattaaagtaagtatgttggaaatttatagttttttttatttagtagagttttggggtgagatgaggtagaatagggagttggaggtagggaggtggttgtttgtatatattttaggattatggagttgggggagttaaaatagttattatatggggaagggttaagaatgtttttagttttttttaggtattttattagggtaagttgaatttggattttagagaagggatattgtttatggagatttttttttttttattttttgtttattaaggatttagttagtttgggatgggggatagtgggaattattttttggtatgaggttatttttattttattttttttattgtagtttttttttagatgttttttatttgtatgttaatttgtaaatattttattattattggtggttagtttttttttttttttttttagaaattttttttttgattttttttttttttatttttttggtttaaataaaattgtatttatttattatttatttatttatttatttatttatttatttatttatttatttatttatttattttttttttttttgagataaaattttattttgttgtttaggttgtagtgtagtggtattataagtaattttaagtagttgagattataggtgtttgttattatttttagttaatttttttgtatttttagtagatatgggggttttatgatgttggttaggttggttttaaatttttggttttaagtgatttgtttgttttggttttttaaggtgttggattataggtatgagttattatatatgatatttggtttttatttatttatatttatttatttatttatttatttatttatttattatttatttatttaatttatttatatttgtttatttatttttatgtatttattttatttattgatttatttatttttttttttttttgagatagagttattttgttatttaggttggagtgtagtggtatgattttggtttattgtaatttttgttttttgggtttaagtgatttttttattttagtttttttagtagttgggattatttattattatttttggttaatttttgtatttttagtagagatagggttttattatgttggttaggttggtttttaatttttgatttaaagtgatttatttattttggttttttaaagtgttgggattataggtgtgagttattgtgtttggatatatatttattttttttttttttgagatggagttttgttttgttgtttaggttggagtgtagtggtgtgattttggtttattgtaatttttgttttttgggtttaagtgatttttttgttttagttttttaagtagttgagattatagatgtgtgttattatgtttagttaatttttgtatttttagtagagatgggattttattatgttggttaggttggttttgtatttttgattttaggtgatttatttgttttggttttttaaagtgttggaattataggtgtgagttattgtatttggttttatatatttattttgtttgtttgattgtttaatttaatttatttattttatttgtttattttatttattatttatttatttaatttatttgtttgtatgtttgttttttttttgttttttttttttttttgagatagagttttgttttgttgttgaggttggagtgtggtggtgtgattttagtttattgttgaatttttgttttttgggttttaagtgatttttttgttttaatttttggagtagttgggattataggtttgtattattgtgtttggttaattttgtatttttagtagagaagggttttattatgttggttaggtttgtattgaatttttgattttaggtgatttatttgtttaagttttttaaagtgttgggagtataggtgtgagttattgtgtttgtttttaaatgtttgtttttatttatttatttatttatttatttatttatttatttaatttatttttttgtttaatttaatttattttatttattttatttattatttatttaatttgtttgtatgtttatttaatttatttatttaatttattaatttattatttaatttatttaatttgtttatttaatttattttatttatttatttatttgtttatttatttatttatttatttgtttattttaagtatttattatgtattaagttttggttatttttttttttaggtagatggagtaattggaggtagttaataaagatggagttattttttttatttttttttaaattattgtaagaggattaagtttttatattttttgagtgttttatttttttttatagattgtgttttagtgtttagtaggaaatatagtttattttttatggtttaagagattgtagaaagggggttatttatataggttaagggaattaattaatttgaagtatagatattattaatagtaggaagagttttgaagaagtgaaaatggtgtttttggaatttagagagtgtttgtattttggataaggggttattttatagaagttgtggaggggtagggttgtaggtgaggatgaatatatagttattgatagaaaatatgtttagggtagggatagagtaggaaaaatattttagttttttttttttatttttttattttatttttgaaaggtattttttattggttagttttgattggtgttggagggtaagagagtttatgagttatgtgtggttgttagttttttggtggagagttatagataggatggagagtggttggtagggttttgtggggatgaatagtttggattggggtgattgggttttatttaggttgggttggatgtgtgtatatattttagtgatttgttttagaaatagaattaatatggtgaatagagaaagaagaaattagtgatttttgtttttttatataatttaatttggtttaagttagttaaagttatattaagttttttttttatgttttagttgttgttaggtttgtggtggttatatagttggttagattgttatttttgtttttaaggggtttaagttagaggaggagagttgagaaattaaattattatatataaagtagaaggtggaatatatttaggagtatgttaatggggtgttgtgggattttagagtaggtagattgttattaagttttaatggtaaagatgttattgggggaaagaaggattaagtttggaagatagagtaagtttggaggtaagattttgttttattagtaggggttaggtttatggtgatattttttttaggtagttatttttttgagtttattttatattttaggtttggatttaaagatatttgagttttgttttagtttttttttgaggtgttattttggtgttttttttataattattgttttagttttatgttatttggtttttagttattatattaagttttttgaagttttatatagattatgttatatttttattaaaaaattagtagtgggtttttttatttttaggataaagttttagttttttgatttgtttgttaatatttgtaattattgtttgtataaattagttgggtgttgttatgaaaggattatttgagtttaggagttttaggttgtaatgatttatgattgaattattgtattttggtttgggtgatagagtggatttaaattaaaaataaaaagatttatagttaagttttaaaggttttttttatatttttttttattattatttttttgagtttttttttttttttgaagtttttttgtatatttttattatttttgtatattttagaatggggatatttttttttttttttttttatttaatttatggtttttaaatttgagtgtgattagttatttggagatttgtgaaaatttagatgattagatttatttttagtttttgatttagtaggtttggggtggggttgaggatttgtatttttaataagtttttaggttatgttgttgttgttattgatttaggattttgggaattgtttttttaatttatagttgtttattttttatggtttatttagagtttttttgttttgtttttattatttttagttttgtttgtttgttaagtgtataggaaatttttttttatttaaattttggattaatgttttttgtttggtttatttagaggttttgtagggttggtttgatattggatagagaaatggttttttgtttttttttttttgatttttttgaagggggtttgtttttttatatttgtgggtattttttgtaaggtggagataagagattgagaaaagaaataagatatagagaaagtatagaggaataaaagtgggtttaggggattggtgtttagtaagtgaggatttgtattggtgttggtttttgagtttttttagtatttattgattattatttttattatttttgtgaggggaatgtggtggggttatagggtgaaggtgaggagagggttagtagaaaaatatatgagtaaagattttgtgttataaataagtttaaggaaaggtgttgtgtttggatgtgttagatttatgtttaattttatataaatattttagtgtagtaaagagtaatagagtagtattgttgttatgatgttttgtttttagatataaggtagttttttttttttttaaaatagaatgtatgattggttttatattgggttattttatttttagggatgagtaggagatagatgttttttttttattttaattgaatagaggttttttttttttattaattttttttagtatagattttttatgggtgttgggttggggggttgtaaggtttttttttttttatgaggttatattttaggttgttttagtggggggaaatttggataatatttaggtttttttgggtaggggtttttgtggttttttatagtgtattgtgtttttggttaatagagaatggagaatggtgatgatttttattaagtatattgtttgtaagaatttttttttttttttttttttgagatagagttttgttttgttgtttaggttggagtgtagtggtgtgattttggtttattgttatttttgttttttgggtttatgttatttttttgttttagttttttgagtagttgggattataggtgtttgttattatgtttggttaatttttttgtatttttttagtagagatggggttttattgtgtttattaggatggttttgattttttgattttatgatttgtttgttttggttttttaaaatgttgggattatatgtgtgaggtaagaattttttaaaagtgtattttgtgtagttttagatttattaaattttgatttaatataggatatgtttttgtgagtatagggttgggataaaagttatagattaatagtattttaaagtagaataattttttttagtatagattaaaatggagttttttatgtttttttttttttatatagatatagtaataatttgattttttttttttttttttatattttttatgttgtattaggttttaatttttgggaatgttattttagaattgttttatatatttttatagttatttggtttaggttttttgttgattaggatggttgtagttttgtttttggtgttttgttttttttagtttttttatttagtagttgtaggggtttatgtggtaaatttaataatttttttttttatagaaaattttttgttggttttttagtgtttaggatttagttttagtattttagtatggtttttaagtatttttatgttttggtttggttttatggtttttttgttaatttgttattttttttatgtatttttttttgattttttttttatttattttagtaaagaatttttttttggtttgagtatagtattttgtggtgtgtattttagagtatttagttaggggtgtgtaagtttattttgttattggttgatgttgtgaagttttaagttgttggtgttgtaaataaaaaattggatatgatatatataaatagtaaagtagtaaaagtttattaagtatagtatgatttattatggattaaggatgatttgtgaatggtattagtattattttgttatattttatggttttttttatgtgttttttttttttttttttttaagttgtttaagttttagttagtatgtgttttttggttgataggtgggttgtttagttttttggtttttgtgtgtttatgtgttattttttttttatagttttaagtatatgtatgatatgtattttgtaggtatgaattttaagtagttaattattatatggggttattttgaggatattttttttttgtagtatatgtgtatttttttttgtagtggtgtaattttggtttattgtaatttttttttttttggtttaagtgatttttttgttttagttttttaagtatttgagattataggtgtatgttattatgtttggttaatttttgtatttttagtagagatggggttttattatgttggttaggttgattttgaatttttgattgtaagtgatttatttattttggttttttaaagtattgggattataggtatgagttattgtatttagtttagtatatgtttattttttaggagttgtttttaattggtttggtttggatttagttagttatggggttttttatttatttatttattttttgtttttgtttatttgttttttttttttgtttttgtttttatttattttttttttaatttaatttttaattttttttgttatttttttgttttaagtttattaggttggttgtaagggttttgagggagaggttgtgtattgtttttgtatattttaggtttagtaaatgtttgttgattaatgattggtattttttttaggttttgttatttttgtgggtttaggtttttattggtttaggtttttgttttttttggtaaggttataatgaattggggagttttttttaggtatttgtttttggtgttgtaattgggtaagtttttagatttggggttttaatgtagatgatgtgggaggaaaggtaaaggtggaggatggggtagagggggatagtggtgatattgagatttgattttttttttttttatttagtgttttttttagtagttatttagggaaagaaagtggtgttgggtaaaaaaggggatatagtggaattgatttgtatagttttttagaagaagagtatataattttattggaaaaattttaattagataaagattttgggaaattagggtttttttttaattaaaggtagggttgtttggttttttatttagggaggaaaatatattatggagtgaaagtttttggtgtttgagatttggttttagttaaattttgggattttagagggtttgggttgatagaaatttagtggtatttttatttagagtttttttatattaattgttggtggtttagggaaaggtggtatgtgaattttaatattttaatatttaatatttatgaatttattttagtgagttttagaataattattattatttaaaatttgtgattttttgagtattgttgttatagatttatgtagataatattttgtatagtgatttatatgtataattttagtattgtgggaggttgaggttggaggattgtttgagtttaggagtttaagattagtttgaataatatagtgagattttgtttttatgaaaaaaaatatatatatattttttttggagataaggtttagttttattatttaggttttagtgtagtggtgtgattttggtttattgtaatttttattttttaggtttaagttattattttattttagttttttaagtagttgggattataggtatgtattattatgttaggttaatttttgtattttttatagagatagggttttattatgttggttaggttggttttgaatttatgagtttaagtgatttatttattttggttttttagagtgttggaattataggtgtgtgttattatgtttagttaaaaaaaatttttttaattaaaaaaaaaaaggttggttgtagtggtttatatttgtaatttagaattttgggagtttgaggtgggtagattattggnggttaggagtttaagattagtttggttaatatggtgaaatttggtttttattaaaaatataaaaattagttaggtgtgggggtgtagttttgtatttttagttatttaggaggttgaggtaggagatttgtttgaatttgggaggtaaaggttgtagtgagttgagattgtattattgtattttagtttgggtgatagagtaagattttattttaaaaaaaaaaaaaaagttgtanatttattattattattattagtttatttatttatttttttgagatagagttttgttttgttgtttaggttggagtgtggtggtgtgattttggtttattgtaatttttattttttgggtttaagtgatttttttgttttagttttttgagtagttgggattataggtgtatgttattatgtttggttaattttttgtatttttagtagagatagagttttatggtgttagttaggttggttttgattttttgattttgtgatttattttttttggttttttaaagtgttgggattataggtgtgagttattgtgtttggtttagaattatttttttttatttttttttttttgaggtaaatttttgatttgttgtttaggttggagtgtagtgggtatgattttggtttattgtaagttttgttttttaggtttaagtaatttttttgttttagttttttgagtagttgggattataggtgtgtgttattatgtttggttaatttgtgtatttttagtagagattggtttttattatattggttaggttggttttgaatttttgattttaagtgatttttttattttagttttttaaagtgttgggattataggtatgagttattgtatttggtttttttttttggttttaaaattattatatgtttattataaaatatttggttaatgaagaaaagaatatggaagaaaattaaatgtatgtatatttttattatttagagatattttttgttaatattttgattgatttttttttaatttttttttttttttttttttttgagatagggttttattttgttgtttaggttggagtatagtggtatgattataatatattatagttttaagtgatttttttattttagtttttttagtagttgggattataggtgtatgttattatgtttatttaattttttattttttgtagagatgagattttattatgttgtttaggttggttttgaatttttaggtttaagtgatttttttgttttggttttttaaagtgttgggattataggtatgagttattgtatgtggtttatttttttttattgttgtttggtgtggagaatattatatatataattatgtaaatgatattatattgtatatatttttttttttattttttttttaagttatattataatgagattattaattattagatttttttttttttttttgagatggagttttggtttgttatttaggttggagtgtaatggtgtgattttagtttgttgtaatttttgttttttaggtttaagtaattttgttttagttttttgagtagttgggattatagatatgtgttattatgtttagttaatttttttatttttttattagagatagggttttattatgttagtaggatggttttaattttttgattttgtgattagtttggtttggttttttaaagtgttgggagtataggtgtgagttattgtatttggtttagattaattatttaaagtaatttggtaatgtttaatgaatataaaattttaaaatttttggatttaataatagttattttggaaagtttatttgatagaaataaaattgtgaatatttttttttgttgtttttttgagatagagttttatttggatgtttaggttggagtgtagtggtatgattttggttaattgtaatttttattttttgggtttaagtgatttttttgttttagttttttgagtagttgggattataggtgtgtattattatgtttggttaatttttgtatttttagtagatggggttttattatgttgattagggtggtttggaatttttatttttaagtgatttatttattttggttttttaaagtgttgggattataggtgtgagttattatgtttgattagtgaatatttaataatatttatggaaaggtgttattataagaattgtttgtggggttgggtgtggtggtttatgtttgtaattttagtattttgggaggttgtggtaggtggattatgaggttaggagattaagattattttggttaatatggtgaaattttgtttttattaaaaatattaaaaaattagttaggtgtggtggtgggtatttgtaattttagttatttaggaggttgaggtaggagaattgtgtgaatttaggaggtggaggttgtagtgagttgagattgtgttattgtattttagtttgagtgatagagtgagattttattataaaaaataaataaataaataaataaaatataaataagtaaataaaggttaggagtggtggtttatgtttgtaattttagtattttgggaggttgaggtggatagattatgaggttatgagattaagattattttggttaatatagtgaaattttgtttttattaaaaatataaaaagttatttaggtgtggtggtatatatttatagttttagttatttgggaggttgaggtaggagaattatttgaatttaggaggtagaggttgtagtgagttgagattgtgttattatattttagtttaggtgatagagtaagattttgttttaaaataaataaataaataaataaataaataaataaataaataaaataaaaagtatatatatatatatatatatatatatataatgtaaaagatttattttattataattaatattatatttaatggtgaaaaattgaattttttttttttaagtgtaggaataagataaagatgtttgtttttattatttttatttaatataatattgtaattttttgttagtgtaataaggtaagaaaaatgaaataaaaggaaaattgattagaaagaaagaaataaaattgtttttatttgtggatgatatgattatatagaaaattttaaagaatttgtaagaaattttttagaattaataaatgaatttattaaggttgtagaatataagataaatataaaaaatttattgtatttttatatattagtaaggaatatgtgtatatagaaattaaaattataatattatttataattgtttaaaaaggttaggtatggtggtttatatttgtaatttttgtattttgggaggttaaggtgggaagattgtttaagtttaggagtttaagattagtttgggtaatatagtgagattttgtttttataaaaagtaaaaaattagttgagtatggttgggtgtagtggtttatttttgtaattttaatattttgggaggttgaggtgggtggattatgaggttaggagattgagattattttggttaatatggtgaaattttgtttttattaaaaatataaaaaattagttggatgtggtggtaggtgtttgtagatttagttatttgggaagttgaggtaggagaatggtgtgaatttgggaggtggagtttgtagtgagttgagattgtgttattgtattttagtttgggtgatatagtgagattatgttttaaaaaaaaaaaaaaaaaaattagttgagtattatggtgtatgtttgtagttttagttattggggaggttgaggtgggaggattgtttgagttttaggagggtaaggttgtagtgagttatgattatattattgttttttagttttggtaggagagtaagattttattttaaaaaaaaaaaaaaaaaaaaaagaaaagaaaagaaaagaaaagaaaaagaaagagagaaagaaatatttaggtgtaaatttaaaaaatatgtgtagggttaggtgtagtggtttatgtttgtaattttagtattttgggaagttgaggttggtggattatttgaagttgggagtttgagattagtttggttaatatggtgaaattttgtttttattaaaaatgtaaaaattaggtaggtgttgtggtgtatgtttgattttagttattttggaggttgaggtaggagaattgttttaatttgggaggtagaggttgtagtgagttaagattgttttattgtattttagtttgggtaatagagtaagagtttgttttttgaaaaaaaaaaaaagaaaaaagaaagtattgaattgtatgttaaaaattatatgatgttgattaaagaagttaaagaagatttaaatatatggagagatatgttgtatttatggattgatggattggaagatttaatataagatagatattaattttttttaaattaatatataagtttaatttaatttttataaaaatattagtaagattttttgtagatataaataagttggttaggtgtagtggtttatatttgtaattttagtattttgggaggttgaggtgggaagattgtttgagtttaggtgtttatgattgtagtgagttatgattgtgttattgtattttagttggtattttagtttaagtgataaagggagattttgttttaaaaataaaaataaaattaaaataattttgttttgtaaaatttttattaagaagaagaaaagaggttgggtatagtggtttattgttgtaattttagtatgttgggaggttgaggtaggttgattattttagtttagaagtttgagattagtttgggtaatatgaggaaattttgtttttattaaaaaaaaaaaaaggtatatatatatatatatatatatatatatatatatataagtatatatatatatatatatatatataggtgaatagatgtatatatatttatttattgtgaatatatatttatatatatatgtgtgtgtatatatatatttaaaatttatttttatttatttatttatttttgagatagagttttgttttgttatttaggttgggtgtatttgtatttttaatgatataggaggttgaggtgggagaattattgagttagggaggtagaggttgtagtgagttaagatgttgtttggttgtttgggtaatagagtgagattttatattaaaaaagaagaataataagaaaagatagtttatagaatataagaaaatatatttataatttatatatttagtaaaggattggtatttagaatatgataaataatttttaaaatttaaaattaaaaaaatgaataatttaattagaaaataggttgaaaaggatatatagttggtaaataagtatatgaaaagttgtttaatattattaattattagggatatgtatattaaaattataataggttattattaaatttattagaatggttaaatataaaattggaatattattaaatgttgatgaggatgtggagaaattgggttatttttttaatattggtgggaggttaaaatggtaaagttattttggaaaatagtttgatagttttttataaaataaaatatgtggttgggtgtggtagtttatgtttgtaattttagtattttgggaggttgaggtgggtggattatgaggttaggagattgagattattttggttaatatggtgaaattttgtttttattaaaaatataaaaaattagttgggtgtggtggtgggtgtttgtagttttagttatttgggaggttgaggtaggagaatggtgtgaatttgggaggtggagtttgtagtgagttgagattgtgttattgtattttaatttgggagatggagggagattttgttttaaaaaaataaaaataaataaataaaaaatatgtaataatttagtaatattgtatttttaggtatttattttagagtaatgaagatttatgtttatataaaaagttgtatataaatgtttatagtagttttatttatggtagttaataattagaaataatttagatgttttttaattggtgaatgattatatttatattatgaaatattttttagtaataaaaaggatgaattatagtatatattataatttggatgaatttttagggaattatgttgagtgaaaaaaagttaattttaaaaggtaatatattgtattaatttatttatataatatttttaaaataattaattatagaaatggagaatagatgagtgattgttaggggttaaggggtttagggatggggaggggaaggggtatggttataaaaagtaataattttatggtgttggaaatgttttgtattttgattgtgttaatgtgagtatattggttgagatatagtgttatagttttgtaagttattattattagagtaaattggatagagggtatataggatttttttgtattattttttataattgtaagtgaatttataattattttaaaataataagtttagtttaatgttaggtgtggtggtttatatttgtaattttagttttttgggaggttgagatgggtggatggtttgagtttaggagtttgagattagtttggttaatatggtaaaattggtttttattaaaaatataaaaattagttgggtgtggtggtaagtgtttgtagttttagttatttgggaggttgaggtaggagaattgtttgaatttgggaggtggaggttgtagtgagttgagattatgttattatattgtagtttgggtgatagagtgaggtttttttttaaaaaaaaaaaaaaaaaaaaaaaagtaggtaggtagggttaggaaagtgtataatttttgtagtttaaatgattaatttaaaaagtgaagattggttaggtgtagtggtttatgtttgtaattttagtattttgggaggttaaggtgggtggattatgaggttaggagattgagttattttggttaatatagtgaaattttgtttttattaaaatataaaaaattagttgggtgtggtggtatttgtttgtagttgtagttatttgggaggttgaggtaggagaattatttgaatttaggaggtgaagttgtagtgagttgagattatattattgtattttagtttgggtgataaagtgagattttgttttaaaaaaaaaaaaaaaaaaaaaaaaaaaaaaaagtgaagtttatttttttttttaaatttttttttttttttttttttattttgtgagataatttttttttttttaaaaagttaagagtttatttttgtaagtaaagattattttaagataatttagaaatgtatattattagtattttttattttattgtaagttatttgtaaatattggttttggtgttaatttagaattttattaaattaattgttttttaatatatggttattattattttgtttaatattgtattttattaataatgttgtaagtattatttttgtagttaaattatggtttgtattttaaaattattgttttaaggataaagttttagaaatgaaattaaggatatgaattttttgagtatattttgttagtattgagtagtattatttaaaatttttggggggggtaattttataattgaaaaatatattattgttttaatttgtattttttttattgtttatgagattaaaataatgtattattttttaaaaatttttaagttttttgtgttgatgtttttgttttgtttttatggattttatttttttttagaatagtttttttttttaattttttgatttttaataataatagtattattttttttgtttttttaatttttgaaatatagagttatgtttttttttttgttttaatttttggttttttattgttattaattatgatttttttttgttttgaaagtgttttgggttgggtatgatgtttgttatttattgtaattttagtattttgggaggttgaggtggttggatgatttgatttgaggattttgagattagtttgggtaatagggtgaaattttgtttttataaaaaatataaaagttagttgggagtggtggtatatgtttgtagttttagttatttggggggttgaggtggtaggattttttgagtttatgaggtagatgttgtagtgagttgtgattgtgttattgtattttagtttaggtgatagagtgagattttgttttaaaaaaaaaaaaatgttttagttttttttttttttttgtttttatgggaatgttattattattagttaaggtttatatattttttatttggattatagtgagtttttaggtaatttggtttgttattagttttgtttatttggattttttttttttttgttgtagtattgttttttaaagttatgttttgtatatgttatattttagtttattagattaagtttagaagtttttgtaggatgtttatttttttagtgttattgtttagttttttagtggaaatttttgtatttaggaggtttttttatagtttgtttgtgttgtttttttggagtttttttttttttttgtaatgtttttgttgttttttgtttttagtttattgtttatatttttttttttttttttttttgagatggagttttttttttttatttaggttggagtgtagtggtgtgattttggtttattgtaatttttgttttttgggtttaagggatttttttgttttagttttttgagtaattgggattataggtgtgtattattatttttggttaatttttgtatttttagtaaagattgggttttattatgttggttaggttggttttgaatttttgtttttaggtgatttatttgttttggttttttagagtgttgggattataggtgtgagttattgtatttgttataggtttatattttttttaagtttttatttaatattagttgttttatgaatttgttttagatttatttatatgtttagattttttatattattttgttatagtttttttaaagtatgggatagtatggataagtaggttatggtttttttttgaagagaagtaaggaggtagagttattttaggaggagggttatatattttattttgaattaattgtgtttggggtgatggtaggatattaatataaatttattttttggattattggaaatgtgtgtttagaattgaggagagaggttagggttggtagtaataatttggttataatttgtagagttgattggggatgaggtggaatttagaatgtttgtagaaatggggaagagaattaaagatagagtttgggataatatttaaatgtagatgttagagtaagagtttaagatgaagaaaaatgaattatatttagaaatggaggggaggaataaaagaggtggagtaaagtggggtagaattagagtaggttatgtttttaagaagtttggtaaaggaattgtgaaaggaatgtagttgaattttagggtaagttggggaattaaagtagtgtgtagatttagggtaaatagtaagtagggtaggaattattgaaggaataaataaagggggaggttgggtttaggttgttttgagtagggaagtttttttaaaaagtgtgaaattgaaggtgtggggtggattgggtgtttgttgtgttttgaggaagtttggggtaattgtgtgttgaggttgtgaggttgtttggaaggggtttttggatagtaagagttgagtagtggggaagaggattgtgtggtttggaagaggagagaaaggagagtgagtgattgaattggtatttaggtttttatattaaggtagaaagagggagaggatttgggtattttagggaggtagaggtagtattaagtagggtgagaggttttagttttagttatttttgttttatttttttaaatatatattttaagtaaaaataaaataaaatagaattgtttgttatgtaaatttagtttttaaagttttgttttatagagattttggagtttttattgtatttagaaaatgtatagttaaagagaaaattttttttggtgatggttattagattttataagaagaggttaaaggagatatatatttatgttagaagaattttttagagatagtattgtatagtgaaatagtttgaattatttttattttttaaaatatttttttttttttttttttttttttttttttttttttttttttttttttgagatagagttttattttgttatttaggttggagtgtagtggtgtgattttggtttattgtaatttttattttttgggtttaagttattttttttttttagttttttaagtagttgggattataggtatgtgttattatgttttggttaattttttttttttttttttttttggtatttttagtagagatggggttttattatgttggttaggttggttttgaatttttgattttaagtgatttattgttttggttttttaaagtgttgggattttaggtgtgagttattgtatttggttaaaaattttttttttttaagatgaggttttattttgttgtttaggttggagtgtagtgttataattatagtttattgtaattttgaatttttgggtttaagtgatttttttgttttagttttttaagtagttgggattataggtatgtgttattatatttagttaattttttttaaaataattttttttagagatgagggttttgattggttgtttaggttggttttagatttttgatgggttgtattttaattttagttttattatttatgggagttaaaatttaaaagatagaaaagggtatataggttgggtgtagtggtttatatttgtaattttagtaatttgggaggttgaggtgggtgggttgtttgaggttaggagtttgagattagtttgggtaatatggtaaaatttgtatttattaaaaatataaaaattagttagatgtggtggtgtatatttgtaattttagttattttgaaggttgaggtaagagaattttttgaatttaggaggtagaggttataatgagtagagattgaatatttgattttataaaaataaataaataaaaaaagaaagtaggttgggtgtggtggtttatgtttgtaattttagtattttgggaggttaaggtgagtggattatttgaggttgggtatttgagattagtttgattaataaggagaaattttgtttttattgaaaatataaaattagttgggtttggttgtgtatgtttgtaattttagttatttgggaggtagaggtaagataattgtttgaatttgggaggtggaggttgtggtgagttaagattatgttattgtattttaatttgggtaataatagtgaaattttattttaaaaaaaaaaaagtaaagggtatatagtgaaaagttttttttttatatatgagtatttattttttttttttagaggtaattaaggttatttttgtgtgtgtgtgtgtgtgtgtgtgtgtgtgtgtgtgttttgggatagttttatttttttattaaggttggaatgtagtggtgtgattttattgtaaattttgttttttagttttaagtgattttgtgttttagttttttagttttttttttttttaaatggggttttattttgttgtttagggtggagtgtagtggtatgattatagtttattgtagttttgattttttgggttaggttatttttttattttagtttttggtatagttggggttattggtatgtattattatatttagttaatttttttttttttttgagatagagttttattttgttatttagattggagtgtagtggtgttattttatttgttttattgtaatttttgatttttgggtttaagtgatttttttattttagttttttaaggtggttaattaaaaaaaatttttttttttttttttttagagatggggttttgttatgttgtttaggttgattttgaatttttgggtataaataatttttttattttgattttttaaagagttgggatgagagatttttattatgtttggttttatttttttttttaatttttttttagatattatagttttttttaatggttttatttttttatgtttaatttgagaattattttttttatatataaagaatatattttttttatttttaaaaataaatagtagattgtttaatattttgttttatttagttagtgatgttttttagatatgggtttaaattagtatataaagtatttttttattttttttttatggttgtatagtagtttattgaatgggtgagttatgatttatttaatttattttttattgatggatatttggttttgtatatatatttgtaattttgtatagattataaattattatttaaagaaattgtattggtttatttttttataatgtgtgagagttgggtaattatttaattttaatatgtgagagtttaggtagttatttaatttttttgagttttagtttttttatttgtaaaataaataaaatagtgttgatagtatttattttttggaattattgtggagattattgagatgatgtttgtaaagtatttggtatgtaggagttggtgttttttaaataaggatatgattttatttgtatttgtgagttattgttttagttaggtaaatggatatgatgagatttttttgttagattgggtttttttgattagaatgaggagtagatgttgtaggaaattagtaattgatattagaagagttgtgggtatttttttgttagaggtgttttgtttttagggtgttttagtttttttttatatgttttttgtttttaggtttatttaagttgaatgattgtgttgatttaagaagaagtttttgggattaaggaaatttttttttgattattaagaattttaagatagaagatttagatatttatatttgtgaagtggaggattagaaggaggaggtgtaattgttagtgtttggatgtgagtggggtaggtggggatgaggatattttttgtttggtttttttttttattatttttatttttgtattaaatttagtttgagttggtgatattgtagtagttttaagaggattaggttgttaaattggtttttaaatgttttaaaattttttttgattaggtgagggatgttggtgggtggaggagggaagaggttttgggaaaaggaaagaaaagggaaggaggtaagggaaggagggagagagattggggaagagaggatgaggggagaggaggaaagaagagagagaggaggggagagggaaattttattttggttgggggtgtgtagttgggtgttgggaggaaggagatgttgggatggtgataatggagagatgttgttggttttttgttgtttgtttttttttttggggatggtatgtgtgtgatatagttggtttttttttttatagtgattgttaattttgatatttatttgttttaggggtagagtttgattttgattttggagagtttttttggtagtagttttttagtgtaatgtaggagtttaaggggtaaaaatatatagggggggaagattttttttgtgttttagttggagttttaggatagtggtatttggatatgtattgttttgtagaattagaagaaggtggagtttaaaatagatattgtggtgttaggtaagggaagtttttttttgtgtagttttttttttgttttaggggttgatagtttttttttttgttttgattgttttgtttttggttttggtgttgggaggttaggagtggagaagattaggttttttagagttgaggtttgttttgaaggatttattggggtttttatttttagggggttgattggtagttattttttagtgtggtggatatggagaaaggaaaggttggggaaggtaaggatgttagaggtttgagttttttttggaggttttaaaggaggaatgttagggagtttattttttttgttgttttagttttatatttttattaagttggtaaatttatttatttagggatattaatattagtaagttaattttgatgatgttttatgttgtatttttggatttttaagttaggttattgtggggagattaaggttttattttagattttgttttttgggtgtttatgtgatttaaggtagatataaggtagtgtgttagtttagtgtatgtatgttgattgaaattttggttttgttataattatgtgattttgggtgagttattaaatttttttgtattttggttttagtttttgtgaaatggggatgatgttaattgttatagtgattattttgtattaagttgaggattgatatatgtaaggtattgaaaatggtgtttggtatagagtaagttttagttaagtgtttgttgttattttgtgaagggtgatgaatatgtttttaaggagtggaggttaaatggtttttgtggtttaggaattttaaggatagtaaggattttttgtggttgggttgttttgtgatggtttttgggaggagggaggtggtttgttgtaggaaaatgttgggtggaagaagggagagaaggttggagaggtaggaaggaattgaagtatttgaagtgataaggtgggtgtttggatttgttgggtttttttttatttttttgttgtttttatatgttaattttatttgtgtatttttatttttttatttttttatttagggtttttttttttttatttttagttttttagaaggtttttagtatagtttataagaaagagggggaataggtggagtttttttttttatttgtttttatagttgaaaagttgatgggtagtggtgagttgtggtggtaggtggagagggtttttttttttaagttttggattatttttgatttgaagaataaggaagtgtttgtaaaatgggttatttaggattttaagttttagatgggtaagaagtttttgttttattttattttgttttaggttttgttttagtatgttggttttggaaattttattttggtttttgaagtgaaaataggaaagttgtattaggaagtgaatttggtggtgatgagaggtgaggggttaggttagggaggggtgggtaggggaaggagttggaggggtttggtttagggttttttttgaggtaagttaggttttaagaggggatgtttaggttttggttatttggatgaagtgagggagggttttttgggtttggggttggttttgaattgagatatttatgagttagtttggggttggttttattgaagatttttaaagtatttgggttaagaattagggttttagttttttttataattaattttttgtgattttggttaagtttttttttattgtaggtttgttttttgatttgtttaataaggataatgaaatttgttttttgtgtgatagtaatgatgataatgttaagttttaaattgagtttttggtttttttatttttttattattataatgattttgtaaatagtaatggttaatatttgatgtttagtatgtgttgggttttatttaaatattttatatgtatgtttgtttttagtattatttgggtgtaggttgttaagttatttgtttagagatatatagttgttaagtagtggagttgggatttaaatttaatattattggattttaaatgttgtttttttttgtaggattgtatgaaaatttgttttaaaaggttaaaagaaggttatttatatagagtattattttaattgttttattgaattttaggtttttgattttagttttttgtttttttgtagttatttagttttagaaaaatttgatttgtgaggtgtggggatttattttttttaagttgatgttgagtttgaaattggagaataaggaggtaaaggttttgaagtgggagaaggtggtgtgggtgttgaattttgaggtggggatgtggtagtgtttgttgagtgatttgggataggttttgttggaatttaatattaagggtaaggatttaggttttaaggtttttgttttttgggttgtgggatttttttgtggttggtagagattatttagagttttggttttttaatgtttgagttggggggttatgggtatggtgttttttgtggttttagggtgttttggaggttttaaaaggaggtatagaagtgatgaagtgaggtgggttgtggttttgggttttaggttgttagttgtaattttataagtttttatttttttaggtttatagtttagggatggggtttatttgattgagagtttttttttttggtttttggtttttttttaaatttagatgtatttatatatatatttatatatatatatttttatatatatgtatatatttttatatatttttatatatgtatatatattatttatatatttgtatatatttatatatatattatatatatatttatatttatatttatatttttattttatgtatttatatttatgtatttatatattgttatatatttatatatatatatgtatttatatatgtatgtatatatatatttatatatttatgtatatatttttatttatatattgttgtatatgtatatttatatatttatatatttatatttgtatatgtattatttatatatgtgtatatatgtgtgtgtatatgtatgtagttatgtatatatatttatatatgtatataggtatatatttatatatatgtatatatgtatatatatttatatatggatttatatgtgtatatgtgtgtatatatatatatttatattatttatatatgtatatatatgtatatatttatatatgtatatatatatgtatttatatatatagtttaggagttagattatagtttttttttttttagagtgttttggatatggatatgtttaaatataaaattgattttttagtattggtggtttttgagagtttttaggtatttttttttttttttttaattttagggttaaattagagattggttaggagggattgtagggtagtttttagttttttggtttgtggaggagggtggtgtattgagtatattttttttttttgtagttttgtttatatggtttattttggtgtagttaatggttttgattgtgttggggggtgttgttggttttttgttttttattgggttaggtatttttttttgtgttaggtgttggtattgaagggtgagtaattttatatttggtttttataaggtttttaaatttttgagttttttattaggagattttgtatatgggaattgattttggtttagttttttttgtttatttgtaagtttttttgttgttttgttttagattttatttaagggagagataggaaggagtagagagttaattttaggatagatggtttgggttatgtaattgttttttttgttgtagttttttttattttttttattaaggggtattttttttttggaggtttgggatttttgtgatttttttttttgtttttggatagtgttaagtagagtggatgttttagattaagagattttttagtgagaagaagatttgttagtgtttttagtaaggatttgggaggaggggttgagagaggggaaagggggagggggagggagttagagaggagggggaggaaggggagtaaaggggggtaggaagggaggatggagaggaggaaggagttgaggaggaagagttgggaggggtggaggtgaggagatgggggttaaaggggtgtggtggagaggatagaggggtgggaaaagatggttaggagttagaaggaggtagaagtgggaggatggagttgaaggagtagtaggttaggaaaggttttgttggaaagttattggagttgtgttgtgttggaaaggttattggaggtgttagaatgtaaaggggttgtagtggggatagatttgtttttttttttttttgtttttgtagttggttttagaagatatgtagttttatttgaggtatgaggttaggtagattttatttgtagtttttttaggtgtttgttttgtgttttttgtttgtggattagatgaatgtagtagatttttagtttttggttttttgtttgttttttttataatttgttattgttttttttgggttaggttttggttttattggttgagtgttgttttttagtttttagaggtttaattatattgttttttatgttattttttttttttttaagtttagttttttttttattatttttttttgattttttttttattgtttatttggattttaggggagtgtttagggttagttttggttggtatggagggtgaggttgggtgtttggaagtatggagtatgggattgtttttttataagataggattttgggattatagagggtaggaatttgtataaaattatatagttaagttagttaaggatggatgtagatttagaggtttttggtagttagtattttttgttttatgttgtttgttttttattttatgtgggtgggattatagatttatattttgattttgtataaatagtttttttggatatagttttatgtatatggttttaagggatgttttatattttttgtttatttgagatttagaaaaattttataaggttggtagtgatagaattaagatgattatttttagtttatagattagaattagagtttagagaggttagatgattgattattaagtgttggattagtaagtgttggagttgggattaatttaggttttttgttttaagttttattgttgttttttgaatgtagggataaatgttatatggtttttattagtggttagtggtgggtatttaatgtgtatttttgggtttatagaagtatagtatttatgggaagggtttattttagagaatttatgagtagggatgaaggtttttttgtttaaaattttttttttattttttgttggtggtagaatttgttattagaggataaagtttttggtttttttaattagagtgtaagttgggagtataggtattgtaggagagaatgtttagtgattagttattgattttgtgtagaattttttggaagtgagttttgttgggagagggggtagttagtttgagagggaattttttaagggattttaaaggtgattgtgttaggttttgtgtttgttttatatttttttttatttttttttagattatttaggatatagggaaattagggttataaatttttttgatttattttttttaggattttttttttttttatttttttttattattttttttagttttaattttttttttttatttttttttttttttgtttttaaagtttgttttttttaggaagatttttttattgttgttggggttttttatttgtttattttgtatttgtgtttattttttatttttgtttttttgagttgaaataaaaatataataaatttattataaagatgttttttgtgtgtgtgtgtgtgtgtgtgtgtgtgtgtgtgtgtgtgtgagagagagagagagagagagattttttttttggggattaggaattttttggtttttggggttggatttagaggagaggttgttgggtgtgttttaggaaggagatgaagtttttttggagagggaaaaattttgtggaggttgg

SEQ ID NO: 68 - DNA, 242981 bp, Homo sapiens
gttttagaaatgatagcgaaaagttaattttttatattttatttataatgtaaaatattagtttaaatttgtagaaagtatattttttgaataaaagatagtagatgttgtagtatttttgttaaagaaagagtttagtataaatattttgtagtatgtaaatgttattttttttatgtgaatatttttttcgagtggatgttgtagggttggaggtttttgtttatgatttaggttgtaattttatttgtggaaataaattaatcgtggagttttaattgttttggtggtgaggtgattaatagtttattattggatagaatagcgattataggaagagtattgaagattttaatgtatgaattatgtatgtagcgtttattttttagttttcgaatagaatgatagggtttgtgaagtcgttttagatagttttttgtattaagtgattgtagtgaaatgtttaatatttttaggtatagaagtagtattgattcgggttagtcgaatttggaagatgtaaattttttagtttatagtacggaatgttttatttgaaagtattgttatgtagatagtcggtttttttgttatttaatttgttttttttaggttggttgaaggatgggagcggttgtgtttgtttgtgaggttatagtatgaagtttttttaatttgttttttgttgtaggagagaggcgtattgtggtataattgttgttgtatttatttaaatggataatttgtaatagatattatatttaggacgatagataagttaatatataaggtaagtttaaggttttttttataggttaggtaattgtaaattagaatatgttgagttaggataatggtgatgcgatattaataaggttgatttagattttagtattgtaatgttagtattaggatttttaattgttacgttaaacgagaggtgattttttatatttgatagtattggattatagggtattttattttgtatgtaaaagttttttaagaatgtattagagttcgaatgtgtagaagattgtaaattggggaggggtagtagtagaatgagttgaattaataagtggaaattatttttttgtggggaagttttagtacggttgtggtatcgcgttggtttagattatttttttaatgttaatatttttaaattttagtaaaagatgtgggtagatattagaaatgtttaattttttttttagaagtagaggaaagtatcgaggtatttaaatttaaatattgtgttgtatataaattgagtagatggaattaaaataatttggattagtatgtttttgagggaagattttgttgttaaataaattatttgatttttatttgtgttggtttggttttgttttttttttttgttaagaatgttttattttaaaatgtatggatagatgacgtgttgtgatatttatttaaaaaagagttttattttttgtttttttaaaaattatttttatataattataggatttattatataagatttaaataaaatttataaaaattttgtaaaattgaaaaatatagtattatacgagtatatttgttagaagttattgttaattaaagttttttgtttaaatattatggtaaatgattaatttttgaatatttttttaggatgagaaaatagaattaataaatataaagtaagagatattagataagtaaaattttttaaggttattttttaatttatattattagtgaatatatattattagtgaatatatatattagtgaatttatattattagtgaatatatatgtatatatatatatatatattataatttatagtttataaaatataatatatgtattataatatataggtatatttatttttttatgtatgtttattaatattgtttttaaaagtgtgtttgttaaattatttattaagattaagaatagataaggataagtatgttttgggaaaaaaaagtattattttattttttttaaaaagaaagaaatttagagtaatgatgataataagagtatagtataaaatgttatattttatgtattttaattttgttataatgttgttatattatttggattttttgttgtttaggtgttgtgtatagaatttttagtattatagaatggtttaaatttttaaagttgatttagtttaggtataagaggaaatttatatttgaagtttttttttagggaggggaaaaaaggaaggagatattattatttatatattttagaagttttttgatgttgagttatggtgtttagttttgttgaaatgttttttggttgaggtggttgattaatagttaataaaatggaatttagaggaaaatgagaaagaatggaggggggtagaaatttaaagatatttattgtttaatgatatatattaaattttgagtaataagtagaatggtagtgttatttgttggatttggttgagttgatagtaggagaataaaagttttcgtgttgggtgataagattatagtagtagaattaatggtttaataaggggagagtgtataaataaagggatttaagaagtattgtttttgtatttatttaaatttttttgttttttttttagttttaatttaagttattagttaattttatttaaaagatataatgtttagataaagaatagtttttagattacgtaaggaaaatttagaataagatgtgtttagtttttgttttttacggtggttataattaatttttataggttattaattgggaggaattaataaaaaattgatgagaatttttaaatattttgtttggtatatatgaggtattaaaatgagtttagatagtgattattatggtaatatataatcgtattagatataattggaaatggagattgaatatattataaaaatatatattaaaaaggaaatagggtaaatggaatgagagagtagtgaaatattaaatataagattttgaaagaaaaatgtatttaaattgtagttgatatatattattagtgatttaaaattaatgtataaaaaattttgaagtaataggtttattaatataagggtttataatttttttaaaaataaattttaagggtgatttagagtgagaaataattgataataatattttaaagtagaaaggtgtaatatttttttatagggaataaatattgatagagttaaaatatatttgtatttatgttgtaataaattgaagtagaaatttttttatatatattgagagagagggagaaagtatagtgtatatatatatatatatatatatatatatatatatatatatatattttttatttgtttatttaattatttagttttttatttagtaattattataagtgatttgtaattattataattttaagtggtagttatatatatatatatatatatatatatatatatatatatatatatatatatatatatattatatatgaaatatatatattataagttaatatatagtatagtatatatatttatagtatatatattataaatatatataatatagtatatatattatatatatattatatatattatatatatatagtatattatatatattgtaaatatttatagtatatatattataaatatatattgtaaatgtatagtatatatatttatttatagtatatatatttatatatataattaaatgtatatattatatttatttaggattgtggtagttatagattatttatggatgattaggaggtttataagtatttgaaaagaggtaatatatttatttttaataaagtaagttaatatgaaaattgaggaaattagagtttatgtttagataataagaaaattttttatagggtattttagtaaatagttttgatgagttgtaagttttgtgaaatttatagaaaatttttgtaagtatgaatttataataaagagtgattgttgggagatattattttttttttttttttattcgagaaaaatgattaaattggtttttttttaaaatgttttttttgagtaattaatatatgaaatattttttttttagatatgtttttaagggttgattttgaggagtgttttagtttaatatagttttatggatgttttattaatttatttttttttattgtaaatatattttttattttatttttattgtttattaatttttttttttttataagataatttagtgtaataaggaagtatttattgagaatttttttgtttggttttgttaggtattttggttttgtagatgtaaaagatgaagggtttgtgtttttaatgggaataaataagttaaatgtagggggaaaaagataaaatataggagtatttaaaaatatttggtaaaacgttttattgttataggagaaatgaggaattatgtataatattttttaaatggtatttggaggaagaatatgtataaaagtatggaggttaaaattaatagtatatattttaatgttggtattgaaatagagggattggatgggtggtgtagttgagaataaataaggtggggtaggttattaggaatttagttattagaataatatgtttagatttgatttaataggtagtgaatatttatagatattgtttaattttattggaggtatttaatgataaagaagtatttgatttttgaattagataaatttttagtatttttttttaatggttgttaattttaaattaaatagttatgtattatataaatattttttgattgtatatttgatagtggttttatgagattataatggagtagaaaattttttgttgcgtagtgatatggtagtttttgtaatgatatagagtaatatattattttttttttatgtttagatatataaatatttattattgtgttatatttgtttatagtatttagtacggtaatatgttgtttatgtttgtagtcgaggaataataggttatgttatatagtttacgtatgaagtaggttagattatttaggtttgcgttaagtatatttcgtgatgtttttatagttaaaattatttaattgtttattttttagaatgtatttttatagttaagtgatgtataattgtattgtattaattatgttttttattttttgaattttgatattttagttttgtagattttggaaggattattttttttaggtgttagttgattattggagttagtatataatttgtttttgagtatattttttaaatgtaaattaattaatttagagttttattattataattattttttttatttgggtttttatattttgggttattatttatttggttaattatttcggggatatatattagataagtgataaatgaaattttttaaattagttaattttaagtatttatttgtttttgttcgttttggtgaaaattatatagttttttttttttttttttgttttttgattagttttagtttttttttatgttgttttttgtggtgtgttgtgttttttgttttggtgatttgtgggtttaataagttattttttttttttgagatggagttttattttgtcgtttaggttggagtttagtggcgtagtttcggtttacggtaattttttggagtgtaatggtgtaatttcggtttattgtaatttttattttttaagtttaagcgatttttttgtttcggtttttcgagtagttgggattataggtatgtgtttttatatttggttaatttttgtattttttagtagagatagggttttattatgttggttaggttggttttgaatttttggttttagatgatttgtttattttagttttttaaagtgttgagattataggcgtgaggtattgtatttggttaataagttgtttttttaatgatagttgtttttagatttgttgtttttaataaatttaaataataaaatttatattaaaataaatatttaaaaattttttaaattttaatataaattaatataaatagaaatattatatttttaggatatgaaataaattagttaagtttttttttttaaaaaaaaaaattattatttttttattaaattgttattttattttgaatttaaggattaattttgaatgaattttttataaaaataagtttaattattttttaagttgtggttgataaagggagggtatattttttagaaatgtgaatgggtaattagaagtttttagttttatgttaagatatataagtttaaagttttaaatatttttttgagattgttttaatttgtagtatgttatatttattgtatggaaataagtatttattttgttaaataattaaattaatgttgagggaaaatgttatttttatatttgaatatagaaattttgaaattgtaattattaaatgttagttttgtttatataatgtttttaatatttgatgaggaattatattatatattttaataaaaataaattttgttatattaagttataaaattgaattgaattgtatttttttgagaatagtgtttaaggagagattgttaattagtgaatgtaaaattttagaataatgaattaaatgtaattaagtagaagattaataagaattatattatatagaaaatcgtgttttgaagaatatgtattataagatcgtattttttggtggtgtattttattattttaaaatattattattgaaagaagagaatagtaaacgattttaagaggtagaataatttaaatattaaatgtatgtttgatttttacggttattaattgtttttttattcgttttgtttttagattgtattataagttattattgtaatcgtaatagttttttgagaaataaatttttgaaaaatttaagtggtaaattgatggtttaggttgggaataggttagaaaagatattagttatgatagtagatggaagggtagtaaggtaggtggttgggagggaatttggaggcggagttgtgttagaaagaatataggaatttaaatagatggaagatgatatattagttggtagggagagtcgttgggtgataagtagacgaatttattgaagaattgggtggataggtagttaataagtgaattagatgaattagtaataaaagaaatagattagtatgagggtatttaagttttagaataaatcgataagaataatagaaaataattataattgtttttttgtttgaatttgaggaaacgatttttattgtaattttttaaagtgtttagaagtgatgatgaataaatgatgataaataagatgatgattattttttatagaaggaaaattttagtataaaatttaaagatgtttattattaaataaatatattttataaaattattatgagtatataatttattttatgttttagttttgggttttttataaattgagttttggttttggtttggttaatgtatgaggttacggggatttggttggaaaataatattgatgtatagtaaaagtggagaataagaattttaattttttttaaaaaagagaatttattagattatggtaaatgtgaatatgatattatttttataaaaatagtttatgttgtttttgtttattaaaaatgataatagtagtgttttaatgaggataaagaagattattataagttatttggttttttttttgtttttagatttatttatttttaaattattatatttttaggtaattatttatatttgtaagtatttagtataattgtgtagtgtagttttgtattttttaaatgatagttgttattatgggttgatagaaagtattatatttaggaatatttgtaggaaggatttggtttaataggattattttgattgatttttagataattatatggttttttagtagagaagatattttaatttgttatattataagtttaaaatttatattttttttatttttttatttaatttataaatttatttttttggtattgttaattatgttttttaggttagtttattattttttattttattagttaaagtttatatgttattatgtttgaaattgtgttgttttattgttaatatgattatttttaaaatatttgtatttttattaattttatatatagaattagggattatttattttaagggttgtttgagttatatgaatattttttttaagtgaattttttttagttgatattttaattttttgaattaaatttttgagtttaggttagtagtagtgtttttcgaaattttaaatgttatttatatatatatatatatatatatatatatatatatatatatataagttggagtaattttttaaagaattagatgaggtaaattttatatatatgttaggtattaggttagatattgagggatataaggataaataagatatgaatttttttattagagtttatattttggtggatgaataggtatatatatgtgtgtgtgtgtgtgtgtgtgtatatatgtatgtatatatatatatatatgtatgtatatatatgtatatgtatataggtgtatatatacgtatatatataggtatatatatacgtatatatataggtatatatatacgtatatatataggtatatatatatatatgataatatataatcgtatatatgtgtatatatagtatatatgtataaataatatatatgtatatattgtatatatgaatatataattatatatgtatatattataatatatataatatgtatgtatatataatatatatatgtgtatatatatataaaattagatattatggtatattttaatagatgtaatgatattatatttatgtaatatatgtgtatattattttttataattgtaaattttttgaggttagggaatatattaatttattaattagtaaatatttattaagttttttttatgtataatggttatgtaaagggaagatttttttttgttgttatgggtaaaatagtttattgaaaaagggaaaagaaaggagtaaattttttgtgaaatatgatggtatatagtatgtataataagtgtatataaattgggttttaattaaaattaggagaggatattaaggataatttttttaatgaagaaattaaaggatatataggatagtttttaaattatttaagtatttgtataatggttaatttattgttgttataaaataatggtgttgattgtaaattttagatgtttagattaaaaaagatatatgtatttaatgaatataatttgaaaggaagttaattatgtgtttggtgttgagataattatttaagtattagtttatttaattttttttagaatattatgatatttttatttttaagttggatgttacgttattattaaaattttttagtttaggattaggagattaaagttttttttttatattattataattttgttaaatttttttggtattttgtagaaattttaaatgttaatgtatttatatatttagtgatatttcggaatttttatatttattagattgtttatttttttttttttttaattaaaatatatataatggggttagtataatgttgtatgttaatttttatttagatgttattgattaggagattggagtggggttttaagatggttgattagaaagaagttttttatgtttattttttttattttaaaaattaaaatagtgtatagatagttatatattgaatatattatttgagagacggtggtggaatttaataaggaagtgataaaaatattaaaagtaggaaggagaagggagagagagatagtttgtttgtttagaattagttggaagttgggagtgattttttagtttagggattaggtgagtaagatatatttaatggtttatattattattatggaattatgtagttttgattataggagaattttttattatttttaatttttgaaattattatagggagttgttaatagattgtagaaagaaggaattgttttagggagggagtttgtattgggttttatattttttttgagatttaagtggttatagtaaggtgttatttttaaatttagtttttgataggttttttgttgttttggggtgtagtagcgttgagtttgaggtgttagggaaatttgggttgtttttgatgggattgaggagtaagtcgagaatgtttttatagttaaggttaagaagtaagtgaggtgtgggttgtagcggttattgttaggaagtaagtattgttaggatagagattgagatataagtaggatgtaagttgatattgagatatggatgttagttgggtggatatttttgtagttagggttagggtttgagttaggtttaggttattattggtagtggtggagtatgagatagatttgtgttttttattagttatggttattgaggataattttattttttttaatggtagggttttagtatcgttgttattgttttttttcggagtattgtatttggtatttgaggattattttattttatttataatggttggtgtttgttttttttattcggggtattgagtaaaaggttatttagttcggtattgtatttgtaagatagagtacgtagtttgtggttttggggatggtttaatttaatttattattttggaattagagtatttttattagtattttgaagttggttttaaatttttagttattattattttagttggtatttatttgtaagtgttatttgtgagtttggaaatgggttcgtttagtttattgttgttattattaatattaatatatattaattgagatttaaataatttttttgttattgttattgttattttttatgttatattagttatttaatgtttaagtatttgaatatttatttggtttattgttgttattattggaatttgagtaagatatttggagttttaagagttagttttttagtaattgtaaataaaagtatttgtgtatattatttagtggaataaaaataggtaaatttaatttattgttgttagtattgtggtttgaatattggtttatttgatattttagtatttagtataattttattatagtttttattaataattatattttaatttattaaaaaatgataggtattattaatgttgtatgtagtaaaagaaattatatagagatatatttagaattaaagttaaagtattttattcgaataattttatagaaatatttttaggaaaagtttttttttatataagtaaatttaaaaataggaagaagtaatagttatattatatgtgtagatattaatgtaaggatatatgaagtatgaaaaaataaggaaatgtgatatcgttagaggaatattgtaattttttagtaatagattttaatcgaaataaaatgtaatattttaggtaaagaatttaaaatatttattttttaaatatttagtgaaatataagagaagtttgaaaatgatataaagaaattagaaaaaataatttaggatatgaatgagaaatttattaaagatatttttttttttaagaaaaaataaatagaaattttggaattgaggtattttttgaaggaaaaataaaatatatttgaaagtattaaaattggaagttagattaggtagaagaaataattttagaatttgaagataggttttttgaaataatgtagttagataaaaatatagaaaaaaaatttaaaaagaatgagtaaagttattttgatatttgagataatataaaattattggatagttaagttattgatatttttaagggtgaagaaataataataaaaagattagaaattgtttaacgaaatgatagatgaaaattttttaaatttagtaaaagatttagatatttagataaaagaggtttagtaatttttaggttgataaaatataaatgtgtttttatggtatattatagtatgattgtttaaagttatagataaaaagttaattttaaaaatagtaagagaaaatatttagttatttataaagggaattttattagattaaaagtagatttgttagttgaatatttataggttagaagagaattggatgatttatttagtgttgaaaaaatgttagttaaaaatgttatatttagtaaaattattttttattaatgacgtagaaataaagttttttttagttaagtaaatgttgagggaatttataattattagattagttttataagaaatgttcgttttaaattagaaagtaaaagaataatatttattagtatgaaaataagtaaaagtgtaaaattattggttaaaataataatataaaggaggaagagataaaatttaaatagtgttattgtagaaatttattaaataataaagagtattaataagagaaaaagaaaaggataaggaatatatataataattagaaaataataatatgataggaataaagttttacgtattaataataattttaaatataaatgaattaaattttttatttaaaagttatagattggttgaatagattagaaaatatgaattaatttttgttattaataagaaatttattttattagtgaagatatatatagattgaaagtaaaggaatggaaaaagatattttatataaaaggaaattaaaagtaagtaggaatagttatatttatattaggtaaaatggattttaagtgaaaagtagtttaaaaaaagataaaagttattatataattataaaggaatgaatttagtaagagaatataataattttatatatatatgtatttaatattggagtatttagatttataaagaaaatattattagatttaaagagagagaggttataaagaataatagtgagagattttaatattttatttttagtattaggtagattatttagatagaaaattagtaaagaaatattggatttaaattagtttttagtttaaatggatataatagatatttatataatattttatttagcgatggtagaatatatatttttattataagtatgtggaaaattttttaggatagattatatgtgagatagtaaaataagttttattaattttttttaaaaattgaaattatattaagtatttttttagattataatggaataaaattagaaattaatattaagaggaatattgaaaagtaaataataagtttttgtattaatattgagttaatgaagaaattaagatgaaaataaaaaggtttcgaaataaatgaaaataaagatagagtatattaaaatttatagggtatagtaaaagtaatgtaaagagagaattttatagtaataaatgttaatattaaaaaagtagaaaaatttataatttaaaggaattagaaaaataagaataaattaaatttaaaattagtagatgaaaaaaaataaaaatgagattagaattaaatgaaatagagattaaataaataatataaaggattagtaaaataaaaagttggttatttaaaaatataaataaaatggataaatttgtagttaaattaattaagtagaaagatttaaataaataaattaagaaataaaaaaggatatattataatagatattatagaaatatagaagattattagagaattattatgattaattatatattgaaaaattggaaatggataaatttttagaaatatataatttattaaggttaaattaggaggtagaaaatttaaatagattaataataagtagtaagagtgaattagtaataaaaagttttttaatatagaaaaattttgtattagatggaattatagttgaatttaattatatatataaagaagaattaataattatttttttgaaattattttaataaattgaagatgagagtattttttttattttattttatgaggttagtattaattcgatattaaaattagataagaatataataaaataagaaatttttaatatgtttaaggaatatggatataaaaatttgtaataaaatattagtaaaataaatttaataatataataaaaagataatatattttgattaagtggtatttatattaggtatgtaaggattgtttaatatatgtaattttataaaggtgatatattatattaatggaattggggataaaaattatatgatattttaatagatgtagaaaaaaaatttgataaaatttaatatttttttatgataataatttttaataaattaggtatagaaggaatgtattttaatataataaaggtcgtataggataaacgtatagttaattttatatttaaaggggaaacgtagaaagttttttttttaagaattagaagaagataaggatgttagttgttattatttttattttatataggattgatatttaaatgttttgatttgattattgtgtattataaatatgtaataaaagtatttattgttttataaatttatataaattttttttaaaaaaagaaataaataaaaagatatttttaattaggagaaagttaaatataatttgaaaaataagttatttataaattttaatttaagttaagttaaaaaggttattttgtttgagtatggaaaatgtgattggtaaatatagaataaagtgttatttgaggaaatacgtatattttataagatgtttgttgtatgtattttgttgaaatattagtgagtattttgatgaataagtttttaataaatttatattaattagtttgttattggtttttttaaaatatgtattgttaatagtaggtagaaggaataagtttagtgtttaataataaaataggaaattgtagttaataataatttacggtatattttaaaatagttagaagagaagaattgttatgtttttaatacgaaagaaaatataaatgtttgaggtgatgggtattttaattattttgatttgattattatatattgtatataggtattaaattattatatgtatttttataatatatataatttatgtattaataattattgtaaaagaaaaaataataatttttagtttttttgaggagatgttttagatatttttgttttttttttatttttgttaagtaaaattaaatattaagtagtagagttttttgtgtaagattgaagattatggagggtaataatttgttttgtttatttttgtatttttagtgtttagtatagtgttttgaatatagtagatgtttaataaatgtatgttgaataaaagagtatatgaattattaatatgaatatattattatttgttatattatttaattaatagatttttagggatttgttatgtttaatgtatatatttaatgtaagatgaattttgtagtagtcgattttgttttttaatgacgaaaatgtgttttaaattaacgtaggtaaaagggggattttatgtaatgatataatattatatatttgaaggttgtataagtaaatgttatgaaggatggagttaaggtgtagttggatttaaagtatattttaattagagatatttagaattaatattgttagtttttttgaatacgggttttatttttaatgaaaattaatttttttatgttttagaaaatatatttgattttaagtttaggtatttttatattttgtagtatttttaattttttttttattagtaagtatgtttttgtgatagtttttataaatattatgttgtaaatggttagtttaggtgataaagtataaatattttgttgatatattgattggaaaattaatgggaaaatattaggttgaaaatttgaatagatattttgtttaataaaagttttttgaatattttaataaaaaagaaattgtggtttatgttgaagttaatgaatattagggataaaagtaattaaaatattttaaattattttaagtaatatttgttatttttttagattttatggaaataatattttgtttatttttttatatttttaatatttggtatattgtttggtgtattgtaaattgttggtttatatttgttattaatatattgataataaggttttttcggtttatatatgaatggattataattaggtagttgtgataagaaagtatgtataaaattagtaaatgtattttatattgtgatttatttatatttaaagggtaaattatataatataaattgtttagagataaatgttttgtaagataagtaaggatttagattaaaaagaatatgtttggttgggtttggtttgtattatatttttaaaaatagtttgaaatagtatatcgtttttttggaatttattgaagatgttaaatacgtgggaaatttttgagaggagtagaattaagtagaaataataataaagattttgagagaagtggttatttttgttaaattagttagaagaataagaatatggttaaatatttttatatagatatatttggatgagatttttgtaggagtgcgtgaatgttaatattgttaattttgtaataaatgttatattttattgaaaaaattttttggtataatgattttttttttttttttgagacggagttttattgtgtcgtttaggttggagtgtagtggtacgattttagtttatcgtaattttcgtttttagggtttaagcgatttttttgttttaggttttcgagtagttgggtttataggtatgcgttattatgtttagttaatttttgtatttttagtagagacggggttttatcgtattggttaagttggtttcggatttttgattttacgatatattcgtttcggttttttaaagtgttgggattataggtatgagttattacgtttggttataatgattttttgaagttattgaatgtaagtaaaattataaatattgtttttttgtgtgtgttttttattgaaagtagaatgtagtttttatttatgaaaatatgaatgtttttaagtaaagtttttttttaatttaaattgaatttaaaaaaatgttttttgtagtagtgaaaaaaatatttttggtaatttaagagtgatattatttagaatttttttttttaattttttattaagaataaaatgaaattttagaaacggaagaagttttataaagattgtgattaattttttagtttttataggtagaaattgaattttttatgattgatttttgttgtttaaggatttattatttatgtatatttatgtaatgaaaattaagtttaaaagtataaatagttaaaagtgtaataataattgaaaattgtagtaacgttttttttaattgtataattattgatttaagtttaatgttttttatgtgaattatatttttagtttgagggaaaatattttttaatgaattgtttttgttttgttaagtgatttattttaagaaatagtttttttttagaaaataaaggaaattttaatgaaagaaaaagtatttttttgttattttaaatatgtatattttttagattttaattacggaagagtaatgttgaaagaaaattatttatgagtattgattaggaaattggtgtttattgagatatgtttagtattaatataaacgtaatttttttttaaaagagttagttgtatgttagttgatttgttgaaaatgtttcggttatattattaaaaatagaaattttagtggtttttaatttaggaataaataagagtaaaggtgagaaatttgaaatgtaagtttattaatttttttttgttatatagaaaattgattagaattgttagtttagtaaagtgtagatatataatagatattaaatgtagaaaaattaagaatataatattggttataaattagataatgtaagaagaatgaatataggttaatttaatttgttagttttaaatatatattattatttgttttatagtaaaattatattatttattgtgttttattgatagaatagagtattaagtaaaagaagaattattagattattaaaaaataaaaaatgttattatatttgaatttatgttaatgagatggtgttgaataaagtttttagatagttttaagatggggttagttattagaaagattaaataattagagagttggaaattttatttttattcgttagtttttggagatgagaggagggttggagagtgagttatataaattttttattaatgagatttagggagtattttatttggtgagtatattggggtatggggagcgtggtgtatttagagagggtatagaagttttgtattattttttaatttttataatttgttttatgtattttttttatttgttttcgaattgtagtttttataataaattagtaaatgtaaagaaagtgttaaaaataataaaaaatgaatattagtggaatggaaattaaatattttttattaatagtaaaaaatgattatcgatagattgagttggggaatgtgaattatatagtgattttcgagtgtgatttaaaatgaatttagtaaatagatttatgggaaataattagtttataggtgataaaaaattattttagtaataatattgcggaggaagttagaaaaatagtaaatttatatagataattgatataaaaaggatagagtaaattttttagtaattaataaataaatggtagggattggggtgagggtaaaaaaaaaatggtttacgtttgtaattttagtattttggaaggttgaggcgggtggattatgaggttaggagattattttgtttaatacggtgaaatttcgtttttattaaaaatataaaaaattagtagggtatggtggcgggcgtttgtagttttagttattcgggaggttgaggtaggagaatggcgtgaatttcgggggcggagtttgtagtgagtcgagattgcgttattgtattttagtttggataatagcgaaatttcgttttagaaaagaataagaatttaaatgtttttatgaagttttggtagtatttttattgtttttatgtgtcgttattttatatagtagtagaaaagttttattagagttaagtttttattataataatgtttttgtttatttattttattaaattaaggagattttgggagagttttaattagaaatgtataggtatttttattatagtttttttttttttaatttaaatttttgttgttgttgttgttgaggtagagtttttttttgttatttaggttggagtgtagtggtatatttttagtttattaaaatttttattttttgggtttaattgatttttttgttttaggttttcgagtagttgagagtatagaaatatgttattatgtttagttatttttttttattatttttatttttttttgagatggagttttattttgtcgtttaggttggagtgtagtggtgcgatttcggtttattgtatttttcgttttttaggtttaaatgatttttttgtttttattttttgagtagttggggttacgggcgtgtgttattacgttcggttaaattttgtatttttagtagagacggggtttttttatattggttaggttggtttcgaatttttgatttcgtgatttatttatttcggttttttaaagtgttgggatgataggcgtgagcgattgtgtttggttttttttatagttttgatttggttatttttgttttttttttgttttttaattttaagtaatttttaaagggtatttatttttttttaattaataacgtaaaaaagattgtatttatttggttaatttttagggatttttagttttttagggatggattaaatggttggttttatggtttattaaagtattttaaatttgatgaataaagtttatattttttatttttattttttaattatatttttttataaattttttgaagtttttttgtattttaattgtaatttttgtagtaaagtattttaaattagttaaaattttttttttgttttaacgtttatattttaggggaaaaaaattgaatttattaatggttgtttttaatttgtgttatttttaaatgttgtgtttattatttatgtaaattaaaattgtaaattgaaattttaattttattagttttatggaaaagtttagaaagtagtggatttataatgtgaatagtaattataattatattttattagttatattttaggtatatttttgaataagaagttgaattatagtttgaaggagtgggttgttttttttttgttggggattttttattgggaattagtggtttttaatcgttttggtattagggataggttttatgtaaaatagtttttttacggatggggtgaggatggttttgggatgaaattgttttattttagattataaggtattagatttttataagaagcgtataatttagattttttgtattatttgtacgggtagtttataatagagtttgcgtttttgtgagaatttaatgttgttattgatttgataggagtttaggtagtaatgtttgtttgtattttgtttattttttgttgtgcggttttttttttaataggttatagatttatattattcggtagtttggggtttcgggatttttgttttagagtttttaaattttataaatattttttttaggaatagttagttttatgttttgatagaatggattttttaggttgtgatttgatattagaatttatataaggatttatgtataaagaacgtatttgatatttttttttatttttttttaaattattattttttttaattttatttatattaagttaaaatttttatagtgtttaatgttagtaaaaatggtattgtgttttaggttagattattaattttttttatattgttattttatttattattgtgttgaaagttttattgattatgtaagttgttataatttttttggaagtattagtgtttatataatgaaaaattaagtaggtgaataatgtatgagttagtatttagttttttatttgttttgaatgagttaagagatttagatattattttgaaagttataataaatagtaatatgattatatttagtttttttttaaaacgatatagatgtaataaaatgaaggaaggatatttcgaaaatgtttttttgatttttttttaagtttttttaaggatgtatgttatatgtttggtttttagtaaaggtatttggtttttaggtttttttaaagttgtaagttttattgaagttgtattgtattgagttatatatgatggttttatattatagtttagatattttagggtattaggtgtgtttttttttttttttttttagtaatagtagggattggttataaaggagaaaaattatttttttttttatggattaattgtttttttaaataaaataattaaatatagtataagaatataatgtaattatatttgtgatagatttaaattattaaggtaatgaattattaaaagaaaatatttttgtggagttaaaaggattaataaatattagtgtggttgtattattaaatattggattaagaatcgaagaatttgaatttagttttttgagattttagataaatggtttaatttttttaagttttaggttattgattattaaaatggggattagtaatatttggttttattaattgttaaattgtttatgaagtataagtgaaatattttttgaattgtttataatttttatatttatttaaaaaaggtgtaaagattaagaaggtaaatttaatattagtaataataagaaaatttatatatttgattaataagggtgattttatttgattaatatatatgtaaagttagttatttagggaaagtaaaatataaataaatgtaataaatatattaatgattgattttaaaagaagtatattatagtttggaaattatagtgaattttttaattaatttttgtaaaattgatttataattatgttttaatcgagtttattttttgatttttttaatagtaattatggagtttggttgtaattgattaggagaaataaaggtaattgtgttagttattatattagggtttttaatttatttttaaattatttgaagaatttttattaaggggattgagtttatataaaatatggaatgttaataatatttttttaattatttttgtagtaattgttaatgtataataatatattaaataaataatagtgatttgtattattaaaataaggatttttaattttttagtatgttatatgtagttaaagttaaataaatttaaataaggaaaagattttttttttaaagtttgtgagatatagaatattattttagtgagatatatatatggtatatatagtatatatatagtatatatagtatatatgtattttattaaatatatatattttattgtattttgtgaaatatagaatattattttagtgagatttatatatatatatgtgggtattatatatatatgtagttaagaattaattttaattaattttttagaaaatgatattgatgtatatttgtaaatgtttgtatttttagtattataatttatgtttgttgagttaattttatttaatttgaaattgtgatttttatataggtatttaataatttgttaattttttttgaattttttttttatggatatgttttgtaaatttatttatattgtttattatgaaattaatttatgataaatttttgtttattttatatttttttaaagattgttagtttgtatttatttggtttgaagtttttatagattaggttatagttatttttttttttttttgattttttagatatgaatttgaattgatttattattttttagttattatgttagatgtattttaaatagtgttttgtagggttatttagaaggagttttggtaaaaggagtgagtagttattgaaagttttatttttttatatgttataaaataaaatggatttgttaaagttttttatttgtttttttattattttttgtattaaaaaaaaaagtttttagaagatgtagatttagtttgaattttttattgtttttattttaattgatataaataaaattatttagcgatgatattaaaatatgagttagtttttataagttgtatgattagatgaataagtataaatagtttttgtattttttagttgtttatgagattatggttggtgtagatttgtattaagtgatttgaggggtttttttaattgttagtgggagttgtggataaggatatttatttatttttgtattattattgtattaaatttaagttaattataaatgattagtttttattttatttttttttattttgaaatttaaaatattatttttttggtataaatggtgtttgtttggtattttgaggtttataaaaattatttgattggtacgaaacgatttatttttatttaattgttttgaatagggaattatttttatttagataatttttagattttagggtatgaaatggaagtatttttgttgggattttgattgggattgtatttattgtgtagtgaatttttatttgttataaattaaggatttttttaaagtttttgagtagatttttgatagtggtagtaattgggattttggattaaaggtggtaatagagtttttatgtgttttgagattaaataatattttagtaaaattagagtttagaaataggtgtgattttcgtttttagtttgtatatattttttttattttttttttttttttttattgttttggtatttttttagtgtattggggatgaaagttttagtttagaaaaaagtatatacgtgtatatttatatgtgtatatatatgtatttgttttaaattatattttataaaggagtaggtaattcgtatgaaatatgtagttaaaaaggaagttttatttatattttgagattttgttgggatatttattttttagttatttttagtttttttggggttagttttgttagagaattatatgtttatttttgttaaaataataaaattatatttgtaaagttgttatttatatttttttttttttttattgttattagttaggtttaggtttattttgattatgtatagtaaattaattattgtgacgtgggttttgtagaagagaaatttatttatatagatatttagtaaggaggtaggagtatattttttaaatttgtttttttaaagataaggtttagcgatatttatgagttagggaagtggggtggtttaaggtatggggaaaggtgattcgtagtggggaaaaatgaagtaatgggtttattttgtgtaagtatagttaggattgatggtattttataggatatatgtatagaaaatggtagtattagtataatttgagggttaagttttgggttttttgaggtgaaaaggatattttttcggtgtttgtataggttttaagttgaaggttaggtggttttaattggtttgaattggataggagttggtttaagtttttgaaaaataaataaattaattattattatggtgattaatggatgttgtttgtaaagtaattagtgaaggttaagttttagtatttagtagagaggtttttagttatagtggtttttagttttatggaaaaaagaaaaagaataataataataataaaaagtaagttagtgaaagtaaatagggttgttagattcgattaaattaatttttcggtttttttatagttatttagttatatttaaggttggtatgaaagttatttttttttttattttatagatgaggaaacgtttagagaagttggtttttgggttgattagtaatgtttggttttaaatttggttggttttttttgggattagtgtttttttaggtatttggtatgattgtggtttggtttttaagttttttattagattttttatatattatttatttatttaaaaatgtttattagtattttaagaattttgtgtgttgttttttttttttagtgttatatttttttaattttaaatggtatattttttttattattaaaattaatgttttaatggtatttttttttaaaatttgagaataaattgatttaatagttgatgttatagaaatgaggaagaataatatttgcgttttattattatgtttagaaaatttattatatgttttgaattttttttttttttatttttgaaaaaaatgtttgtttttgtgtgaaaattttatgtattttagttattattatttttatttttataatttttttttattaatttttatgattttaaatttattttttaagttatttagtttttttaagaaataatttttattgtatagttttttttttattttgagagaatttgatttagtatttattagttttttaaatgattttgttaaatagttattgaggttttttaataatggttggatttattggaatgtattttttttattgcgttaatataaatattattttgtttttaaatttatttatattttatgatattttgttagtattttttagttttggtatgaaaaataatatgtaagaaattaagttttataattttttgttgattttttttgtttttgttttaattgttggaggttttgttattagatatgataggatttgagtagagtgaaattaaggttgaaaaaaaattgaatgtttgaattattgattttaagagtaagagggaaggaagaagtggaaagtattttaaaatattatgtttaaaggattatggagtttaaaattttagtataaagaattgaagtgaaattaatggttttattattagtggattaattaaagtattgaataggagattaagattggatttttgttgaatgaattttgtttatatgagaaaagttagtgaaagatttaattgaacgtttaatttaaggtattttttgtatttgatttgtgatattaaaattgtttttaatatgtgatggttatgtttatattgttttagtttggttttattaatttatttattatttatttatttaatatttattatttgtaagatattgtgataaataagtgatatataagataaataagagatatataagataaataagagatatataatttttttttttttttttatagattgtagtttattgggaaatttgggtaataaaataggtaattataatgaaggttatagttttgatattaggagttagtttagttttttttttagttttattcgtttttttttttaagtttttttgtttttattttttgtttaaatagttttgattatattaagttattttgaataattttaaaaaatgtaggaagatatatagtttattgattatatgttttagtagtgaaaaaatgtgtttatgtatatttgtttcggaatgaagttttttgtatttttaaatttataataattttttaaatatttttttagttttttttaatattttttttatagtattttagattaaaatgattgattttagagatttttattaaatattttttaatttatttttattgtatgttaggtattatgttattttttaaggatataatgataagtaaatagataggttgatatgttatttatatttaggaagtttatagtttagtggtaaatatatatattaaattaaaaatatgtaaatgataagttagtttgttatatatgttaatagggaaattgtaagagtatagaatttttttatgggataaaagtgagtgggagagaatttagatgaatgtgaaaagattgatttttggtgaaagtttgatttattttgaattttgaagaataaagatttatttaagatataatatgggggaataattagttatttttatatttttatatttagttttattttattttatatttttagatttaaaagtttggttatggttttttaaagatgtgaattattttaagtttttaagttaagattttgtgtttttaaatttggattagaaattagttggagaaataagaaaagaaaaaaaagattgttatgtaaatgtttaattatttaaaatatgaggatttaaggagttaaaggtagattagtaagtgaaagttttttattttcgttaatattttttattttaaattggaagttatgtgttatgataatataagaagaggatttttaatttagagtaggagagttaaggaatatattttaaagtaattgattttagaattgagatttaagtgataattaggagttaattagaagagtagatggcggaaggagaaaaagtggaggaagatagtttagaggagttagggagttaagaaagaagaggaatttgagaacgagtttagaggtaagagggttgaaaagttttgtagtttagtattcggagggtgttggtataggggaatagtggtaatgtgttattggggaggtgatagggaaggtaatgagagatttttagattgtattaagaagataagtgatttgattgaatttttgtttgtaagaaagttttggttattgttgtgaaaatatttttgagtgaggtatgattgtgaagtagaaagaatattagagggtagtgtagtaattttggatagaaatattaatgatttagtttagtggttattaaattttgttttttaaatatttttaaaataattttgtaaaattgtatattattttatatatttgtgaattgatataaatatttattataagtttaaatcgttgtaaaatgtaatttttagtatattgtaaattttgttattttaaattgtttgttgtattatttttaatagtatttattagagtttgaataatatcgagatttaatgttcgttattatttatttaaaaatatttgatatattttttgtataattttaaaaattttgtgttatttttttttttttaatttttatttttatttttatggattttatttttttattatatattatatgtttaaaagtatttaattatttaataatgtattttagttataaaatggttataatttaattttaaatattttttataaggttttaagtgttaattatttttttagaatgagttgttaataaaatttttattattgaatatttgaataaatttatataattatattttaaattttgaaaaaattgttattgataaaagaagtataattttattggtaatgtatagtttaatgtaatagacgggtttttaaaattttaatttttttatttttgggagaatgttatttattgttaaaattagatagagtttaatattaattttgttttgaatttgatttattgttaaaaattatttttaataaatttaattttgttgaatgtaaagaaatggaaattgtttgatttacgaaataatttagttgttagttatttatttttttaatagttatattagtattttttaatatttatattagttatttttttgtttggtgtttttaaagagtttatatgtttaattaatgtatattaaattttgggtgggtgagaagtatgttttttttttgtaaaataagaggaaggtaattaggaaagagggagttggaaagtagagtttgtatttgtgtttgaagatagagttgaagataaatgtattttaagttaattatttaaaatttttttttaagtataatttggaaggatttgtatgtttttaggaatatatatatattagtttaaagattatttagatagattgaggtagtgataatgatagtagaaaaaagtggaaagatattagaaagaaagagaaatataaggtgaaaaatttaataaatttttgtattgtgttagattggtagtatgtataaaagttttagaagttaataagagtgggttatattttaaatatttttttggagagtagaaaatcgttgagtagggaaatagaatgatttgtttggtatttggagataatgagtttatagggttgatttgtaaggttgtataattttttttgtagttattagttataagggtgaagatgtagagaaagtataaagttgagggttttgcgtgttaattttagaaagtcgattttgagggatagtgaattattatgaatgaaaattgataaattttaatttttttgggtaagataaattaaaagtggatttaaatagaggaatgtatgtgtagtagtaaggaagatttgttaaagtatgttaggtagggaaaagaatttgaggaaaaagtttagtagtaggaggtttgggatgttttgtaaggttgattttgaggtaatttatatataaaaataatttgagaatgtatagtttcgagaaataatttttgtagattaaagtaaagaaagttgttataaaaataattagaatgatatttaggagataaagttttggaatattttagattttttttttttaatgttttataaatatatatttaaagtaattatataatatataatatattggatattatattatttgaaattattgatatatatattaataagagtttagatgttaacgtataatatgtaaaggggtatataattttttaagggggttttgtaggtaaaaattttgaagattattgaaatgaagtattgagaattagaagtagaaatttagagataatgatgtttgtttagatgttggggaatatgtgatgttgaaggttggtgttggtagatttagagttaattttaataataaatttatataatttttttaaagaattgtatgattatgagtattttaaaggtgtttattaaataagttattttaagaatttggtagggttgttgaaaatagtaaaggtagtatgggtaggtaatattttttttagtggaaaagaatttgataaatttatttttattattatattttagtttgtagaggtttgtgggtagtggagatgttttaggaattttgatgaaagttgatagagaaagtagtttggggttagaaatatttatatttttaaattatttataagaaatgaatgatttgaaagtaggtgggtttttagaaaatagatagaattatggtgttgttttagtagagaaatgaagttgtttttcgtggaaaaagttaagttagaattttgatgttttttagtaaaatagtattaaattgatgaattaaatttttttaaatgtgtttttgtatatttatataaaagaaaatttcggaaaagttagttattgttattttttaggtataaaaagttgagttttgtatatatagttttttatatttttagagatagtttaggttttaaataggatttggttagtttttttgattttttgtatgaatttgtaagtttttttgtgttttgttttttttgtttttggtagtggtggtggtgggatattattttttaattttgtgtatatattgttataaatttagtaattgttaaaatatatttggttattttaatttttttgggttaggagtatgggtatagtttagttggattttcggtttagaattttataaggttgaagttaagtttggttgggttgtgtttttttttggagtttggtgtttttttttagttgttagtagaatttagtgttttgtagttataggattaaggttttgattttttgttgttagttttgagaggttattttttattttttgttttttttattgtatttttatttggttttttttaatatagtagtttatttttttaaggttagtaggagattttttttttttttggaagggtttaagtttttttttaaggatttttatttgattaagattagtttatttagaataattttttttttaattaagtgagaattaatttatttgagattttaattaagattaataaataatatgaaaaaaagttgaatattatagattattagagaaatgtaaattaaaattataatgagatattattttacgttagttagaagggtaattattaaaaaagttaagaaataatagatgttggagaggttatggagatgttggtgggaatgtaaattaatttaattattgtggaagatggtgtggtgattttttaaagatttagaattagaaatattatttgatttagtaattttattattgtatatatatttaaaggattattaatttttttattatagaaatatatgtatacgtatgtttattgtagtattatttataatagtaaagatagggaattaatttaaatttttaatagtgatagattggataaagaaaatgtggtatatatatattatggaatattatgtagttataagaaggaataagattatgttttttgcggggatatggatagagttgtaagttattgtttttagtaaattaatgtaagaacggaaaattaaatattgaatgttgttatttagaagtgagggttgaataatgagaatatacggatatagggaggggaataatatatattggggtttgttagagggtggggttgggggagggagagtattaggaaaaatagttaatgtattttgggtttaatatttaggtgatgggttgataggtgtagtaaattattatggtatatgttgatttatgtaatagatttgtacgttttatatatgtattttagaatttaaaataaatataaaaaatttaaaatagatataaagaggagatgatggtgaaaggggatgaaaaggttaaagaatatggagaatagatttataagtaggtaaaataaatgattaatagattaatagttttagaaggcgagaatagaattgagagatgaggagaggggtaaattatggattttagttaataaatattaatattggtttattaattgtaataaaagttttatattaatgtaagatgtaggatataaaagataagataatagcggaaattgtgtgggtagatgaagggggtatatgggaatttatttgatttttttattataatttttttgtaaatttaaaattgtttttaaaaagttattaaaataaataagtaaataaattgtgtaatggaaaaaaaaataacgataaaaagattttttttttttgtatttttgttatatagtatttttttatttttgtgtaatttaatatagagagtaatattttattatattgatagtttttatttatatttaagggaagaattaataggagtattatgttgggggttagggtaagaattttgagattttataattttgtttattataggagtgaagggtatagaattatagtgatatttgattatttatattttgttattttattataaaattatttgatttaagttttaataaatttttattaatgttaatgtttttaatttggtttgtttaaataatttattatttaaaatttttttatttttaatatttaaaattgaagattgttttttatagttgatgttagtaaaaaatttattaatataattattaattatatttttttaaaatttttttaattatattgttttttttgaaatagaatatttattattttatatattatatttgaagtttttatttgttataaattttataagatttttatattttttttaattttttatataatattgattagaaatcggatttttaaatttattaggtttaatttaatagataaaatttatttttataaatatatattgtatattttattagttagttagtttgttaggatataaaattgaaaaagattattttgtttttaaatagtttgtgaaaaattttttgatgatatattaggataatttttaatattttgtttggatgttttttaaggtttggtgtaatatgtgtgatgttttttttaataatatttatttagttttgattttttggatattaattgggtgtttaataatttaatttaattgtgtttttaatttattggagttagtgtagattttataggttaatggtttagttttataagattgttttttattttagatgttagttgtaagttttaagttttttgtatttttgattaacgggttataaattgtaggtttttacgatattttatataggtttaataaattgttgtaatgttttatagaatttaaaagaatgttatttattattattagtttattatgatggatgtaatttaaaaatagttaaagggaggagatatgtagggtaagtatgggataaggggtaggagtttttatattttttttaggtatgttatttttttagtaattttatgtgttcgttaatatggaagttttgtaaattttagtatttagggattttaatggaaagttattatttatatatgatttattggttattggtagaaagtttgaggtggggttgagagttttaaatttttaattaaggtttggtatttttggtaattagtttttttattttgaagttatttaggggtttataaagagttattttattattataaaagatatttttattatttttaatatttaggaaattttaaaagttttaggagtttcgtgttaggaataggggataaagattaaatatttatgttattatttagggtaatgtaattattaatttagaaattattattgtataatataatttaaattattttggaaagaaatatatggttattttaaagttaattgaagtttatttgttaatttaaagaatatattatatttttttgatatttgttttaattgagttggtttgtttatgttaagtttttttttttttttgtagatttaagtgttttggttgtatttgttttagtttatttataaaatattagatgaaatgttttatttaatgtttttagtattaatttttagggaattttgattaaaagttttttatttagaaaaaaatatatatttatgtttaaatttgtttgtttaaaaaaaaagtagaaatgttttttaagtatttagtgaaatatttttaaagttttttaatggaattttgttttataaattaagaaaataagtgtaagtaatttttattagttttttttttttttgattttttttttttttagttagagattatttaggaatgtattttttttttgaaatattgttggattgttttttagtgtattattttattgtagaagtgagatttatttattttataataatttttaagaatcgttttgtgtttatttatatttattaatttttttaaaagaattttttttaaaaaagttatttttagtttatttattaattttttattggttttttttgagtttataatatgtatttttatttaattatttttgaataatattatgttattttttatatagtataattatttttataatagtgtatttttagttttttttgtcgttattgttattgttgttatatatggtatttttatttatgttttaaattttataatatattgttattatttttgttttagatagtgaatttttttttatagtaattataaattaggaaaaagtgggagggttgtttgaggttaggagtttgagggttaggagtttgagattagtttgggtagtcgagtgaggtttttgtttttataaaaataaagaaaaaaaaaaatagttgggttgtatttagttttttagaagtttgacgtggaataattatttgtgtttaggagtttgaggttgtagtgatttatgattgtattattgtattttagtttgggtgatagagtgagattttgttttttaatatatatatatatatatatatatatatacgaaatattttttttatttattttatttttatttttttgattttttttatttttttttgtagatttaggttgtgtttagtgttatattttttttgttgtgtagtttagtttttaataggttacggattggtattagtttattgttttttatattttttaaaatgtgggtttttttttatggggtttatagaggttattgattttttttgtagtttgataaaaataaaatgttatatgtgttttttttttttttggagaggtttggttttttttgttatttaggttattcggtggttttataattttaggtttttgatatatttaaggaaagttatgaatattatttggttttttttatattgttatatagaggcgagattttttgaagtttttagtatttaatgtagaagtagaagtttatttataatttatttttttagtgattgtatgttgtattgttaatgtaaaggttatgaaaaaaatttttttgttattttatgaatttaatatttttttttgaattgggtaaagatttttttttttattgaatttgttttaatattaagttatatttgtaatttttataaatattgaatatatgtttattgaaagttatagagtaaattggtttttttttttattttattttaattgtatatataatattttgaaatttattattattataaattagaagtatttttatatttattaaatatttatattttttttttattttattaaatgaagatgtattaaagaaagtatgttttaattttagttatttaaaatatagttattatatatttgttgttttataggtattgaggaagatgtttatgagagtattgttttaatgataaaaattgggtttagggattttgatattttatgaatttaaaatgataattttagaattattgttaaatagaattgtaggaagtatattatgtttaatgttggattgttagaggttttgaattaatgtttatgaatataagatttatttatgatatttaagaaagttaaaattgttgggattttttttttatatattgttattttagttaaaatataattgatgaatagataatttataattttaattttaaaatattgtaattttgtattagatagaataggttaagataaaataggtaataattgtattaataaatatttataaaattttaagtatttgatatagtaaaggtttattggttatttatattatagttaaatgtattaatattttattttttaatttatgtatagtaaataatttttaaggattttttgtagtaggagtttttagtttttgggtagtagattggtattagttcgtgatttgttagaaattgggttgtatagtaggaggtgagtagtagatgtgtaaatattattatttgagttttattttttgttaatagtagtattagatttttataggagttggaattttattataaattgtgtatgtgagggatttagattgtgagttttttatgagaatttaatgtttgatgatttgtggaatagttttattttgaaattatttttttttatttgtggaaaaattgttttttataaaattgggatttggtgttaaagagattggggattgttgttgtatagaataataaagggttggaggattaggtgggatttggatcgatttttttttttttttttttttttttttttttttttttttttttttttttttttttttttttttttttttttttttttgttttttttttttttttttttttttgttttttttttttttttttttttttttgatagagttttgtttttgttgtttaggttggagtgtaatggtgcgattttggtttattgtaatttttgttttttaggtttaagtgatttttttttagtttttgagtatttggggttataggagttcgttattacgtttagttaattttttgtatttttagtagagatagggggttttattatgttggttaggttggtttcgaatttttgattttaggtgatttatttgttttggttttttaaagtgttgggattataggcgtgaattattatgtttagatttattttttttttttttttaataattttattgagatattatttatatattttataatttatttatttaaagtgtataatttattgatttatagttgtgtaattattaatttaattttagaatatttttattttttaaaagaaattttataagtgttggttttattttgtttttattttttttttttatttttgagtaattattaatttattttttatttttatgatttatttattttggatattttatgtgaatgaaattgtattatatgattttatattttttgtgaatttttttttatttagtataatgtttttaaggtttattgatattgtattatgtaaaattattttatttttttttattattgtataatattttattgtataaatatattattttttttgtattcgtttattagttgatggatatttgagttgtttatgttttttggttattatgaataatgtagtaatgattatttgtaagttttgtgtagatatatgtttttattttttttatgtatataattaagggtggaattgttggggtatatggtaattttatttttaaatttggaggtaaagttattattaaattgttttttaaagtaatagtattatttttatatttttattagtatgaataaaggtttttttttttttatatttttattaaaatttttttttgttttttttattaaagttattatagtgggtgtgaagtaatagtttattgtgggtttgatttgtatttttataatgagtaatgatagtaatgatttggatgtttttttatgcgattattgtttatttgtgtattttttttggagaaatatttttttaaattttttgtttatttatttaattgggatttttgtttttttaagtattgagttataagagtttttttataattttggatataagttatttattagatatatgttttgtaaatattttgtgttattttgtgagtagtttttttatttttttgatgatatattttgatgtttaaaagtttttaattttaatgaagtttaattttatttttgtttttgttgttgatgttttttgtattttatgtaagaaattttggtttaattcgtggttaaagatttatttttatgtttttttttaagaaatatataattttagtttttatatttagatttatgatttattttgaattatttttttggtatggtgtgaagtaggggtttaaatttattttttttgtatttgaatatttagttgttttagtattatatatttattgaattgtttttatattttttttaaaatttattgattataagggtaaaggtttatttttatattttgaattttgttttattgatttatatgtttattattattaagattatattgttttgattattgttattttgtagtgaatttgaaatttagaattgtgaattttttattttgtgtttttttttagtatttttttggatattttgggttttttggatttttatattaattttaagattggtttgttaaaatttgtaaaaaagttaggtgaaattttgaaagggattatatttaatttgtagaatatttttgggaatattgatatgtaaaatatattaagttttttgaataacgaatataagatgattttttattaatttaggttttttgttttttaaataatgttttgtagtttttagtgtaaattttttgtattttttttattaaatttttttttaagtatgttattcgttttggtgttattgtaaatttaattatttttaaattgtatttttagattgtttattgtaagtatatagaatatgattattttttgtatatttattatttattttgaaattttgttgaatttatttattagttataatttttttagtggattttttagaattttttaaatataagattatgttatttgttaataaaaatagttttattttttttttttaatttgggtttattttatttttattttttatttatttgttttgtttagaatttttagtaaaatgtttagtagaagtggtgaaagagatatttttgttttatttttgattatatgggaaaagtatttagtaatttatttttaatataatgttagtagtggattttgtgttgatgttttttattaagttgggaaagtttttttttatttttagtttagtaagtatttttattataaaaagtgttggagtttgttaaatgttttttttatatttatgtagggtgattatatggtttttgttttttattttattaatatgatgtattgtattaattgatttttggattttaaattaatattgtgttattgggaaaaattttatttggttatgatgtataattttttttatttatttagttagatttagtttgttaatattttgttgataatttttatatttgtggattttatttatttgtttatttttttatatattttatattgataattagatgttttagataataatattatagtaattttggatattgatttttttattttgttattgttattgttgtttagtttttggttatttgtgtatttgttttgtgatttagttgaaataattttgtgaagtttttttgtgtaggatgtttttaagggttaggtttaaaagttatatatattatttttgttttaattttaaatgttagaatttggatatgtggtttatatttaattgtaagagaagttgggagatgtagataagtatagtgttatttggtgagtattagaagtttttattattatttaaatttttagttattaaatattttttttttatatttaatgtattttgttgtttaaggagtttaatcgtaaattattgaattttaagttgaagaatttttaagttaggaaatgtatttatttggtttagtgatatagaaattaaaaagataaggtttttttatattttatttgtatttatatatgtttttaatttaaatggtggggtaggggaaagaaaaatatatttattattaataaaatggaaggttggatgatatataatgattattaatttttttatgagatattggttaaaggatataatatgttagttaagtaagaggaataattttaatagtatgggattatagttaataataatgtattgtatttgaaaatttttaagagtttatgttaagtgtttttattataaaaaataataagtatgtgaggtaacgtatatattaattagtttagttgaattattttatagtgtatatatattttaaaatgtgttgtatatggtaagtatatataaattttatttgttaatttaaaaataatttgtttgtagaaatattagaattttttaggatagataatttttgaagtttttttgttttgatagtgagggaagttttttgagatttatttatgttttgttttttaagtatgaatttttttttttatttttttttttattttgaatgaattttttttttttattttgttaaacgtttattaatataaaatggagttatattggtttttttttgtaaagggagagaagatgggttttttgagtttattattattattattattattattattttgttgatatttttggtggtatttttatatttgtgttattgtggttagaaatattattggattatattttagttttgaatttaattttgggatttgttgtaatttttggttttagttttattattggagaaattatttgttttgagaagttaaaagtgttattgagttttaatttattaagattttttagattttattattttttgagataatagtttttattttttttttttatttttatttttaatgtattttttttttttttgggtataagatttttattattataaataaaaataattattttaatggaagttttttatttattagaattaggaggtcgtttgaatgttaagttttttttatataaagattattaagattttaatttggatgaaaatttgtaatttgtaagtaaaattttaaagtaaagtttttaatttagtttgttaaacgggattatagaggattatatttttggtagatgggagtagagatttaggttgagttagtatttatgtggtttaatttgaatttgaatttagaatgttagaggaatagtcgttataataatttttataaagtttataaaagggtaattaaggatgttgaaaattgattttagtagtagtatttttttattttttatttttacggatttaatttttttgttttttgcgttagtttttcggaattatttttatttttttaaaaattgttttttttgttttttttgatgtttttgtatttgttttttttgggtgataggttgttattgattttgtggttgattgtattgtattttagtttgaatatttatttttgataattttatggtttttgtttttacgtgtagttaattataaattttgtgtggattgagattaattgtgttttttttttttagtagttgtaattttatatgtttttcgttattggtattgtgttagaaagtaataatagatgttttaaaaagagttgttatatgaataaaattttatttattttttagttttgtttgagttacggattttgaagttagttatttgttatttagaaattttgatattatattgttattatttattttagattttttttagaaatattaaagttaatatttttgtgaaaattgaaaaaaaattttatgattaaatttttattaattttgaataaaatgttatattaaggaatgaatgttttgatagtttataaaatataaaataatattataataatttaagtgatatataataataatttaagtaatattttttaaggtttgatttaaggatataaatatatgtattaaatattgaaaaaaaataaggatgataggatattagatttattattttatttttttttttttgttttttgagatagggtttttgttatttaggttggagtgtagtggagttattatagtttattatagttttgttttttttgggattaagtgatttttttaatttagtcgttagagtaagtttggattataggtgtatgttattatgtttggttaatttttgtattttttgtagagataagtgttttattatgttgtttaggttgattttgaatttttgtgtttaagtagtttgtttattttagttttttaaagtgttgggattatatttgtgagttatcgtgtttagtttttattttttttttatatatatatattattatagttaatttattagaatgaattatagtttataggaaaatattttgtatatagttttttgataaataatgtttgttattatgttaaatttattgtaaaatttatagtggttttttatattatgttgtttttatggtttgtaaattaaatataaatgaattattagaattattaattattttgtttgttagtgaagatattggaatggaaattattttgagttttaaaggtaaatgatatattttgaagataattattattttttttatttaaaatgtatattgatatggtttggttttgtttatattaaaattttattttgaattgtaatttttataatttttacgtgttgtgggaggaatttggtgggaagtgattgaattatgggggtgggttttttttatgttgtttttatgatagtgagtgggttttataagatttgatggttttaaaagtgggagtttttttgtataagtttttttgtttgttgttatgtgagatgtgtttttattttttattatgattgtgaggttttttagttacgtggaattttaagtttaataaattttttttttttttttttaaattgtttagttttgggtatgtttttattagtagtataaaaattgattaatatatataggttttattagaattatttaaagaataaagtaaaaatattaatataaaatgattgagttattggaaaatgggattatttatggtagaatttgttgtaataaaagatttttttgttaaaattgttattttatttgggattttttttttaatttttaaggtaaaaataagataatttatatgtatagtttaatttgtagtttagggagatttggtatataattttagttataatgtttattttaatttttatttttttgatataaggtatttaattagatagataatagatttttatttttaaatttaatatttttggtagttttgggtagtattttttggagggaaattaataaattaaattttaattagtatttattgagtatttgttaatatagatgttatggtagggaaaggttatgggtgaaggaatgatagaggtttatgagatattgttgttgatttaaagaaatttttatgtagaatagatgtatataagatatatgtacgtatatatatatatattaatttaaatatatcgttatatataaataaataaaaagtttattatcgttgagtttggttagtttataaatggttggtttgagtggaaagattaatgagaattatagtatttttggtttgtagatgtttttattttgtgttatatagagttagtaaataagtatttaagaataaaagtgagtgaatagatgtagtttttttttgaagtatatttgaattttgtgttttgtttatttggaggagagagatgagtgaggattttgttaggatagataaatataaattattgttttataattttttattttttggaataattttaattaatattttttttgttattataaaagataattttttgttgggagttagttatgtaattagtgagaaatttttaagtagtgatttggatttgttatagagaaaaaaaaaaaaaaaaaaaaaaaaaaaatagaagaagtagttagaggatgataaatatagggtatggtattttgtgttatgtttaggaagtaggttggagttgagatagattgaatattatgggatttatataatatttaattgtaataagtttttattgtatgattttagggagaggagaagtatggtttattttttaaaagattattttaagtaattttatagagagtagattatagggaggttagttgggaggtttggattatagtagtagtggaaatatggggtaaagtggttggatttgggatattttgaagttagattttaaatattttgttaatagattggatattaatggagagaagaaggataattagtaatttttgttttgtgtttgattaattgagcgaatgttagttttattttttgaaatgatttttaaagagatagaggaagaggtaaaatgttttgtataaaatgttaaggttatattttgtattttatatttttaaaatagaattaatttggttaaaaatgattatgtttaatggagtgagttagattaatttgtataattttaagataatttgaatatttatttgttattttttttttggttggaggttattgttggtggtggtagtttgatagaaaaaatgtagattttttggttaattatgagaaggaaaaatttgatatagaaaaaatttggtttattgagtgatttttagaaatggaaggtatttttatttttttaaaatgtgaatttatatttgttttttgtttattattgaatgagattggatagtttttgagaggaaatgataaaaaattatttttatttttatggggttttttttttgaagttatttcggaagttatttattgtgaattttgattttatagtaggagaaaattgagttattataaatattaaatgaattttaaaaagattttatatatttaattagttagtatagattttgagtttaagagatttcggtagggttttttcgttgttttgtttgtgtgtgtgtgtgtgtgtgtgtgtgtgtgtgtgtgtgtgtgtgtgtgttttttttattatgatatagaaaattataattattatttataaaattaaaaatttttagtgtatagttatgttaagtgtaataaattaatattaagtattaaaattattaaatgaatttgtgtggatttaaataaaggtttttataatataaatgaaatgttttgtttattttgttttgagtatttttaattatatagttattttgagagggtttagcgaaatgtttttgatatttaaatggtttttgaaatattgattatattgtttataataatagtttgtattgtatgtattaagtattttttttttttttttttttttttttttttgagatggagtttggttgttatttaggttggagtgtagtggcgttattttggtttattgtaattttagttttttgggtttaagtaatttttttgttttagttttttgagtagttgagattataggtgtatattattacgtttagataatttgtgtagagatggggttttattatattggttaggttggtttcgaatttttgattttgtgatttatttatttcggttttttaaaatgtcgggattatagtcgtgaattatcgtgtttagttgtattaagtatttttatagttatttttttgttgtatatttatagtaattttatgaatttggtattattattattttattttaaaaaatgtataaatttaggttgagaggaaagataattgttttaaattataagaaggtaagtagtttatttaggatttaaattttagttaggttgatattaattttatgttgttgtttatttttttttgtaattttagtagttagtaatttaataaaagtattataattatgtgattaaatttttatagaaagtggaatatattataatgaagatagagaggtattaggtaagaaatagaaaatgtttaagtaaaaattttaaaaagtgttataagatatataaattattttaatttttttatatataaattgtaagaattattattagtatatatttttgaaaattttagtaatttgattttttgttatattatatattatatgtaatgaaatatggtgtattataaaatgtataagatataagtttaatttatgttttaaaggatagttataattttttttattgaatataattttgatagagtttttttgggttaagtttttgattataatatatgtattttaaaatataatatagattttttatattggtttgattgttaaaatattttttaaattaaaatatgtaaaatttgagtaatttttttttgttttttttaaatgtttttgttaaagttttagtgtgttaggttaaaggatatttataatgatatgaaaagttttaatatatgtttttgtagtttatgatatttgtttaaggattttttttttagaatataatataattttaagatgtattaatatgttttaaaggttatatttgtaaaaatttaaaatataatttaattttaaatttttttatttttttattttttatatttttttttgttagtttattattttgtagattaaaaatttgtaatggttttttattgtttttaaattaaatatgtaataatagttattaattattggaatatttgttgtgtattgggttttttagtatattattttttatttttttaattatttgttatatatagagataggaaaattggagtatagggagttgattttgaaatttatgtttatttgatttgaaaattttgtattttttttattagaaatgatggtattttttatttagtaaatgtttattatgttttaggtattatatttaggagtttgggtttaaattttagttttattatttttaatttatgtatttttgggattattatttaaattttttttgttttagtttttttatttataaaattaggtaaataataataataagagtattttatagggttattgggaggataaaatgaataatttatataaagaatttagtatataatttagtaaatataaatacgtattagttattattatttttattaggaaatattttagatatataaaaatttataatgataataaatattaaagttataacgaaatttaaaggatagaatattataaatataattggagtatatgttattttgtagtttagtatttattttttttgtgtatgtttttgtttttttattatagatgtgtatattattttatagatgtttaaattataaagtaatatatagaaatatttttaaattttttaatggatgagattaattgtattttttttgtaatttgttttttatgataaatatgacgtttgtaaaatttattataattgataaatgaggttttagtttatttatttttattgttatgtattatttatgaatgaaattgtagtgaaattagaataagtttattgtaggaatgaaattatagtttatttatttacgttattattgatgtatatttaggtgtgttttaaaatttatattattttataaattgttatagtataataaatgatgataaaaataatataaaatattttttaatgtttattttttaggtaatgatttatatatgttgaattatttaattttataaaattttataggaagaattattattatttataatgtatagatgaagaaagtgggttaatttgatatatttggtatatggtgtttttggaaataaaaataaggtaattaggttaagatgtagttgttttgattatatgtgtttttgggtatacgtatatataagagtgttttaggattagttttttattttgtttgtatattaggattatttggatatttaaatataatgatttatgtttaaatttttttttagataaattgatttaaaatagttggggattaagtttagatataaatattgtttaatttgatttttaattaaattttttgttttgagataattgtaaatttgtatgttgttgtaatattatttattatttatttagtttgttttagggatattattttgtaaaattatagtaaaatattatatttaggattgatattaatatagttaagattttgaatatttttgttattataatgattttttttgttgtttatttgtatttatatttattttttttttgtttattttttttttaattttttataattagtaattggttttatatttttgtaattttgttattttaggaatgttataatattttatataaatggaaagttaattttaaaaggttgtatattatataatggaattttattatataggattatattataggattttattatatagtgtgggattttattatataggattttattatatatatttttttgggattgattttttttaatttattaaaattttttgtagatttatttaggttgttgtatgtataaatattttattttttttatagtttatagtagattatggtatgtaagtattatagttggtttaaatatttatttgttgaaggatatttggattgtttttaggtttttttggttattaaatataagtttttatgaatatttatttataagtttttgtttgaatgtatgtttgtatttttttggaataaatattaaggaatgtaattattaggttatattatattttgatttatttttgttttttaagtaaattgtgttaattggttaatatttttttttttgattatatttaaaggttaaaaagttagtgtttattttaaggtaatattattttttatttttaataatgattttattattaatatttttaattttgatatgaatattatttttaagaaattggagattataaaatagttataggttaaatattgttgatattatttagtaaaagttaaaaaaaaaaaatttagaaaatagtttaaggttttttaatttatagagtattttataaggaaattaatatttgtatgtaattattttattagttttgtttattagatacggtatgtgagaaagaaaatattttaagtgtttaaatatttttaaaattaaatttaaaaaagtatatttttttaatgagatgtttattgatttgaaattaaagtaataagaatgttttgaagaaaatatatttaataatttgtatagtaaagtgaatatagtgttttatttaaattttatagaattttatgaaaaaattaattaagtaagattggatgatatttatattttagaggtatgttttttatttattggaaatttgattaaattattaatatgattatttttatttttagatatttttaggatattagagttaatgaatataatgttttattaaggagaatatgtttaaataattatagaaattaaatattttattttattattatttaaaaagttgtatgtgtttatttttatattaaaatattttttattaaatatatatgtatatataataattttttttattagttttgtttttttttattttttgtaattagaaatttttttgtttttttgagatagaaatataattgtgtatttgttggataaatattattttttttttttaataaaattttttgatagaagagttttatgttggtattattttaatgaatttaatatatttattaaagaagtggtaagtttaataatatatttgtttttgtgtattatttttttttaaattttgggttatttgtttttgtatattgttttaaaatttaggtatttaagtgtgttattttttattgtaattaattatttggttttgagttgttttaagaattgaatttcgttaaaataattgtgagtatgaatttttttgtttgtgagttttttgaataagttggtatatttttttttcgataattgttattatttgataatttgttattatagttagattaatattaagatttaagtatttaattttgggtttagtgaaggttaggtatatttagatagttttttatagaaaagtttgaagttaatattttgagtttttttgaattgtatttaataatttttaggttaaaattttaaatggtagaattaaataaatagatttatggtataggttttgagagatgagtaattggagaaagaggtttagatgagattattttttttgaaagtattagtttttattgttatggaggaaagaagatttagatgaatatttatataatttagttttttgtattgtatattatagaaagtttatagagaattttttgggagagtgagttagaaattaaaattaatttgggataatatattatttatttttatattggaatgatttttaaatcgtttatttttattgttgttaatgatataagttttttttatgtaatagtttttgaattaaattaagaaaaggtataaatatattgatgaggtttatataatttatgtttaaataattagaataaattattaatggtatttaaaatattttaaaatgtttgttattttaatttgttttttttatattattttatatgtttgtttttttgatatttattttttttgttgttttatttaattataattaggattaaagtttgggaaattgagaagtgatttaaatttattataggtaattatttttttatttttgtttatttgtttttgtaaattttttttttattatttgatgtttaatatattgaagtttttattttgttatttttattttttttttttttattaaagaaatagttttttttttttttttttttttttttttttttttgagatagagttttgtttttgttgtttaggttggagtgtaatggtacgattttggtttatagtaatttttattttttgggttgaagcgatttttttgttttagtttttcgagtagttgggattataggtatgtattattaagttcggttaatgttgtatttttagtagagataaagtttttttatgtttgttaggttggtttcgaatttttgattttaggtgatcgtcggttttagttttttaaagtggtgggattataggcgtgagttattgtatttagttaagaaataattaaaaaaaaaaaaagaattttgttttttgattatttatagtaagttataaatagtttataaaattattaaatatatataaaaataaattatattttataaagagggtaaaatggtttagatttaatatatagaaagtaagttaattttttttttaattataaatgattgatatgtttaattagttttattatttttaaaaaaatcggagtttattatttagaatttatatgaggaaaagtttagataaaaatggtaaatttaaattatttacgtaagatttttatgaatgggtgtgatagtttattatgtgtaatgttattgaattagtagttgtaaaatttttgtttattttttattttttgattttttttaggaagtaataatatatttttgtaatttaatagttatcgttatgattttcgaaataggggtttattagagtattttatattttttgagtgatatttaatttttttattttttagattttaatattttgttttatgaaagaattaaagtaagaaatttaagatatgaaaaaatatttatttttaaaggaagagattattttagttgttcgaaggtttatatgtttaatgtattttttatttgttaatgagatttgtttatattatatagtttttaattagttgttttgaattaattttttatagtttatataaaattataatattataaaaataaaattaatacgattgaggagtttgaagggtagcgaggttatatattttagttttggtttatttagagattgattaataggttgtgttttggagttggtttatgtgtaagaattaaattaatgttatggttttttatgttgaaattttaaggtattatgatgattttaattatatatattaaatttattaaatattataaatagtatattttattgtttttttatagaatattggttggtagtttttttcgaaaattagttatttattagaattttatttattatttttttaaaggattttttaatattttttttatagttaagtaaaggttatttttttggtatgtgttttttaaagttttttagtttatttaaatattttaagaaaataataaagattttgtttttttaagtaatattagatataaaattttttaaagagaaataaattgagtattttatgttgaattaagaatgttttttttttttttttttttttatatgttatgtaaaatgagttaaatgatggggattaggaatgagaaaaagaaaattaagaaaggagtgagataaaaattaagggtttagtattatattatttaaaaataagatatgtgttaggtagtaaggagggagattatagaaattaattgaaggttgaaataaaaatatgtatagatttgtttttgattttttatgtataggaggaaattatggttttttgtgagaagataggttatgaagtttatagagatacgtaaattttttgttataattaattttatttgtgttatgatttttgttttttgtgaaattttatgtttttgttttttttttttgttgggtatttagaaatttgtattaagataaagaaaaaataggtaatttattaaaagtaagaaattcgtagtgattattgtatgttatatgaaaataaatagtattgttttattaaataagttgaataaagattgtgaaaaatgtttgtagtaatatttttgttttaagaattttagtgttaattgttgtaaggaatataaaatggtgtaatatagagtgtatttttaaggaataaatttatttgaggtgacgtaaagttataaataatgtaaatattatataataaaaagtaaaaagtagattagtaataaggaaaaggtagattatatagtggatatatattatgagtgtatttatttatttaataattattttttgattgttagtaaatttaaaattagttagattttagagatttaaagattattgtgaattggataatttaggaaatttgagtaagaggatttttttttagtaagtttttatgtacgtttgaaggggatgtaggagaatatttttttttaagtggatgtaaatacgtttgttgagtaaatggttataaagaaaataataaagttattaagtttttaggatataatgataaatatttttgtttgtaatgttaagtataaatatatttttgtttaaatgatatagaagtgagaatgttagaaaggagagattttaattattatttaaaatatttgttattggtgttatgtgtaaaaagaaattttatttttaagtaagtagatgatgtagtaaaagattgtgcgttatttagtatttttttgataataagtgttagagaatttagttaaagttgattaagaaaagaataggtttgtattgatatatacgattgaaaagtttagaagtaaatatggttgtacgaatattttggaatatagatgatttaattaggaatttgtttttattttttttttgattttattttttttttaggttttatgatatttttttttttagttttaggtttatatttttaaagtatttagttcggtagaaaagagagggaaattttggtttgtttttgagtaaagttattgtgttttatgtttggaatttttaaggttagaagtttattttttagttaattattggggttaaaacgatggaattatatagatttattcgtagtagattataaatttattttttattttttgtgaatagaagaatttagtaatttagtgttataattggataagtatagaatttatgtgtttttatatatatttatatagaatgagaatggaggaagtttattttttagagaataattgttgtattggaaataagtgtaatgtagaagttttgtaaatttatttaaatatttattttagggtgttgtataatagtattatgttgaaagggttggatgaaagaatatttggagagagaatgaatacgtattatggttataaattgtgtgaatttgagttatatatataaattggaatggaaagggtgatatttatgtgtaaaattttttgaagaatgatttggtagagtttggtgattgtttattagtttatttaatagtagatgtttttatagttatatatattagggttatattatggttagaggtttttaaatttttgtaagttatagtatttttaatttttcggttatttttgtatggtatttttttattaaaataaatgattaagaaatatatttaataaatattgattattttagtaggtttttattttgggtattatagttatagttattgatttataaaaatgtgttattattttttaagaaggattagaaaatggaaaatagataagggttttgtagttattagtttagtaatattatatataaaagattattatatttatttatgtagatttcgagtaggtgatttgggtttatcgttttgtttaaatttttttttatgtgagttttggataatggattttgatttaaaaaatgataaaattgattttatatattagttatgtgtagttggagaagaaattgatttgttttttatatgttaattttagattattttgttttttttgtaaaatgtgatttgtttttgtatatgtttagtgatttaatatgttatttataatttattgtgagtgattagagaatagcgtttttaaaaaattggtttttttggtggggaaggaagagatgaagataggaggatgggggttttaataggtattagatgttgaggggaaggagtatagggattgataggtagaagtagaaaaagaattttttgtaataaatttgggttattttttagttttttaagtattaattttgattatgattggataaggtaataaaagaagtattaggaaaataggtaggtatatggaatgatatagagagaataagttgaattaataagtattttggaatattttaaatgttattagtgatttgttttgattatttagatatgggttaaatatattttattagtatatttatgtttttttttagtttgatttagagattgttatatagaagaaatatgtgttattaataaaaataaaagtagatgatttgaaagttattttagtatgaaaataaatgatatattgttttagattgattttggtttttgatttatttttttagagagttttttgtaaattttttgtaatatgaaatatagaaaattgagttatatgaatatttatttagataattttttttttaagataataggaattagtatttttagaggaaataattttatttggattttttttttttgttgtttattttttaggatttatgttatgtttaattatatgatagagttgaaaatagtagtttatttttattaagtttatttggtgtattttttaagtttaatatgagtattaatatttatgtatatatagttttttattgtaatgttttgaatttaatatattttatatttagtataagtaaaatagtttataatagtaaagattttttaaaattatttttttttttatttgttttgtatatatgaagttttgatttttatattttagtttttttgtggttttattatttgaattgtatatttgatttatttgagtaaatttttttataagttagaatatttaagatgtatttgatcgttttttagtaattattttagaatatttatttattattgattttatgttttgtataatatatatgtttttaattaggttatgtgttataattatttgaagatttttttaagtttaaattttaattaagtttgattttaaatagaataattagagttttgaattaggggaggggtatgtttttagatttttaggtgattttaatttgtatttatggttgagaatgatttaatttaagtaatgtttttttaagttaaatgtattttttagttatttgttgattatttttggtattgagaaaaatgaggatgatatagttatggtgtttgtttttttttagtttatatttttgttaattaaaaatattatgaaagttatataattgtgatagagaaatgtaaatgtatttttttaaatttaaagtataagcgttataatattttaaaggaaataagaaaattttagtgatttttgaattgatattttttttttttttttttagttgtttgttatttagtttatatggtttagttataggataagagaaaagtttttaagtattttttatagatgtgaatgtttgatataaaaaaaagatattttggtttaaagaatgttgttaggaaatatagtttgaagatgaatttttttatagagttgttttttattttgtaataagaaagtgtggtggtagtatgtttttatttaaaagtaaaaaaataatttattaattgtgtatttagagggaatttgttataggtttatttaaaatttatttggaaatagttttggtttattatatgtattataatttttaggaatttttttgttttttaattggtgtaaggataaagttgtgagtatataatattttgtttaaataattattataagagaaatgtatttaaatataataatgaatttatgttaatttttgttttaatagtaatttttattaaagtaatatattttttattataggaaaatgtggatatataaaaaatatgttaagataataaggattgtttataatgttatttaagagaaataattatgttttggtgttatttatgttttattttttttaaatatttaaggtatgttggttaattgttgttataggtttgttttgatatattgttatttagtaagtaaaatagtttaatttatttatatttattataattttttatgtattttgatgtatttttaaaattttattttatgtttttttaattatttatttttttttttttttttattttttgttttttatttgattagtttatgtattatgtattattgaggttataatatttaatatttagttttgtatttttatataatttagtataagttttttttgattttgattattataaagtatttgaaagtgtaattttaaggtttttttaatatttttattatattgttttattatatgtaaatatattaaattatttaattagaatagatttttttatgaggaattattgtattaaagtatttgaatatttttaagatatttgatgtatattattaaattattttttgaaaatgttgttttagttattattttttgtagtagtataggaaaatattaattattgtatttatataaatatcgagtattgttaattttaatgttgtgtaaattttattaaataaaatatatatatagtattaagttgtattttttatttatatgttatatatgtatgtttatttatgtaagtttagtatgttttttatttattagtttattagtattataatagttttttatatattaattgttgtgagttttttatagttatgtttgtaatttttttgaagtttttttttaatttatattttgtttttaaaatttatttataatttttatatatataatttaaatttttttttttgtatttttttatatttagggagttggtgtatttattttttttttaagtttttgtaagttaatttgatttttatattttgatttttaatttatttgagtttttgttgatatatgaagtgagattagaatgtttattgatttttttttagttatttagttgttttagtgttttttattgagtcgtattttatatttttatttgttagtatttttataaatagaggatgtaagtaatataaatgtaagtttggtttaaattttaattttattatttattagtattagaaatattataattttgggtaaattgtttaatttatatgatttaggtgttttatttttaaaatggatataaagaagaatttatatgaaggtttttgtgaggggtgagataatatatgtaaggtgtttggtatataataaatgtttagaaaatgttagtttttatagaatttgtttgttttgtaaagaatattattttttatgaagtttttattatgatttttaattggtgggattatagttattttattagttttgagaaataatttggtagagtatttaagtatatggattttagagttaaattgtttggttgtgaattttaatatgtttattagttaattgtgtgattttagttattttatatttttgtgttttaatttttttatttgtaaaattgagatatttatagtatttattatagagattttttgtgagaattttaatgagaattaaatgtatttatagtggttagtagtaagtgttatgtatgtattagttataatttgttttaaaatagttttaatgttttttttaaatattttttttttttaataaatttgagatttatttttttaagtgtagagaaattttatttgtgttttgattgaaagtatgttattttggaaaattttaagaatattgagttttgttattaggagttggtatagttttttaatttgttaatgttttttttaagtttattaataaatatttatagttttttattttttgtattgattattaaaagtatttttaggttattaatcgtgtgtttgttaatattgtaggttgaggttttattttttttatttttaagtagatattgttagtataaaagaaaattatagtttagtttatatttattttttgtttagttattttgttgaatttttaatgtttatattttatttaaatttattttttttgatattttggtttataattatatcgtatgtaaaataatagttttgtatttttttttttgattgttgtaaatataatttttgttttattttgaattatatttgtttaagttttaaaatagtgttaaattttgtgtttttagtatggtagaagatattgggataaaaaatagattagatagcgatgggttttgtttttatagtgttttaaatttatttttatggatttaatataatattgatttattaaattttgtgtgttggtttgtattatttaggggagatgttatataatttttattagattattaaaagggtttatggttgtaaaagttaagagttttttatcgtagattttggatattagttttttgttagaggagtaggttgtaaaaatttttttttattttgtaggttgtttgtttattttgatggtagttttttttgttgtgtagaagttttttagtttaattagattttatttgttaattttggtttttgttgttattgtttttggtgttttagatatgaagttattgtttatgtttatgttttgaatggtattgtttaggtttttttttagggtttttatggttttaggtttaatatgtaagtttttaatttattttgaattaatttttgtataaggtgtaaggaagggatttagttttagttttttatatatggttagttagtttttttagtattatttattaaatagggaattttttttttattgtttgttttttttaggtttgttaaagattagatagttgtagatatgtggtattaattttgagggttttgttttgttttattgatttatatttttgttttggtattagtattatgttgttttggttattgtagttttgtagtgtagtttgaagttaggtagcgtgatgtttttggttttgtttttttggtttaggattgatttggtaatgtaggtttttttttggttttatatgaattttaaagtagttttttttaattttgtgaagaaagttattggtagtttgatggggatggtattgaatttataaattattttgggtagtatggttatttttacgatattgattttttttatttatgagtatggaatgtttttttatttgtttgtatttttttttattttattgagtagtggtttgtagttttttttgaagaggttttttatgttttttgtaagttggatttttagaatttataagaaaaaaataaaaaattttattaaaaagtgggcgaaggatgtgaatagatattttttaaaagaagatatttatgtagttaaaaaatatatgaaaaaatgttcgtcgttattggttattagagatatgtaaattaaaattataatgagatattattttatattatttagaatggcgattattaaaaagttaggaaataataggtgttggagaggatgtggagaaataggaatatttttatattgttggtgggattgtaaattagtttaatttttgtggaagttagtgtggtaattttttagggatttagaattagaaatattatttgatttagttattttattattgggtatatatttaaaggattataaattatgttgttataaagatatatgtatacgtatgtttattgtagtattatttataatagtaaagatttggaattaatttaaatgtttaataacgatagattggattaagaaaatgtggcgcgtatatattatggaatattatgtagttataaaaaatgatgagtttatgttttttgtggggatatggatgaaattggaaattattatttttagtaaattatcgtaaggataaaaaattaaatattgtatgtttttatttataggtgggaattgaataatgagaatacgtggatataggaaggggaatattatattttggggattgttgtggggtggggggagggaggagggatagtattaggagatatatttaatgttaaatgacgagttaatgggtgtagtatattaatatggtatatgtatatatatgtaataaatttgtatattgtgtatatgtattttgaaatttaaagtataataataataataaagagttttttattttaatttatagtgataaattagttttattaataattcgattaatttttgtgatgatttatatgtttttatttattgttacggattttttaaaattttaaaataattgtgatagtgttatttatttttttatacgtgtattttatatatatttttaattatttatatttttaaaaaataataattaattttttatagagaaatgttaaaatatgtcgaaaataaaaagattttaggtatattaatttatatttttaagagttttattttgagtgtttaaaagtagtattggaaatataatttagtttgtaattatggtttggttatttatggtttttgtaaatataaatataaatatagatatggtttataattttaatttgttttagattttcgattataacgtaaagaaatgtgattaataataataataaaaaaaggaagtatatagaatttggtttttttttgttaggaattaatttttttgtggattgtagaaatattggggaaagatagttgattggtaggaaagatagtaaggtgtttattgggtttgatagagagattacgggtttattttattagtttaataaatagagttaagagtttaataagttgggtggttttttataaataaaataagtttgagagttgtagtaaaaggaagagatttttttttttgatttagtatttaggagataattatttaaaggagggatatttatgtaaagaatatagttttgtttttttttttgttattcggtttattttatagcgttttgttagtgggcgtttaggtttgtgttagggatgcgttttatggagttagttagtagaaattttttgaaagtattttgattgaagttgtaaaaagttgaattatttgaaaatttttttttaggttattttttgtaagggttaaatttgttgttttgggaaatttattttttatttgtatatttgtatttatagtgggagggagattttttaataggttggtgagaagtagttgggtttataattaaaattattgttttttattaattagattttagttataatgttgagtggaaaaaataaagatgggggatgtgataagtgattagaaagaaaataaaataaaattgttaagagttaaatatagtggtttagtttgaatggaattgaaggaaagaaaaggggtaattggaatgttattgtttttttttttagtttttttaatttatttttttatatattttgtataaatattaagtaatttttttagataagtggtatagttataatttttaaaataatttgttaatttatacgtttaggaatttaaaaattgtttattaagtattttttatgtgataggtgttgtggtaggttttcgggtttttgaagttttaaattaatgggagagttagatattgagaattatttaattataaaatgtaatatttatttttaaagaagggtagaaatggtataaattttaatgtattattatgagtattaaaaaaagataatttatataaagaattggtagtgatcgtggtagtttatttattatatgtattttagtgatgagaagaattatgaagacgagtattatgttgaggatgaagatgttaggggataggtattgttatttattattattggtaagttgtttgatttttttaaattttatttttcgatgtgttagttggagttaataatagttatttatacgtaattttgaagattaaaggtatttgtgaattatcggtatttgaaatagtgggtgttttataattgagttattttttttattagatttttatttatgcgatattaatttttaatattatatggatattattaataaaaaagaaatatagatatatgagtggtatattttgagaataatattagatatggattatttttaaggttatttttaaatagagcgaatattattttttttgtgattttttattgtattttatttttttttataattttgttattttttaatagattttaagagttttaggtttatagtaaagttgagtagaaataatagcgagtttttatatattttttgtttttttatatatagttttttttattgttaatatttcgtattaaagtggtatagttgttaaaatcgatgaattcgtattgatatattattattaattgaagtttttagtttatattagggttatttttgttgttgtatattttatggatttgtatgaatttataatgatagtattatatagaatagttttattgttttaaaaattttttgtgttattgtattttagttttgtgatttttttatttatttttttttttttgttaatttttaggaaatattgattattttattgtttttgtggtgttgttttttttagaatgttatatagttgaaattatatagtatatagtttttttatattgaatttttttatttagtaatatgtatttaagtttttttaatatatttttttggtttgatagtttatttttttttagtgttaaataatattttatggtttcgttgtattataggttatttattgatttttttattaaaggatgggttttaatttttggtaattattaattaaggtgttataaatatttttgtgttagtttttgtattgatatatatttttaatttttttgtgtaaatattaaggagtgtgattgttggattatatggtaagaatatgtttaattttgttagaaattgttaaattgtttttttaagtggttgaattattttgtatttttattagtagtaaacgagagtttttgtttttttatattaaatgttagtgaggatatggaatagtaggaattaataatatttggtgttagatttttgttatttgaattggtatgtagtgatatttttttattattttaatgtgtaattttttgatgatatatgatgttgagtatttttttatatattgatttgttatttgtttattttttttggtgagatgtttttttaggaattttgatcgttttttagttgagttgtttgtatttttatttttaagttttaagaatttttgtatattttggataatatttttttattagatgtttttataaatatttgtttttgtttatggtttgtttttttttttttttgatcgtgttttttgtagagtaggaattttaaattttaatgaagttttgttttgtaattttggtttttatggattttgtttttattgttatattaaagaagtttggattttgtttttattgttatattaaagaagttatttttatatttatttttttttaggttattttgtaggagttttatagttttgtattttaaatttaggtttttgatttattttgagttagtttttgtgaagagtgtaaggtacgtagttaaattttttttgttgttgcgtatggatgtttagttattttaatataatttgttgaaatgattgttttttaattaaattgtttttgtttttttgttaaaagttagttgattatttttatatgattttatatttgaattttttattttgttttattgatttatgtatttgtattttttattagtattatagtattttggtgattatagttttatagtttttatggttttaagttttgaggttggatagtgttcgttttttagttttgttttttttttttaatattttgttgattattttgtttttttatgtaaattttagaattattgttaatgtaaataaaataatttgttgtagttttgattggaattgtattgaatttgtagattaagttgggtagaattgatattttgataattttgaattttttttattatgtttttatttttgtgttttatttaaatatttgtttaaggaaagaataatttgaatttttttatattagagttttgtttaaaacgtttattttttttgttatttttagttttggttaaataattagttggttgtgaaggttgagtaaagatttattattaagaatttgtattgtgagtttgtttgaaggtgaatgatgtatagattggatgcgaatagtaaaaagtgataagaaagatatagttatagtggaaatgagttttttttagggtttaaaatttgttattttgtatattttttaaagtgttgtttttaatggattttgtttgtttgtttgtttcgtaaaataatatgtgtattttagatgaatttaggaagttttttattttaagaaaaatattaaattttagttatattagaatttttttatgagaggttgtattaggttattgatttttattaaaataaaaatattaattatagaaaataaaatggaattatttttaaagaaggagatataataagaagagatgaaaaattatagttaaataattattattattggtatatcggaaatagtatttgatttagttaagatattgtgtttcgataggaatgttaattatgttttaggatataatttgtttaaaaattatatatttatagttttcggaagggaagtttatttttgtaagggtaagagatttgaaatttgaaattttgtaatttttttgttgatagggttggagggtgatttgttaatattttattatataatgtatgttaagagaaatgtaaaggttaaaatatggtgttttttgtttttgttggagtgtttagttagagagatttagtttagtataatattaattattataaattttttttcgaaatttaagatatattaattaaaataaatggaatttaagaaaaatgaaaattggggggggtgaataaataaatatatgattgagttgaaaatataaaaatatttattaaaatattaaaaatattaaatagaaatattttgatgtaatgatttttgatatagtttaaatttaaataaagaatgtatggttatataaaatgtaagtaagtatattattttttatttaaagttttttagttaaatgtaaaatttttttttttattttaattaggtagataattatattattttgtatagttatgttaggagtttaatttttaagttaaattaaaattatttaaaatgttaatgatagtttaaaatttaagaatagaaatttggatatattaaatttaaaattgatgttttattgaaaaaaattaaatgtttttaaattgttataataaattttatatgtttaaaattagttaataaaaataaaagaggataaatttttgtattttttaatttttaaatttttaatatttttattttaagaaattgtagttattgtagtgatatttttttaattttgaaaatatttaggaagtaattttttttaaatgttttattttggtaggaattttagattataagttaaaggtattttttttaaatttgtaaagaaagtaaataatttattaagagaataaatagtttttaatagatatagtttttattgttttttttttttattttgttttttttagttagagagttatgataaaggaaaaataaaataattttagatttatatttttgttgtttttttttttttttttttattttgtttattgtataaaataaattgattaggaggtttttttgttgggttttaaatattattaatatgtagatgatttttaagtagttattttttatttttgtttgatttttaaattttggttttatttatttaaatgtttatttagtatttttatttgaatgtttaatgggaaatttaaatataatacgtttaaaattaaattattggttaatttatttttttattaaaatttaagtttttttttgttgaatagtaatatttttatattttaatagttattttaaaaggtaaatatttatttttgaattttttttttttttttattgtttgttttaatatttttataggtattaagtagttaatgtttattttttattggtttatattttttttgaagttaagaattatattttttggatttgttaaatttttaggatttttaaagattttaaaataaataaaattatttatataatagtttttttatttgttaagtaaatgattatttttatatatttatattgtaagtgatattggtattttattgtattgaagaagttattagattttgaaagataagttttattgtatttttttttttaattgttaaaatttatagtagatatatatgaagagtgaatgttgatttaaattgtgaattttagttaataataatgtattaatattagtttattaattgtaataaatcgattatagtaacgtaaaatgttaatggagaaattatataggagagaagggatatatggaaattttttgtattttttgtttaattttttttaagtttaaaattgttttgaaaataatatataaaatatgttatagaaaaaatattttttttattttatgttattgtatttttaagatatttagagatttattttttttttagtttttaatgttttgttttttaatatttaattttttatttaatattttatttattagttgagtatattttatttttttttttataagtgaaaatagataatatataatgttggttttatgaagatttatgaagaaattaattttatgaaataaaaatatttttgaatgagtttattataattgagtggggaatttgagtgttatttttagagaatttggtttatataaatttagttttggtagttagttattaggggtttttgaattggtatatttgagaagtgttttaattttttagtggaataaagaagaggggaaagaatattatagaatgatttttttttttaataaatttttatataaaagggttttgaaagtttggttttaaggtaattttagaaatagattttaaagattgcgatttaagtttttgtgttatagtaagtttaagttttataaagtgttaaattgatgattagttatatggaagtttttatttataatagtatagtttatttttatattatttttaatttgtaaaggtgtttttatatattattttatttggtatttatagttattttgggaaaattgtagaatagatgttaatttttaaatagataattataattttataaagtaaagaaaaagaaatgtatggaagtatttttagtttaattttattagtttattttttattgttttaaaatatttgtaattaggtaagttataaagataagaaatttattttttatagttatggaggttgagaagtttaaggttgaggggttatatttggtgagagtttttttgttggtggggatttcgtagagttttgtggtagtagtaatatagggcgttatgtggtgaagggattgcgtgtgttcgggtgtttgtttaggtttttttttttttttttgtagagttattaggtttatttttatgataatttatgaatttattaatttatgaatggattaaaatttaattatttttttaaggttttttttttaaatattgttatgttagggaatgtttttaatatatgaaatttgggggatataagaaaattatagtattaatgttaattatttaatagtaatttttgtgttttaagattttttttttttttttttttgagacggagtttggttttgtcgtttaggttggagtgtagtggcgcgattttggtttattgtaagtttcgtttttcgggtttacgttatttttttgttttagtttttcgagtagttgggattataggcggttgttattatgtttagttaatttttttttttttgtatttttttagtagagacggggttttatcgtgttagttaagatggtttcgattttttgatttcgtgattcgttcgtttcgattttttaaagtgttgggattataggcgtgagttatcgtgttcggtcgttttaagattttttaatgaaggtagttgtatcgatgtttataggtgttttttttttaattattagttttattttaagatatttaaattttttgaatatatatatatttatatgttgatatatatatgttgatatatgtttatatttatgtatatgtatttattaattatatattgtgtaaagtatttaagttttaataggaatataaagatatgtataaggtatgttttttttttttttttttttagaaatttatagtatagttaggggtaaagagaaatgattataggtattttatatatattttttatataatttttagaagtatgtattatattattatttttattgtataaatattgaaatgatttgtttaaatttattgagttatgtgtattatttttgattagatttatagtttgtatttttgttttttagttttattgttttttgataatataaatatttaaaatgttatgaatataggtttagattttttaggatagttttatagttggttattgtgttttatttattgtttattaagatatattagaaatattaaatttcgataaagaaaatatttttttaaaatattttttttttttaattttttaagttgtttttaaatatattttttttaatttagttttttaatatttaattggaagtggttttgtatttaaaaagtaagtaagaatataataataagatattagtaggtgagataaaggattatttgaagatttttgataagggagaagattttagaggaggaggttgtttgaggagatatttttttataaagataaaatttaatttggattttgaaatagagttgaaatttttatttttttatttataaattgaagttaataatagtagttatattatttgtttagatgaaaattgagttaatatttaggtttttaaaatagagtttgatttagaagttggaagatggagtatatatattttaattattaagttaaatgtttttattttttaatttttattgtttagtataatgtttaatatataaaagtatttaatagataattgttgaatgaatgatgaaatgatagtgtattattggtaaattttgagttagagagtatagtaagagaattatagtttttggaggttaaattgatatttgtattgtttattaagttttagagatttggatatatgttttttataataataaatgtttagattgtttttttttggtggaagggattaaaaggtagatttattaagttttttttaaagtttttgtttaattaggtgttaagtttttgaagtttgagaatttgtttttattgttattattaattggggtttgtatgaagtattttatatagtaggtatttaggaagtattgattgattgataagatttggatttgatataaggaaatagttgtttatatttagggagaataattaaagatattagaaattatagaattatttttttttagatattagtttttgtataatatatatttttttttgtaattttatatgatcggaggtatgtattgatttttgttttattgataaattaattaatatttgatataaattcgaataaaaaggaataaagttttttgtatagtttaagatcgtgttgtggatataagtttgaaattttaatggtttgggggtattaggttaaggtagtttcgtaatttttttagtatttgttttggtaatgaaatttttaaaaggagttagaagagtagagtttttataaattaaagtatttaggattaaatattatgatgatatttttttgtagaattatttaataattttttgtgaaagaaataaaagtttaatatatggtatttaaggtgttatgattttaatatattttttttttttaaatatttttacgagtatatgttttagttatgtttattttttaagggtttttgaatttgatttttattatttttttttttttattgttatttttttttggatttgtttgttaagtatggaataataatttgtttttagtaattttttaataaatatatttaatagattttaatggagtatttttgatgtgttaggtattatgttatatgatgtggggggtatagaaaaaggaatgagataatttgttgttgaggagtttgtaatttagaaattttttttttgaataaatttttttgatttattagtatttatgttattgttataatatgtttggatatggtagatatttaagaaatatgtatgtaataaattaataaataattttaaattattatttatttttttttataggattattttgttatatattttttaaagaaaatgtaatgtattttttggttttcgaacgggttttgaataaaaatagatgtttgtatggttaaattgtataattattgagattaatttatatatgttttaaatataaatatttgaatagttttaattgaattgaagtgaatttaatataaaatttttttatgttttttttagaaatgagggtttaaataattttggtatgaattatttattagtttaagtattgatataatgatttgtatttaatgatttttttatttaaaaaatagaatgttaatgattatattatgtttttaggaggattgtattttttatgttgacgttttttaatttgaatagtagttaataggagttatgagattattagttttattttttttttaggggtggtttcgtgttagaagatatttagaagttttgtgtatttttagatttgtgaagtggaataaatgtttgatattttaataaagatatttagatattgtgtagtatgtagtagtttcgagtattataattttatgtagtagtattaggtagaacgatttagagtggaattttagaaagtatagtggtagtagtgatgaagtttttttattagatgtgggtatttttatagtggagtaaggttatataaagggattattatagtataggaagtttttaaaatttttagggtatattgagtgagtttttggatttggtattatttttttataggttttatttttttatgtttatatgtgagagtaaaagagaaaggagtttgaatattttattttgttgatataggatttttttttgttgtattaaatttaaaattttattttggatttagatatgatttataggtattataaagtatattttttttgtagtagtttattaattttagatcggtttgaattgtagttgagtaataatggtagttaaaatatatttaattaggttattatcgtttaataagatagttttatataaaagttagaaattttttagttattagttaaagtaatatattagaatgttttgtttattatgatatggtaaaatgaattagatgtagatatagaggatatttatttattatgtagattaaatgttatataaaatatattatagatataattttaagagatagattattaaatattatgtattttttaatttttagagatgtgttggttgaacgtgtggttttggaatatatttgtatgtatatagatatttatatattgttttttgtgagtaacgaaaatattttaatttttatttaatatatttattacgataatttttgaattttagtatgtttataaatttttcggaaaatttgattaaaatgaaaatattaagattattttttaagagttgtttagaaatcgattttaataattacgtgttaagtgttgttaatgtaggtggtttttggattatagtttgggaaatattgatttattgttatgaaaaatatgttaattattaaatatgtaaaatattggttttttaaataatttaaagtaaagatagatattaagtattttttaaaaaaattaagtaataaacgataagggatttaaatttgtacggaatagaaatttttgttttgtgttttgttattagttatttgtattagagtaatttatgtaatttttttaagttagtttatttttagaaatggttgttgaggagaaaaaaattttaaggttttgatagatatggatgttaattaagtgttgataggacggtatgtattttatagaataattgattgtttatatttttgtataattggatttataattaaattaattgtttatttatttttgaaatgatgtaatgtaagtagaggaatgtaaaaatagtgaaattttatttgtgatatttatagtatatatttttattgggataatttaagtttatggtgttatataggattataattgttatagttatacgtattttttggaattttaggaaattattatttttaggtggtagtaaaaataggaaggtttatatagatttttgttttatattttgggagtgtgtgtgtgtatggttaggtgttttgtaaagtttgagaaaatgtagaaaagttttgttgattttaaattattttgtttgtggaattgataaggtattaattttatatagttattttgtttagaattataaaatttgatatgttaatggaaaatggagatagtaataatgaataaattaagtgatattattttttgtttattagtaatgttgagaattattgatttaattaatgaataaaagaggtattgttttagtaagtaagatttagaatttataaatgtatttacgagattttatttaattttttttttattagtatattaataagaattagtttattatttaagggtaaagttatattttaggtttggtaaataattgttgtttaaaatattaaatgaatattaaaggaaagataaaatatggtagataggttttagtaggagttgtaaaggatgaggggatgtgaaattgataatcgttttgttgtcgatgatttatatgaagaatttgtgtagaagagattgaagggagttaggtaattaatgggagtattgaaggtgatatagtaattttagatatataaatgtagtaggaagtaataagtatatttgtttaaaattttataagttattaatttgtatattttcgtatttgattttgattaaattttttatatttttagagttgtattgagttaatagggatcgtgtagattgtttaaaaatgtatagttagtaatatagttagggtttgaatttttttattttagatatatttaaattttttatgttttagtagttttttaaaaagatatttaaaattcgtttttgatttagattataaaaaggattttttatatttaaaaattagtatatttttaataacgttaagttagtgttttttaaaatgtggtttagggtttatttaatattatttggggtgtatttgttaattagatagatttttgagtaaatcgtaagataataaggatttttatggaaatagtttaagtatttgattttaattaagttttttaagtaatttgtaggtatattaaagtttaagaattattgtagtaagtgtgttaagtgaaggttggaatgtttgatattttggggatgttatattttatgagatgttttagaatgtgttgtattgttttttttttatgtatacggtatatatatttaagtgataggttgtttgaggggttaaggttgttgttatttgaagattaatgtagttttatttgtttattgaataatatattttattttgataatggaaggatattgtttgtaattatttgtagaaaagggggtattttttttgtgtgtgtattgtattttttggtttagaatagtatggtttttagaaatttttatgaaatgtatttgattattgtaataagttgtttaaatattgttaatgattttatagaaaatggttagatttttgtttatagagtgtaaagaaattagtgtgaggttgatttaaaatatattattagttagttaaagggggttttattatttatatttaaattgtatttaataatttaaaaattaattggagagagataatatttatatgaaagtgtttaattgattttgtattttattgtatagtatttttttttaaaggggtagtaattttaaaatttaaaattagttttatttttagaaaattttatgtattcgttttatgtattttatttttatgtatatatgttgtaaagttttatatttatatatatatatttatatatatgtattatttaaattttataataatatttttagtaggaatttggatttttattttaaagattgatattttagaagatgaagggatttgagtagtagaggaagaattttagatcgagtttgagaggaaattgttttttagttttgaattgtagagtaggagatattggtgtttttttgtttggaataatatgtgtttaatttgaataagtttttgataattttttggaaatagaattttgtagtgaatgttgtttaatattaaattttaggttaaatatttttttaaaaaatgaatttttacgaggttgaaatagaggtataatttatggataaaggtatatttttttgtatttgatgtgttaaaaaattttttttgtaaaagtgatatgattatttgttgatatatatgaatatttttttaatatttttgagatgttttttgttaatgtaaatgattgtttaattattagtgcgatgaaaagttagttttatttgttatgatggaatatatttttattatatagtagtattaaattttttgtaaataatagttgttaatatattgttgaagtattttataataatttatttggattatttagtattagaataaaatatgataagagttagatggaggtttgtttagtagaaaaatgtatatttagatataggatagattttttaaatgagaaaattttagtgttgtttaaaggaaagagggagtaggaagaagaatgataagtagaggaagagagaaggagaaagaaagacgaagatgtgttatattgttttgttttattatattgagaagtgttgttgttttaaaatatgtgtaagagatttagtaaaggatgttggagaatagaaggtgaatttttttggaaattaatagagtgttagtttatgttagggatttattagttatggagatttatagagttgtatgaggttgtgagatgtagtagtagtagtagtagtatttggtataaggtttggttgggtgtataagaggttatagggttttgaaggttgatacgtttagggagttggttagtatagtatggttttaggaataggaatgtatttttagtttttgtttttggtttttttgttattttagttgttgagaagaaataagtttgtttttgtgattggtatatgtttgttagagttgtttttttttttttttttgtttttgttattttattttttgtaatatttttaggtttatggaggttagggggttagttgtgaattattaagtggtgtggttttaagagagaagtagtaggggtagttttttttatattagtaggatgggtttagtttgttgttttttttattgtgttgttgaaggatgtgattagagagttataaatgatgggataattggtgatataatagaatagattattagtagaaaaataaatgtgtgaataatatatgaaagatatttttatattcgaatggtaagaaatttatattataaaataaattatatgttgttgggggatgttttattgttttaatgaaagataaaatattttgaagtgaaggaaaagatagtatggaataatatagagaggtttaaaataatgaaaataattttttattttgattagagtgtatatatttagaattggaaaatagatttttagtaatgtttaataaattatatattttaaaatgtttttaaatattgatatttaaaatatttttttttggagtatatttataaattgtaggaatttttaataaggattaaagttttagtaatagatattttttttttttttttttttttcgtttttttttttttttttgagatggagtttcgttttgtcgtttaggttggagtgtagtggcgcgatttcggtttattgtaagtttcgttttttgggtttacgttatttttttgttttagtttttcgagtagttgggattataggcgtttgttattacgtatagttaattttttgtatttttagtagagatggggttttattgtgttagttaggatggttttaattttttgatttcgtgattcgtttattttggttttttaaagtgttggattataggcgtgagttatttcgtttagttttttttttttttttttttttttttttttttttttttttttttttttttttttttttttttttttttttttttttttttttttttttttttttttttattttttttttttttttttttttttttttttttttttttagagttttattttgttatttaggttggagtatagtggtatgatttttatttattataatttttagtttttgggtttaagtaatttttttgttttagttttttaagtagttgggattataggtgtatgttattatgtttagttaattttttgtatttttattagtgatagggttttattatgttggttaggttggtttcgaatttttgattttaggtgatttatttatttcggttttttaaattgttgggattataggtgtgagttattggatttagattttatttttattttaggaaattaaagtttattttggataggattatagttatgtatatggtttatttattttattatttatttaataattttatattaagtgatttttgtgtgttaggtattagcgttataataatgaataagatatgtattttttgttttggttggtttatagtttaatggaataataaatggttattgaatatttttagttaatattttgtatgtataattttatgtaaattttgtaattgtgttatgaattagatattttttttatattaaaaggtgaagataattaggtttagaggttgagtaatttgtttaaagttgtaagttaaagaatggttgagttaaaattcggtaagatatggttaattttttttgtatatatttatgtattttggtatatgtttttatatattgtggttattattgagaaggaattgttaaattatattttagttttagaaaagttgtttgtattttatttttaatttattgagatattttgttgtatgtggatataattaatttttttttaggtttattttatttttttttagattatttatatagtttatgggtaaatagattaaaatattattgatgtattttattaaaatgaaaaataagaagtaaatttttatagaaattgtttttaattttttatttttatttatttgtttttttttttttttggttagtgttgtttttttgttttttaatagtaatattgtagtagtattttttgtttttaaatgtgaatatttgtgggaaatatttagaatttttaaattataatagtttattattatataaattaagattttattttgttatttaggttggagtatagttaggattatataaattaggatttgtgtaataataataaaattaaaaataaaaataataatatgttatttaagttaatttttataaagttaattgtttgattggtattaaagttttggtatttttatgtgtttgttttttttaattttttttttattaaaatataatttgttttattttgtatgtgtaatttaatgagaaaaattagaaattattaggataaaaaaagtgattaaatttatatttttgtgataaagtttagataggtataattagtgtgtatatattttaaaaatttttatttaagtttatatgtagataacgatgttatgtataattaaaataaaaagttaaaaatttttttatagattatgtaattgatttttttgttttttaaaagaattgttggtcgggtgtaatggtttacgtttgtaattttagtattttgggaggtcgaggcgggcggattacgaggttaggagatcgagattattttaatacggtgaaatttcgtttttattaaaaatataaaaaattagtcgggcgtggtggtgggtgtttgtagttttagttattcgggaggttgaggtaggagaatggcgtgaatttaggaggtggagtttgtagtgagtcgagattgtattattgtattttagattgggcgatagagagagattacgttttaaaagaaaaaaaaattgttttttattttttatttttattaaattgtttatttttttttttgtttaattttgtttaggaaaataaattaataaaaatttaaaattttaggtttatatatattaaaaaggaaaaatatgtttattttggtttatatattattatggtttaggtaaaaattttgtttagtttttgttaaatgttaggatttttgtaaattagggagtatatgtgtttttaaaatttattaaaaaataaatagatttttatatttttttttgatataatagtatggtgtaagtaattagtaggattttaatgttgttgttttaaatatgttcgattatatttatacgttgaatattataatatgtgttttttttttaaaattgttttttatgttttttttttgttttgttttttttgagatggagtttcgtttttgttgtttaggttggagtgtagtggtgtgaagatttcggtttattgtaatttttattttttaggtttaagtgatttttttgttttagttttttgagtagttgggatataggtatgcgttattaagttaggttagttttatatttttagtagagatgggggttttattatgttggttaggttggtttcgaatttttgattttaggtgatttacgagttttagttttttaaagggttgggattataggtgtgagttattgtgtttagtttatgttttattttaatttatgtttttatttaattttatgttatgagattttagttatgttattatatatttttttaaaataatgatttaatgtttttttaagatgaaatttttattgtgttattattgatgagtgttttaatgttttaggttatattatttttaaggtgatttagtaagtagtggttgaggtaggaagttattaaatgatttaaatttaagaatgtaatatttttgtataaggttttgtttatcgtaggaaggtttatttttatcgtgttgtgtttattatggttttagtgaaaatgattaatatttttttacgtttaatagtatataggtttatataattatgttattgtattggtttgtttatatatttgtgtattttttttttgtgaattttttaagagtaagtaaattgtgttttttttttttgagtttttatagttatatgtttagttatagtggtggattttattacggagatgatgaaatttaagtagtagggttttttatttgtatgaggttattttagggttttgggtgaaattttagtagtgtaattatatggtcgtatatgattgtaaaatttttaaaagtaagatattttaattagattgttatatggttttgtattttcgtttatattagtaattttattttttttttgttttgaaagaaggttttttaaatggataattttggttttataaaattttgattgttttttgttgatatgtaaggaatatttatttgttttttttttgaataagtgaaagaagtaaaagggatgaggaggaatgaatattttattaattaatatattgtaatatttaaaattagtatgtttggtaaaaattttttttaagttattaatagaaaatgttaatattattatttttgtgtaatgtttgtgagtttataagtttttatataaatgtaattttaattgaatttttgaattaggtttttcgttaaatgtaatttttaattaaagtgaatgatattaaaatgtttataattgtgttatttgtagaaaagatttattatatttaatggttatagaggaaaagaaatttaaatatatgattgagtgatatttatgattgtattgtgttaatattaggatgttagttgaagttttttgatattgattttagtttttgtattatacggtgtttataaatatatttaaataaatgaaaatttattttataaacgaaaagtataaagttatataggttaataatgttttttttaaatgatgaatatttttaattttttttttttttttttttttttttttttttttttttttttttttttttttttttttttttaattttttttttttttttttttttttttttgatgtaggtgtttaaaattatttaattgttatagagttaaatttttttttggaaaattgaatcgaatttttattgaatataagatgaaaatgtggttgttggttagttattttgtgataatatttattattatttgtttagtaggtaagaaatattttttgtatattttatatatattatgttaatataattgatatgcgtgtttattaaatgtattgtatgaagtaaaaatttttattttttcgatatttgggttagataagtagataaatatgtattaagggtgattttattttttttttaattttaattaagattttataaaatattgttaattttgggtaatagtgtgttggtgaatgtttaaaatttagatttttggggagatttttggagtgtagtatttgtttattattggggagtaaattattttattatggttagttttaatttgatattatttaatgtggaattggaaagatgtgtaatcgtttattagtttgtagtatttttattattttgatataagtaattataatggtaaagagaatataaaatatagtaaataaaagagagaaaataatgggttttaagtatttattttttttgtttttagtataatttatttatttgtaaattaatataatttttaatattggttatgtttaataattgatttataaaatttttgaaaattaataattattttttaagagttataagtagatgtaatatattattgaattttatataatttttttgttaatttgattaatataatttaaaaaatggattaaagtaatttatagtgtgtgtagggatataagattaataaaataattttgagagtatatttattttaggataaagaaatattatatttttgttttttaaaggtaagtgtgaagtatttagatttattttttataatgagaagtatattatatttttatttgaaaaattgatataattatttaattagtatttattgagttaggttatttagtatttattgagttaggttattattatgaaagtattagaaaaattgaattttaataattaatttttttaatatttttatgataatgatttaatttagtagatatttgttgagtgattgttttgtttaagatataaatggtttttatttttttgtatataaatttttattgattattttaatgattaatttgacgggtattattattaagaatataaaaaaatattattttattttggggaataatttttattatgtttattttaaaatttagaaaagattattttattagtatttaaggattttaatgatattgataaatatatattttataattagggtaattatgtatatatatttatatatatagatgtaattatatgtataatatatttatatatatataatgtaaatataataaagaaaaaatttggtaaagttattgtgaagttttatttttgtgaataaaataaaataaaaattattttattattattgaaaatttatacgaattttattgattgtaaatttcggtgttgtaattattaatgtaaagataagaaataagtatttgtatagatgtgaagatattttaatttttatagtaaagggttattatttttattttattgtttagtattttagttatttaagtaatgtttgaaattataatttaaataattgttttaggattaaaattgtttttttttttatttttagagtttatatggtatagaagatatggttatggaggtaagttgattaaagagtagattttgtaaatattttttttttattgaattatattttatttttgttttaaattattaattttttaaattttaaggtaaatggttaatgttagattattatgaaattttgtaaggtggtttttttgagattataagtaaattgtttgttgaatgagtggatatattataaataaatattttattagaggattgtagtaaatggaaaatatttaatttggttggtttttttttttgtatgttttgtaataatgttatgcgattaaatttggaagtaatattttaaaatttgtaagttttgaatttatttttgaaagttttttgttttgttgtaagggagataattaaagttagtgaaattggaattttaagatttagtttaattaaaagtttataggtattgtaaaatttattgtttaataatttttttagtttagagtttattttaattattaaatagatattgtagaaataaagttagtatggtatattggaaaaaatatagagtttagagtaagattagtttgaatttgtatttttagtttagtatttattagatgattttattattttgtataaattatataatttttatgagttttaattttttaatatgtaaaaattatagaattgttgtgaggattaaaaaatgaattgtaatgataatttttagtataatgattggtaagtaggtgtttaatgagtgtagtaatattagtaatttataaaagttattgtatgatggtaggagaatgaaaaattatgaagaattattgaataattagtgttagaatttgtatgttaaattaaggttatttattgtattagtttgtttttacgttgttgataaagatatattttagattgggaagaaaaagaagtttaattggatatatagttttatttggttggggaggttttagaattacggtaggaggcgaaaggtattttttaatttatttatttatttatttttgagatggagtttcgttttgttatttaggttggagtgtagcggcgcgatttcggtttattgtaagttttattttcgggatttacgttatttttttgttttagtttttcgagtagttgggattataggtattcgtaattacgttcggttaattttttgtatttttagtagagacggggttttattatattagttaggatggttttaattttttgatttcgtgattcgttcgttttagttttttaaagagttaggattataggcgtgagttatcgtgttcggtcgtaaaaggtattttttatatggtcgtagtaaaagaaaaatggggaagaagtaatagcggaaatttttgataaatttattaggttttgtgagatttatttattaagtattttttaaaaatagtttatggttgttttttttaattttttgatttatattttttttttaatttgttgtaattagtgttttttacgagtatttaataaaaattgttttatttatgtttttaatgttatatattgtaagtttagtggttaatttttaggttttttatttaatcggttggtagtagtgttgtagttttaggtattatatagagatataataatgttttgtaggtaaatagagtatgtttgtttttttttttgtatttatttatttttaaaaataaggagattttttttagaaattttatattatatgtttagagttgggttatatatttattaataagtttatcgttagtaagagtaatggtattattttttgttaatttttacgtttgagttatgtgagggataggttgatttttgaattaagttgagttttgttatgaaagtaaagggtagaagaggagttgattagttaattaataatgtttgcgaattatttaggtgaattgaaattgagaatttttttataaatgaaaaagttatatttaatatgttatttagtatatataatagtttttaatgattattttatagtaatattagtagttagtgtttaaatatatgtattaaaataaaaatattttaaatttgaaaaataaagtatataaaagattataataaaattattaaaattaattttatttaatgtttttaagaatatttttttttttaatttttttttagattttgtgaaagtaatattgtattttattgagataagagagtaaatatgaataagttgtatataatttgtaatgtttagatatttaattaataattaaattatttgatagtaaatattttagatgtttttttttatttgtagtttgtatttattttatttttagaaagaaaaaaaaaaatttgtagttattgtaggattaatttatatttaggttaatttaaaatgaaaataagtattttttatttttttgtaatttattgagaaaaagtattttaaaaatgaaataaaatagtagtataatatatattttgtaagaattgggatatgaaataatatataatttatattttgtatatttagagttatgatatgattgtataatatttaaagttaatatttaaaaaaaaaaattatttttattgtttagttgtagggaggataggtagaatattttatatatttttatagtatttgtattaagattttttgtatatttttttaattagatttatattagttagtaagaattatttttagtatatatttttatttttaaatatgattgatattttatagtagttagtgatttgtttttattttgatttatggttttatatagttttattaattaaaatagattagagttagattgaaataggttaagttttggaagtaggtttattagtttagttatgttatatattaggatgtagtaagacgtgaggtaggtgttagaagatgtttagttaggtatgtaaaatagaatttagatgttttagaggtgggttataggataaggaagtagtttttttagagagatgtgataggttttttttgggtaggtaaagttaagtaaggagaatttagtttatttaatttttatattaatttgattatattttttattttaataattgtatttttgtaagtttttgaggttaattttttattttgtatgtttagttataaaaaagtattgtaatgttatttattatttatgattttaaaaaattggggtattagagtgtttaaaggttaagtttattttttgttattagtaggaaatggttggtagtggagataggaagttgtaatatgtggaagaaggatgttttgtgataatttaaatattattttatttagagagttttaagagagtttatattattttttatttaataattattgtaatattgtaaatgtaaaaatttttattttagttttttgaaattttgatgttattatttttttttaatagattttttttaggattttttttataatatgtttatgtaaaattgtgtttattaattaatagattgaggtgatatataatagattgggaagtggagtttgttttaaaaagtatataaaatgaatataaatatttttgaagtataaattataattttatttttaatttttggaagtaaaatagaatagtaatattatagtggatattttttatatagtggtaggtgaagtaattttatttgagattatataagtgattaattatattaatggcgaaagtgagaatgaaagaatagtagtttttgttttttatttatattagtaaatatgattgtaaatatttttatattatttatttttattttagtttttttgattatatttaagaaatgtatttatgtttgtaatagatttatgataattatattatttggtaggaaataaatgtatttgtattaaaagtagattaaaatagtgatatgaaatgttaaagttttaattagtttgagaggttatttataattttgtgttttttttaagaagaatttatttagtaaaaaaaaggaatgtattaaaaaataattttagtttttaaaaatataatttttatttgtggtttgttttttatgttttttaattttataatatttttaaagtattaaaatttgttatttaagtgtttttatggttgtagaaaaaaattaatagatgatagtattttttgtaggttgagaatataatgtttatattattggattttttgttgagttttgtattgaaatattttttaaaatttttttttttgtatttgagtattttagttgagttagcgtggtcggaaattaaggtatagtttgcgagggagatatgaggattatatttaagaggtttatgttgaatttggtaatgtaatatagatgtttgttttgagtaatgttttttttaagggtttaaatatgtttttaaaataaaatatatatagtaatttttaaatcgttaaataaaatatattatgtgatttaggtttgaaaagtttagaaagtaagaagaatatagttatgaaataaaatttttaatagaaaaatgaatgtgacgtgaagtgtgttttattttgttttttgttttaggaaagagtaaagggaaatattttaattgtaatatttttttaatgtgaaaaataattttagtatttttttggagattcgttttttattttaatttttgaaagtttgtattgtttgtttttataaaggttaaatataagtgggagtattgggaaatatatatatataatttgtgaaaagtattgtaattgagaagaaaaagtagtataaggtattaatgttatttagtttggtttataaaatttattttaaaattgtatattttttttgagggtttgtttattttttatatataggaataattttatatatatatttagtataattttataggtatggttttattattattagtatgtgatattttataatttttaatgaaaattttttttgttagtatttttttttttttttaaaaatatatattattaagataaaaaagttatttaaaatatatttttagttttttgaaagttgattaatttttattttaaaagtataatatattttaaatgaaaggatatattattaaaagaaatatttaagattatttattttattaaaatatgaaaatttattaatttttatatagaaatatgtttatgtgaatttgtttttattgtatttgaaggcgttaagtagtatttttagtaattaaagtaattttgaatgattataatttattttattttaaagagataaaaaagttttttttaaggaagtaaatgaaattataaattaaatttagaattttggacgatgattttttatataatgatatttttagaagttattttagaagtagatattagataggttagggttgtttgtttttatattggaagtataattgtgtaattggtttttattaatgtaagtttgtatttttttgagatgagtttatattttaggaagttatatttaattattattatattttttattattaaatgagattgatatttagtttttaaaaaatttttttaatgtgttgtttgtagaatgtaagttagagaaggtttaaaggaaaatttttaattttgaagatttgagatttttttaacgatgttttttattgagtagattttttgattttaagaaaatttaatttaattttttttttttttttgatagattatgtttttggtgttgtgtttaaaaatttattgaagtatttaaagttagattaaggatagttaatatttatagtgtattaaattgttgtttttaatatgattatttgaaatttttatgttattattgttgtaagaagtggaaatttaagatttaatttagtgtagattagtggttttatgtttaaagtgtatgtatatttgtaatataaatttatttttttttaaatttttttatatgtatagttttttttattggtaataatatttatattattattaggtttgtcgtataaatatcgaagtatttagaagatttttatgaattttatatttttttaagtaatatttatttttagttttttaaatatttatgaatttagatttaaaataaattgttttaaaataatttatattaaagttattatttattaaggattatagtgggaatagaaattattttatttttaagaagagaatttagatatattgatttttttatttgtttttttaagtatttttatatgtattgagaagaaataataagatttttaaaatggtaggtgaattaaattgttttagttagaaattttgtgtaattgggagagatttaaggaatagtttatgaaattgtttaattgagaagaaaaatagcgtatgatttttattagagataagtataaggttattttttttagaaattagaaaatttagattttttataaaaaatgaaagtttttagtaattaggatttaggatttattttttattttttttttgttgtgttgttataatttgaagagttagaaaatattaggtatttttagtaaaagtattagaagtgaagtagaaaatattatatttatttatggtttttatagttttaagaaggatatggaattagagataatttataatataatttttaaaattattagtagagagtatttttgtgattattttatatttgtaattttaataataattgtggtaggtatatggagtttttaggatatatgtttatgttttttttttttttgaatgtacgagttttgtaaaataaattgtttgtttaagataataattagaaaagtttatggtaggagttaagttttagttttttttatttttttgattttgatttagttattttttatttgaaataggatggtggttatggaatatgtttgaggtttataaattattgaataaaagttttagtaaattttaattaagaatgaggtagttttttttgaaatattttgggttaatttttttattaaataaattaattttttatattagtggtgggggcgggggggggggtagaattaatttgaggattttagtaattatttatatgtataataaaaatgtattgagtgttttaaataatatagtgttaatagtattagagttaaaggagtgaaaatttggtttttggtttttagaagttttatgattagttgaatagtttatatatataagaaatataaataaaattttgaagagattggtaaatttatgagagtgtttttaaaattagtatttatttattgttgattataagttaggtatattgttattttttatgaattgttttaaaataattttgataataatttttttaggtagattttattatttttattttataaagagtgatattgagttttggagagattaaataatttgtttaaaggtatattgataatgttattgaaataagatttaaatgatataatgaaattatttgtttaaaaggaagttcgaatagtatttttatttttaagtttagtgttagagaagataaaatatttgtgtgttattgtttttattttttttttaaaaaataattggaggagtgaattatcgtttagattgggtagagatattttagtgatttgtaagaatattcgttttttttagttatatagatgattattaatttatttgaggtatatggttttgtattgtgttttttaaatgttgtcgtagtggtggtatgtgaatgatttttttttttttattttgttatgaagtgttatttttttttgttagggagaatagattatgaggaataattgttttttaatacggttgtttgtgataaattttaaattagttgtttagatttaatattcgtgtaatttattgattgattgttttagatggtgttgagtgttaacgttagttatatgtttagaaaaaaattaataaaaattggtttagaaaagagattgatttttttaatattaagaagtttttttttgtatttagatttttgtttaaaaattattaggttttttttgttttttagataatttaggagaatgatgtatatagatgaaagacgtagttatttgtttttaagtatttgtaatttagtagaatagaaagttgtattaagaattatagtaagtgtattaagtattataatttttatggggagttataggaatttaaaagaggattaataaaagttaggagagatgagaggttttggttttttgttggaattaattatggttaggttattaaaggattatgtaaattttgataggataagaaaagtagaatgatgattttaggaaaatcgaaagtatatgcggaggtttaggggtatgaaagtatagtttgtttggggaagtggaaagtagttaagtttggtaatatatggtatatttggaaaaatgataggagatgtatagaaaataattttaaatgaagaatttgatgtttggtttagtattatggaggtaaatatttttgttttgaattaaaatggagattttgtttttgattttttttaagtaatttttttttaatgtttttaaattttttttgatttataaagtagtataatgtaaaataattttatattttttgtagtttttgaggaagataaaggatttggattaatttttgaagagtagttaattaatattatttatttagaggaattattggaaggaaaagttttatttaattgtagggtacgagttagttttttttcggtttataagtaatgtatttcgtttttttttttagagtggagtgttagagtaatgattatagattagtatttatgaatttgtatagatgtaatatagtgttttttgtaaattttatggatattaataaaaatattggtatataaattattaaaaaagttgtttaatgtttaaatagtagatttttttaaatatatgtaaataatttttttattattttttgtatagataatgttattggtatttgatattatttatttataaattgtataatggaaattatgtttttaggtttatgaatggttatataaaattatgtataatttaaatatatagatttgaggataaaatgtttttgttatgtattggtttgtataatttatatttatagatatggataaatttttatattaagtatatttaaagattttgtataaataattgtagaaagtattatattttttaatagttttatatttatattttatttaatatagtaaattttttaaatgtttttatttataggaaaatttatataaatatattttttattatttttttgggttatatatgtatgttatttaaaataattttataaaaagtaataatgagtttttttgttttagatgggttataaaagtatattaatagttttttatttgatgtaaagaatgagatgtaaaaattaattaaatgttagtggatttaaattttatttgtgtaatggttttatgaagataaaataagtgattgatggagaaattgggggttttagtgtgttaatgttatttgatttaattgaaagttgttatttaataaagttaattttaatattttttttttgatataaaagtaattttttattattataaaaagtttttataaaagagaatatttttttttatttatttgattttaatagtatttagtttttttttgtttttggttataattataaaattatttttaagataaaattgtgaatttagatataaaattattattttattgaaattatttttatcgttttaattttatatatggaaatatgatataagtaggtattttataaattataaataatatatttgtttttaaaatatttgatgggttagatttatttttatttttaagttatatataatgagagtttatttgttattgatatggaatagtagaattaataggatttgtagaggagatttaatttaagaaaattttataggagaggaagttgaattttgaataagtaaatttgtttgtttaagaattagtaaattatagatttaagattgaaatatagtttttatgatttttaatgaggtatgtaatttttttattatttatttatttggatagattgatagaattttaaaaatttttttagtgatatttatgttgtgatattttgttgttaatagttatataagggattttagtaaattagtttttaggttagaatagaggtaattaaaagaaagggttgtttttagataatattttagaaatatggaaaaggttatgtttttttttgttgtttttatgtttttattttataggtataataaaaagtaaagttttgttttgttagtaagttattaattgttttttttaggttgtatttagtattgaaatttttattttgagtttggtttggttatttatatattaatagatagaattggagaagatagatagatgtttaattttgttatgaagatagtttgtatttgataggaaaaaaaaaagtggggggaaagaatagaaaaaaaattagtttatgatggaaatagtttgatggaaaagaatatttaaagtttttaaaatgtatataattttaggataaattatattaattttggtaattatttaattttttatttatatagtagttatatatttgtagtatgttttgggataacgtgttatttatagtaatattttgagaggtataatagggtattttatttttgatttataagttttgaggtttttattattttgtttttatttttaaagaaataagtattataataaaaaagtattaaaagggattgtagtaatagtttatgtttttgaaattagattagtgaatttttttaaagatagaaaaaggtaatttttatatgatgttataagtataattagatttatgtggaggaaggtaagataataaataaatatttggaattaatataatgagggagaaattataaaaattggagttgtttaataaagaaatttattgttttgataagagttaagtaatttaatattagatggtttaggtagggataatattgttattatttgggggaagaggaaggttttatttattggattgtaatttagtaagttttaaaaatgtaaaattatagttttttatatttgtttttaaattattttttatattgcgaaaattgtaattaataatgttttagtaattttgatttgataatagatattttaaagttattaggatttttgggtatgattattattttaattagaagtggttaggaaatgagcgatgtggttacgagttattattatttgagcgatttgattatagttttaggtttatgatttttttgaggatatggaattttaaaggataaattttgataaagaatgattataaaattatatagttggtttttttagttgagaattattttttatatgtattttttttattattatattagaaagttagatttttgtttttagtttatttataatattatttttattagttaatgttttgattatttgtagtatgttttatattgttatgatattatgtggttggggagaaaaagaattgttttttttttttattttattaaaagtaattttagagtaatgagaaaagatataagtgattattaattttaggttgaggaaaatttagatttatttgtatatttgtggttcggaataaatttttaaaaatttaattgatttttattatttttaaattgtgtgattgatttttagtggttagaatatgttatttattgagtagaatttattgttaattagtttgttttattgaaaaattattttgaaatttagagttagatattgatattttgtattttatttatggtagaataatgtttttaatattttatatagtatatttgtatatgtatgaatttaattggtgtatagatggttattaattatattttaagaaattaatttatggagaaaaatttaataaaatatttgttatttgagatattttataaaaaaaagataaaatacgttatgtattttgatgtttttttgtttgtatttgagttaaattataaattatggttttagagatttagaattatagagtataaagaaatattatttgaattatatttttaattgtttgattttatatggagtcgtatttaaattattttagaattgtgttagtttcgtagagtttttaggttttatgatttgtgatatgatttttgtgttttttttttatagatggagaatgaataatggggacgttgattttataagtgatcgatatagtatggtaggaggaaattttgttattaataattttgataaatagaaagatgttggaatatattattgtttagtatttaataattacgggatggttagaagtattgaagtaattttgagttttggatgtaagtaaattgtaatttttaaaaaagggtaagcgtgtttaggtgagtttagtaagaagaataattaggaaaggatagtgagaggaaggtattatagatgaggtggattttataagatgagtggattttaattgtgtaatggagataataaagtattataaggtatattatgaatgtatttgaaatagtgaaagatgatgttgttaaataaaggaaggttagcgtttgaggattttgaatgattttttaaaagttagtattaggttgggcgcggtggtttatatttgtaattttagtattttgggaggttgaggttggtggattatgaggttaggagatcgagattattttggttaatatggtgaaattttgtttttatttaaaatataaaaattagttgggcgttgtggtgtatgtttgtaattttagttattcgggaggttgaggtaggagaattgatggaatttgggaggcggaggttgtagtaagtcgagattgtgttattgtattttagtttgatgatagagtaagattttgttttaaaaaaaaaaaaaaaaaaaagatattaatggaagtaataagttatgtattattaaaggggtattattatttttaagggggtgaaaattgttttttgggggaagaaaatgttatatattgtaatataatgtttgtgattttttaaagattaatttaatatgataatattgtattttttaatatttaatttttaatagtaggaataaatttaattatattttagttaatttattttaaatttaaattatatgaaatattttttttaattagggttaataatgaaaaattgtgttaagttaaaaattagaggttgttttgaaagaaaattttatattgggagatgagttggattaggtgatttttagtatgtgatttgttagtatttaaattttttgtaaaatgaattataggatgaaaataatgttttaagaagttttttatggtagggtttattaggagggaatgagaaaggtttaggaagagaagtaagattaaattagtgtggtgagagtggaaatgtaaataatatatattaattataaggaaagaattaataggttgtattgtataaaaggaaagaagattgtatattttttttttaagttatgtttagttagagggtagaaatattttgtttttattaataatgggatgggagtaagaaaaattaattttaaggatggtaggaagtatttaaatggttgttttatatgtagaggttattttgatattgagttatttaagttgaaatgttaagtaagttattgaggatagggatggtatttaagtaagatattaggtttagagaagtagatttgaaaagttttttgtaaaaaagtaatatttagtatagatgaatttttagaggtatatattttatattgagaaaagtaataatttaatgttataatttgggtgtcgattataggttaggaataggaagagaggtagaaaaaaatagaatgagtattagtaaaataaatgaagaattggaagaatattaaggaattaagtgaaatgtaagttttaaatatatagaaaagagtaaagaaaattagaattgaaataaatttagaatttgagaaggagtaagagattggttatttttacgttttttaatgagggttttgttttttatttttattttttttcgatatttaagtttttttttaggaagagaaatattttttaaatgagtttatttttttaagttatttttttttatttattttttttggtaggtttttggtttgtttgattttattgtatttttagatattttgattgagattttttttaagtttgaaataaaagtttttaggatatttgtgatttttagggttgttagaatttttatgtaggttgtttttaatatttatagattttgagtttataatagaattttttaatagtttatataaaattttagtaatgtaagaacgaggagttgattttattaggttttattaaattattgagaagtgttgtattttacgaatgagttatttgttgaaaggtaaaattgatgaatgtttttttttttattgattagagagtgaatgtttttttttttttttttcgtaattagattttgatttttttttatttgaggaacgttttgaggttagagtaaaagaagggaaaggaatggtgtttttttgtgattttttatattattttttaggtaaatttaatttttttttgattattagtatttatgaaataaaatggataagtttttatttttttagtaataatgttatattattaataattatggtttattattaattaaatgagattgaatatttgtatattttgtaatgtgttattaattgttgtggatatttttttttttggtttagttatttggttttagttttaaggatttttaattattttagtttataaatatatatatatatatatagtattatgttattattaaagtttttattttatagggaaattttgttagattttttagaaaatatttttgaaatagaatagtattaagaaaggatgtataattaattatttttttaataagttagtatttatgaaatattgtgaattgtatgtaattaaattttagaagggataaagatataataaattattaatttttttaggaatattaattagtaagaataattatttattttataaatggggttaaattaagtgttatttgttatgaaatttaattttgaatttatgttttttgtaattttatatggttaagataaaagttattaaagtgttaattaaaagatgaattttttatatatttttattaatttttatttatttattaaatatttttttgaaataatatataaatatttgtttttataatttaaaaattatgtttttatttttttagttttaatattatgttttaaatttgattttaaatatttttatagagaatgaaacgtaataggtttttaaattttatataggattttgtgtgggatatattaatttgatgtgtgtgtatgtatatatatatatatatatattttatataaaattatgttatatattttatatgaaattgtgtgtgtgtgtgtgtgtatatatatatacgtatatatacgtatatacgtatatatatatgtatatatatatatacgtgtatatatatatatatatatatatatatatagagagagagagttgtggttgtttatatattaaatatttgtgattttttttataataggagaaagatgattgtttgataaatataggaggtatatataaaatttaaaattttttaatatttttttaatgagaaaaattttttttttaaggaattattgaaattatatatatatatatatatatatatatatgtatgtgtgtgtgtgtatatatatatatatatatatatgtatatatatatattttaaaaatttattatttttatagtgttttttataaagtaatgattaaaattatttagtgattatatttgattatatttaatattggatggattttattgtattatttattgatttagaaaattttttatgagtatttgttatatagtaggtataatgtatgttatagaaatgttttagtggagtaaaataggaaaagttattagtttttagaggttttttacggggagagttagatattaataagataaatggttaaaagatatgttatgttagatattgttaaataaggatagatagatagatagatagatagatagatagatagatagatagatagatataatgtagggaagtggggagagtaagtattgaggggaatgattgaatttaggaggagtattattagaaggaaagttggaataaatatttgaaggaagtaaaggagttaataatatgagtattcgagagaagagtatgttaggaagatgttgaggttagattatggaagattaaggaagttagggtggttgttatagagtgaataaggtagagggtagtaagaaatgaaataagagaggtataagagttgtattatggaggattttatgatttataataattattaatattttggtttttattttgaatgcgatttatattggtgggttttgagtagaggagatatatgatatgatttaagttatagaaaggtgattttggttattgttttaagaaaggatttggggaggataaaggtggaaataagagatttgtttggaggtattgtaatagtttaggtagtatatgatgggttagagtggtggtagtggaggtgggaagataaatttaagtatattttagataaaatagaatatattaaattttatatagaaatttaggtatattttggttaaattttagatatattttgaaggaaaagttaataggatttgtttgttgattttatgtggtatataagataaatataagagttgagggtggtataaaagtttttgttgtgagattttaaaagaatgaagttgttattattttagttgaaggaatagatgtggatatgttaaatgtgaagtatttgttaagtttttaaacggaaattaaggtggtagttttatatgtgtgtagatgtcgggggtgatggaatattaatttatgatttattatttaataagttgtttttaaaattatgggattgtaatgtgtttatttagatttttggggtaaaagtaagaagtgttatatatttatcgataaaagtaatattttttaagtatgtgttggtatttattgaaaaaataattttatggttatttattgtttaatttagtttataattcgaggaaaatagatagtttttgtaaagatgattgattttattatttgtgtggggttaggaaagatataaagaagatggtttgttgagtttttgaaagaattagattagggtttagtttttgattgataaagttatattttattcgtaagtcggagagttagcgtggttattgttttggtgttggtatagtttattttggtgatggtgggtggggaaagaggtgagaatattagttttgtttttcgtttgttgtatgattttaggtaagttattttattttattaggttttggattttttatttaaaaatggtaagagttatttttatttttgttgtaacgattgttgatagattttaataaattgtaattattgttttgtttaagtgaatggttttaaaaataagtaagatttgttaaataaatttagattaattatattgtaagttttataaatttaaaggttatatttattttgtttagtagtatttggaaggtatttagattttgtaaaataagtaaattagagaatttatatcgggtatttagttagttagattagttgttttatagtttaagatttatgtttatataatattacgataataatttttcggatttagtatttattttttataaggattaagtattattattttttttatttttttttatatattttttatgagtggggtataggaaaatgttttatattttagagaaattgagtaatagagtgattaattggtttgataaaaaagttatattgagaattaaaatttaggtttttgtatttatataattattgaggatttagattattttaaatgtattttgtgggtagtattttttatatattttatagttataaaagttttttttttgtaaggaaatataaaattttttgatatttttggttttggtggtggggtagggggagtggggatttaatttttaatagaaatttttataaaatttggatttatattttaattgagaataggaaatattaatttagaattagaaaagattaaagtttttttttaaatgtattatatatattagtttggatgaaagattatttaatatttttttttgaatgtgatatttttttatttattttaggagtttttatttaagaaatttaagtagttttttaaatatttttttatattaattattttgtgattttaaattagtaagaagaaaataaatgaaaagaatttaattatttatagatataagtgtttagaaatatatgttaatcgtaattttgagttagaggttaattatggtagtttaattttttgtttttttttatttgtattttgtttttttaataataaatatatgttgttgtttttataatttgaaaaaattaatgttgaaaattaaaagaatataattatatttattgtttgttttgatgttgtattttgttggagaaaattatatagttaagttaaatataatgtttaggttattatttttaattatgtgaagtttatataatgtgtattttttttagttttttatagttattgtgtttttatattttttttgaaagttttgttagttacgttgagttttcgaaagtaaaatagttatttgttatgattatttatttttaaaagaagtttgagtgttgtgattttttggttttttattattttatatttaaaattttatttagtttgatttagagagatttttatttatattttttttagtagaaattgtttttatgtgattaagatgttttgaagggaattattattttttgatttaaaggtatgtattgtttattgtttttttgtgtatttgttgaatgatttttggggagttatttattaaaatagagaggaaagaaggaatagaaaattataggaaatgtagtaaattaaggaggaaatttagttttttatttaattagttagtgtgtttagttaaaggaattttatgtgggtaagagttattatatgatatattttttaatatttaattaaattagtattatatttttttttgtttttgtggtttttttttttaatgtgattataataggttatgtaagtttatttttaattttataaaataggtgtatatatatatatatataaaaaaaaaaagataaagtaataatatggtaagtaattttaattatatttataaaatgtagtttggtagattaattatggttttcgagttattagatatggatttaaaattttatttttttttaatagttatgatattttaagtaagttatgtaattttttcgagttttatttagtttattaatgaaatgaaagtaagaatataatagtttattaaataatagaaatagataaatagatgtaattgtttagtgtaatgtttatatttatgtgaaatatggtatatgtttaaaagtgtgtattgtttgttttggtttttttttaatatttgttttataatagtttttattagattaagtgatagtttgttattagtttttattaaattatgtaataattttgggagaagtatttaatatttagaaggtaatatttttttttagatgattttagttatcgttggtttttaaatgaattttttgtatttattataatggataaacggcgatttgtgttttagataaatggtaatttttatattgtaaatgttgaggttttcgataaaggtaattatttttgttttgtttttagtttttttattataaagagcgtgtttagtaaatttattttatttattttaatatttgaacgtaagtattttatttgttatattttgttttcgtaaggttatttatatatggtatatttatcgtaatgaaaagaaatatttagtgaagattagttgattttttaggaaggataatataaaaggggatgtatgttgaaggggttaaaggtttggttttaagttttttgcgttgagaagatttagttaataaaattgttgtaagaaggttgagttcggatgagttgtttttagttcggaaaatatataggggattgatattttagtttagttttagtgtattggttatagtggaaattattgatatttattttttgttttgtggttatttttattttttagtaagtttatgaagaaattaaaggattggtagattaaaataaataatagtaattgtagaattttttaagttattttgattattttggtatttttaaggaattatttatatgatataaataagtaaataaatggttttttttaatttatataattagtatgaggtgttattttggtagtattatggtagatgatattgataatttgattggtttttttttaggttttaattgaattattttttttttaaaaagtattgttgtttaagagaattaaattatagtatatttgtttattttatattatttttatttaagtttttttgttatattaatattagtaaatttaagtttatgagagtatattagttttagattaatagatttaggtttggtttttgtttttatttttaagtatagtgtgatgatgggaaaaatgttataatattattgaggttttatttttatttttttttgtaaggtaatatttatataattggtatttaaaaaatattgttgattttttggtttatttttttttttttagttttaagagataattttattttttattttatagattgaaaaggagttattatgtaaaaatttttttgattttttttttatttttttttagaaatatatttgtaatttagtatttttatttatttttttattttttgtttttatagtagaaatattttttttttcgtttaagttaagttttttagttgtttcggtttatattttatttgttttaattagaaattttattataatatttattttttttttttttgaatttttagattttgttttattttattatttttgtatatttttttgtatttaatgtaattttgaattattatgaatttttatttgttaaatttaaaggatattttgaagtttttattttgtttgaattttgatattgttttttttgttttttatgaatttttttttttttatttaattttttgaattttttattttttttttgtttttttgataaattttatagaatattttttataaaatattttttttttttatatttttttttaatttttttttaggtatttttatttatttatatatttttaatagtatatttttgtaagagattttaagtttatattttcgaaattttttttgtgtttagatgttaattttttttatattttggatttgttttttagaaagtttttatagatgttaagtttaaagtgttataaatatatgtgttatttttttttaaaattttttttttatttagtttatttagtaatatagttttatttttaataatttaaggtagtattatttattattaaattttaatttttattgatttttaggatagttaattttgtggtttttaattagtaggtaagtatttggggagttttgggaataatgtaggatttagagatattgatttagtaggtttggaatatgatttaggaatttataagttgaattagtattttaggtgattttgatgattgagtttttaatttatattttgagaaatattgatttaaggagtcgttttgttgattttgtttttaaaatataatttatatttattgttttttttttgtttttattgtaattatgttttagtgttggtttttatttgttttgtttgaagtattgaaatagtttttttggatttttgagattgttttttatattttttttttttatgttttattttttaaaaatgttagtaaggttttttatttaaattaaagataagatttatattattttttttattaagttttaatggtagttatttgatacgatttggttgtgtttttatttaaattttattttgaattgtaataatttttatttgttaagggtggggttaggtggagataattgaattatggggggttgttttttttatattgtttttgtggtagtgaataagttttatgagatttgatggttgtataaaggggagtttttttgtatatgttgttttttgtttattgttatgtaagatttttttttgtttttttttaattttttattatgattatgaggtttatttagttatgtagaattgtgagttaattaaattttttttttttataaattatttagttttagatatgtttttattagtattatgagaatagattaatatattatttattgagaaaatttattttaaaatattatttttttagtttttttagattgtgggtttaagtttatatattttagtattatttgagtttttagattttttaaaattttttgtatatttttggagttttgtcgtaatatggtgtttgtttaagttaaattggtttaatttaaatgttatatttgttttagagtgttatagtttttatttatttttaattatcgtttttattagttatttttttaaagtatttattttgatttggtttatatattattatttatttatttgtttttttagtattttatagtgtgtggtatatatttaatttgtgattttaaataatgttttttatttttttaagtttgattttttttgtaagtttgaaggattaatatattttttaggattgatgtgttaaataaatgaaataaagtgtttagtttgaagagtgttgtgttgtttgagtaaatgttttttttttttttttttttttttttttttttttaatttgtttttttttgtttttatttttgtgggtatttttttttttttttttagttttttgttttgcgttttttttttttatttttttttttttttttttttttttttttttttattttttttttttatttttttgagttttatgtagtattgattataatgtttgatatatatttgttgtttattaaagataggattttttttagtaaattgagttataatggttatgtagttgttagaacgagttaatattattgaaaatattgagaagttatattatatttatattgtgtataaataaataagtttatttattatgatatgatttgtatttgtatagagaaaagtttttatgttggagtagttttaattttgtagaattattatgtttaagaataattaatattgtgtttaataattagtggatatttgtgttttttttaatattaggaataataaaattatattttgttgatattgtagtttagtttaaggatgtatatgtattgatgggttaaaatgtgattttagaatgttttgtatttggaaagtaagtatattgatatttttattaatatatatagaaatagtattattttaggaaataaataattgtttagttataaatataaagtaattgttttttaagtgtgtgaaattttaatttttgtattttttatttaaagttttgtttcggatattcgatggcggaaggttttagaattaatgttaagtattgttgagattagtatttttggggttgtttttaagatttttaatatttagttagaagatgaaggtatttatgaatgtgaggttgagaatattagaggaaaggataaatattaagtaagaatttatgtttaaggtagatatattattttaattttgtataaattttattagtattttatttagagttatttttatatatgaaaaattattatataatgattaatggttttaaaaatagtgatgtatgttatattatggagaaagataaaatattttttatatgtttaatgaagttataattatgagttatagaagttacgaatttattattagttgaattataggtaatagtaatagattgatagaagtgttattggtaatttttagaatatatatttaatgtagtttgtttatttattttattattgtttttttttagtatttttttatttatagaagaagttatgtgttatgatttagtttaagttagtggtttgtaaatttaagtatgtattaaaattatatggagggtttgttaaaatagattgttgggttaaatttttagaattttttatttagaggtttgttaggggtttatgaatttgtatttttaataaatttttaaaggatgttgataatattggttttggagttatattttgagaattattggtttaagaaatttttttttttttttttgataaaattattatggtataaatttttgatttttatatattaaaataaatttatatttgggaagatagatttttttttaggttatattggaaattttttagattgaaataatttttataatgttttataatatgaattttgtaggttataagtgaataaatatcgagggtttttataatattattcgtttttaattttggttattgttttattttattttttttcgttttttttaaaaaggaataaaaaatttgatagatttacgtattttttttaaaagtgttgtttttatttttagtttttttttttttttaattgtattttaatatgatttgtatttttgtttttttatagaaatttttttttttatgattatagatttttatattgttaaagttaatgattaatttttagttgtatttttttttgatttaatagtagtggttgttatagttggttttttttttttttatgatttattttttgtattttatgtttgtaatttattttgttattaatttttttgtataattttttattttttattgttttttaattttatatttttttaatattggtgtgattagggttttatttgtgaattttatttttattttagttattttatttatgattttattcgtgattatggttttagatatattttgtattttgaatgttttaatttaaatatttattttgaattttagattcgtatgtttaatgttatagtaatattaatgtaatatatattaagtttgtatgaaatggttttttaaaaggaagaaaatattaggtaaggttttttaaatttttgaaataaatttattattttttattaggtttttaaagtttatagatttgtttttatttaatatattaagaaaattatattttaggtttttaatagagtaaaattttgaattgtttaatatttaaagttttagaagaattaaggtgatagagtatatatttatagaaggtaatttaagagaaatattatttattttttattaatgtagtatattaagtattatttttaggtttgattatattattagaaggttatataattaagttatatatagattgtgttaagttaatttaattatttattatatgatgtaatagaaaatgtttgtgttgtttttgtgaggttaagataggaagggtgttgatatttttgtattatgtattgttaagattgtatataaaataaaattttttttttttataatgaatatatttattaatagtttaaaaaatatttttttatgttataaatataatgatgagtgaaaatatgtattaaataagattatatatgttttaagatatataggtgtatatatgtttatatgtataatgtatatattataatgtataatgttgatggtatttggtgagataaaaatgttttttagtttttaaatttttagtattttattatttgttaaatgttttttataagatgtatatattgtttttgttataaaattaatataagtttttagttttaaagaaaattaaatattattttttatttaggattttttttttttattttttttttgtattaatttatttatttgtatttatttggattagataattgaaataattaaaaagattgttaaattgtttatttgtttgttttttaaaaatattttttttttggaaaatttttagtatttttttatttttatggatgtttttttagttattaagtagattagattaaagaatgagattgagattaattttattaatgtatggattttattaattatggttattgtatatagtttttaatatggaaagagtatatttaggtgtttaagttatttttttagcgttaaagtgagatgttatcgtggttattagttgaaagttttattaaaatgaagataatgtatatttgagggagtgggaaaaatatttgagtttttatttaaaatgttaagagatggtattatattgaattgagatgtaattttttaaaattttaattattattttgatagatttgaaaggtttatgttatgagtagaaaaaaattagttattttagtaataattataatttagttttttaataaaatatgatttataaatggaaaaataatggttgagttatagttattttttgttgtaataatataggatttgcgtaggttaagtttatgtaaagataaggtttattattgagtttaggatgtatatattatttgatgtattttgtagaattaggttaattaaatgtaatatttatattttggagattatgatggattttgagttttttatttaatatttataatgttttttattttttagtattttttgagtgggtagaatatattaatgatatagaggtggatataggtagtgatttttattggttttgtgtggttataggaaagtttatttttataattcgatggttgaaaaatggatatgcggtatgtatgtttaagtgttttgttgtttttgagtttttgtttaagtagtgttttagggtagttttgggataaatttagtaggagagataatatagaaagggtatttgggttttgaaatataaaagttttttaaaaaagataaaaattgaatataaagtatttttttttagtttaaataattttttgtaattttattttattttttttttttttttttttttattttttttttttgttttatttttttattttttttttatttatttatttttaatatttgatattgtttttttttttttgttattatttttttgtattttatagagatagaggtaagagtgaagttttaagttttatttttggttttggggataagtagtagtagtgggatttttttttatttttttattgtaattttttagttggtttaagaggggaaaaggtggatttttagttttgtaggatgaatagaataagagtttttgggtatggtaagtgggttttttttttttatgttatgaaaattttatttagtttattttaggtaatagtgggggtagatgaatataatgtatttaaatgaaaagataattaaatttagatttaagtgaaagtatttttattaaagtttattgagaatatgttttaattttattttttttagtattataaaggggaattaagattgtatgatgtgatttttgaaaatgtcggaatgtattagtgtatagttgaaaatatatatggagttatttatgtaaatgttgagttgaagattttgggttagtattatttttaatttttgttaaatattgttaaagtaatatgttatattatataaaatgtttattgagtttatataaaatatttagtattgtgttaggtgtataatatatgttggttgtttattgatttatttattgttaattattataatttagattaacgaaataatggaatagaatgaatttttgttataataaaagttttttttagagtattagtagtagtggttatatttaggagtatattagaagtgtagaattttaggtttattttagatttattgaatggatattttaaaaagatatttagatgattttaatataaagataattttgagaatgattagattagaggatgaagagttaaaatttagatgaagatatgtttaggtttagaaaagtttttagaaagtatatagttacggatgattgtaatgtgttgaaatatatggatgaaatttgtttggagtttgttaagggaagaggagagtgagtagtggattaaatgtgtggatgttgaggaaagtttgagtatgatattaatgaagtaattttttttaagtttttgtattttgttttaataattattgttttgtatttggaggtaatgatgaattataaatgattatgtttttttaattagttgattagatttattatttttatagttgtttatagatagattttgaaagtaggattttaattattttggtattttgtagggtgtttgtatatagatgatgtttagtaattgtataaagaaggagagattgtattgtttaatgaaaagtatatgttttggaaatagaaggatttagatttaaatgtgatttttatttattattatttgtggtatttttgttaaattaaataattttaatagattttaatttttttatttataaattgggaatagtttatttaatatgtggtttagaggattgattaggattatatgttagtgtgtataatgttggttaattttttttagttttttattttattttttttgtggaattgagttaaagtaatagaatttagagttaattttaaggtaaatgtgtataaaatatttgattgaaattgaagttatttatttattgagatagggttttacggtgttgtttagtttggagtgtagtgaggcgattacgttttattgtagttttgattttttaggtttaggtgattttttattttagttttttggatagttgggattataggtatgtattaatatgtttagttaatttttttgtattttaggtagagatggagttttgtcgtgttatttagtttgtttttaaatttttgggtaagttatttgtttattttagtttttgaaattgttgggattataggtgtgagttatttatgtttggattttaattaaagtttttaataattaatttagttattattaagaattgtatatttgaattgggtgaattttataagttaaagttattaaataaaagttataaagtattaggtatagaatgtttattggtgatagttgattatatttatcgagattaattttttttattaattattaaggagaataaaagattttataatatagaagtaatgtttaggttttataaatagaaagagaaagataataatttgttttttttttagcgttggttttaatttttgaaatgaattttatgaagaaaaagattttggttgttaaaggtggaagggtgataattgaatgtaaatttaaagttgtatcgaaattaaagtttttatggagtaaagggatagagtggtttgttaatagtagtaggttagtgttgaaattagaaatttaattgtaaaatttgtttgaaaaagtttattttatagaagatttgtttatatgttaataatgaaaatgttttttgttttgaatttttttttttatagaagattttgtagttttaagatggatagaaatatttatttttgttagtatttattataatgaaggtttaattaataggattttataatgtataaggaatttagaaaattgaagtttagaggtgtttttttgttgttttgttgttataaattgtttaatgttatatagttaataaataatgggaaataaagtaggatttttttaatatatttttttttagtataggtatttggtatttatatttatttatatttaattgaattttgtgtagttagtttattaaatatttttgtagaaaaataaaaaggtgattttaaagtgtaaataatttttttttattttaaaatgaataagatgttattattattttttttataaatggattatttattaatgttttggtggtttggggataaaatgaaaaagtagtgtataatttatatagattatttgtataaaagttatattgaatagtttatatgtattttagaagaagtaatattgagtgtaaaaattatgacgaggagaaagttaggatgggaaatgggagggatgggatgtgtgggttggtttgagggtgtatgtgagggtgtatgtgagggtgtatgtgaatgtgagggtagtatgtataaaggttttatggtgaggagtttagaatgtgtaagaaattgtagaaattgaaattagtgtgatttgtttttagaggaaaatggaggagatttttaagagatgagatatagtaagttatattataaatgataaagttttttatgttaaggggtttgggttttatttaagagtaatataaatttgtttaaagttttaaataagggaggataaggattatttttgttatttgaaagattgttattatttagatgtagaaaatatattattttttttatagtaatttaataaagtaatatgggaattattatttatattttgatgtgtttaaagtttggtaaagttaaagtgattttttgtaaaaatatatttatgttatttaaattagaatttgaagttgtaagatattgatataaattgagaatatgttagtatagtttttttattaggatgagtataggtacggttgtttatggaatggggtaagagggtagggatattaggggtttttttgaatatattgatttttaaagttaatatgtttgattttagggttgttaagattttaataaaatgatattataagaagggttaaaggaaaagtttatttgtttaatttgtcgttgaaatattaatggttagataatgagtaatgtagagattatgattaaagggtagttatatgtgtaggtgtttattttttttatagtttagagtagggtattttttaatggataaattattagttttttttcgtgataataaaatttttttttgattttgatgaagatttatgttatggatttttttaattaaggattttttagaattatgttttatggatttgttttttttaaatattaatatgtgtttaaaaaaagaagagaaagatttagtttttgaaattttataagtttgattgtgttttgatatttttaaagtttttgaaattaaattgtattatttttttgattaaagagtttataaatttaatttttatttagtattttaatttattattattttagtgtaaatattatttaatagtagatatagtatttatatgtaaatatatttgaattgtaaaataagatgtataaaaagttaaatataaaaattttggtgtttattttgaaaaagaatatataaggattaattaaatattggtttttaagtataaatataattttatttttttgaatataattataaataatatttttacgtaattaagttatttttgtatttggttagtgtttaaagagtggtttatatgatatttggaagaagttatgtattttgataaatagtaattaggtttttattttatgattttatttttggtttaaatgatatattttttgtagtagaatttttttgtaattagtagaattaagttagttgttaatttaaatttaatggattgttattagttttaaggttatttttatttaaattatttataggaagggatttttattagttttttttattttagaggttattttggagtaattttggtattaataagtgattaattggttaaagattagattgtttttagtttgtttgatagttgatttatattatagtatttggaaataaggataagattttgagagtttagtttatattattttaagaataaagagaattattataaaaaaattaggttttttaaatatttttattaaaaagtaattttaattttaaaggtaaagtatttgaaagtataaatgagacgaatgatatatggaattatgtatattttttaaagatggtaaaagattaattgaaaattaatataagtaagttaaaaatattagtatgatttaagaaagaattattattgttttttttattgttattttattataatttttgttgtgttttttgaaaaataattaaatgaaagggatgtgggaatttggttgaggatttatattagagggtagtgagaaaaagtgtgatttattaatattggtattgtgttaatatgtgttttttaagaagttgaagttaggaagattagttatgtaagaaattaattaatggtaatgtatgggagggaaaatagagaggaagttggtggaggtttggaaaagtattttattgagatataggtttgattttagatgaaggatagagggaaggaaggaaaaaagattgtgttgaaatgatttggattgtattgtatttttaagagtatggttatgttattggaaagttttttatttaaaaatgtatattagaggagtttgttgttttttaggagtaggtttggtttaaaattttttttatggttagttattggttaagaatagtttgtggaatgtgtggttttgaataaatatagtgatggatttttgagtacggcgtttgggatagagaataaattatattttttagagttggagagtggtatatttttagagtttttatgattttaaataattatttttattattatattattttgatattttattttttttttaataataaaaagtattttgaaatgagttttaagttaggattggattgtttaagaaaggaaaggaaattttggattataatgttagcggaaattttgttatttttttatatgaagatttttattagtaaggtagatagttttgttttttttattagattttgtttttaaaatggatatacgtttgtatgttttgtgtaaatttttaaagataatttagttttgaaaattatttatttaaagaaagtaaaaaatttaatgataggtaatttaatatttaatttaagtgtgagtttttatataataaaatttagtgagtttttagtgtttattttttgaggaagaggttgataggtagggaaatatgtgtagtatgaaagatttagtttttgtttaaagaagaattttttaaatattaatttgttttagaagttgttattaaggaggttttaaaatattttttaaagtttttaaaaataaaatatatttatatttttttgtagttatggaaatggtaatttgtttttattttttagtttgaattgaagttttgaggttatatttttgggagatcggggtttattttttttaggtttatgattgattttagtttgttttatagtggaaggttagttagaagattacggtaatagtttaagaaaaagatgaaagtggatttttaaaataaaatgttaatgatgagaaaaaatattataattaaaggttagaatttgttattttataaaaatgtttgtggtcgtatgatttatatagaatgtaataattgaaaaatattagtgtttgtaatttaagatataataatgtattttattaaattaggtttgtgaattatatatatttttattttattagaatatttatttgggaagatggtagtttggaaattaataatattataaggaatgatggaggtatttatatatgttttgtagaaaataatagagggaaagttaatagtattggaatttttgttattataggtaagttaatgtttgagggtgtttaatttttaatgtattaaaaaatatgatttagtattaagtatttaaatagttaatgtatttgtaagttttttttttaaaagaattttaggtaagttttttgtttgatgatattgtttttggaatttggaagtgaaaatattttattattttgtataaataaaaatatattggttattattttaatatattagataatattgtgttttatatttttttgaattgtgttttatatttaaaaatatatagattttacgcgaattatattggttttaattaatgtcgatattatagttggagaaaacgttattatgtagtgtgttgcgttttttgattttgttttggattttatatttgtttggttttttaatggttatgtgatcgattttaataaagagaatatttattattagaggaattttatggtatgtgttttaagttttattttattaatattttagtgatttttatgtgtttgtattgaaagttttattattataattatattttatattatttttgttttttatgagattaaaaagtaggtaaaaaagttttttgtggttttttttatattaattgttgtattgttaaatttttttaaaatggttagttttgaggattttggtataaatattaattaattaatattaattgggttttaggtatgattttttttttaattttaatataattgatgtgtattatattagtatatatgtgtttttggttttagtgtttttttttttattttaaatgaagagtatagaatttaatttttgttataatgatgattttaaagtatttatgttatgttttaagagtaagaaagagataaaattatatatgttggagaatttggagaattagtttatgtgatttgaagagggttaaatggttatattttaagaattgaaaggtgttatattttataagttttatagttaaatatagtgatatagagagttaaggtgtagaaagaaataaaatagagggaaaagattgagaagtaatgtaggtaaaataatttgtgtaagaatattgttggtgttttggtaggttgtttaggttatagtgtatttaaaaagtaaattaattattggttttattagttttttttttagaaaagtaaatatttgtaagattaaggatatatttagaatataggtataattaggaaaatttttattttagaagttagttattaatataaaaaagaagtataaatgaatttagtaggatatttaggattgtttaagttttataaaatttgaagattgatatgtatatattattatattatgtttttatattgtttagttatgtttttagttttagaagagttgtaatttaattgatttagttataattgtatatttttagtaaatatattaatatttttttagtttttgaattaaaattatattttaaagaataataattgagaattggtagagaattgtaaattttgtattttgatattatatattatgtaatatattttttttatagatttgaaattattttgtatatgtttaaaattagttaaattggtattaaaatttttaatattttatttaaagtgtattttattttgtaagaaaagtaaatataatttgggttttatttattttaaaggaaaaaagtaagttaaatagggattttatttttttaaaaagtaggtttttgaatttgaaagaattatttttggtgttataaattgaataattttaaaagtaaagtttagaagttttataattatagtttataaagtagtaattaatagttgtaatgaagtttatgtaaataaatttgtagataaaaattgttttaaattgaaattttatatttagagtttatttatattttttaaaatattaattatattgtgttggtatatgtaaataatgattgtaaaaagaaaatggaaaaaaaaaggaatttaaagagaaagaaaaatagattttagttttttttaaaaaaaaaaataggaaaataaagaaataattggaatattaattaggaaataaataataaattagattataaaaatgtaaaagattttgtggttatttagtgtatattttttttttttagatgatagttgtagagatttatatagttatttttttagttaatttagagtagagttttgatcgtaggtttattattttaggttttagtttattttattaaataatgatttgatagtgggagtaaatttatttaattgattagataagtattttaattgaattagaatattaaatgtatatgtttagtatgttatagatggatagatgtatttaattatttcgatttttaaaaagtttggataagaattattttaaaataaataattaaattgaattttattttttaaattaatataagattaatgaagttatttttggtatttttttttttttttaaggtaaattataaagttaaattttattggttaatatgttatgtaaaatttaagtaaaaacgttataaatatttgatttattttttggaagatagttttaatagttattaattgtttttaggattgttaatagattatttttagaattagtggttttttttatgaaaattttagtgaatatatatatgttttttaaataatgatttggtattttatgtagtttttttaatattttaataattgaatagtatttgtttattaagaatatgtattaagtatatgttataagtagatatagttgtaggtattaggttaaataaaatattgaaatagatatggatattagtttaaaataaattaatgatattttaagagtttaagatttagatgtaaatgttttttggtagttattatagttaataaaattaatataattaatatgttttaataatttttattgttaaaaattaatataggaagttttgattaataataaaaaggaatagggaaattaaattttaaattttttattttaagaatttaagtttttattttttaatttagttttaataataaattgaatttaataattaagtatgtattgattttagtttgttatttttgattttaattattaaggggtaattttgtataaggatttaaattttatagttcggtgtaatttgggatttttttttttttatgaaattaaataaatgtatttgtttttatttatgaataaattgtgagattataggtgatttttaaatgttttttttatattttttttaattaaagttatgtaattattaggaaaaatgtaattgtatatttttaaagatgtatattttttttaagagtttaatgggaatattaaaaaagtaaaaataatattgtttttgtatttagtaattttattttatgtaaaattttgggattaatttattttttaatgtaatttttaattttaaggtagtaattgtatatttagtattgattatagaaaaatattaaggagttaaatatttaaaaattttttgagtattatattaatatgtaataattgttagatgttttattggaatttgaatttatgtatgggggatgttaaaaatataagttcgaagtagaaatttaataaatttgaggttttgatataataagatattaaagtagtttatttgttatttttttattttgttgatgttatatggtaaatgattataaatgttttaagtttaattataaagtggtttttgttttggttttttaatttaatagttatttaatgttttggagtaaatataaaaggtagagttattttatttatttatttaatgtataattttttttgttttagaaaagatttaagataatttattaaaaatatgaattttaaatattttattttattttttttttaaggtggtatttaatttgtagaattttttagtagtttttaatttttgatatttattttgggttatttttttttaattgtttaataatattttttgtttagagttattaagttagttaattatatgagttttttaaaatttttagttttggagattgttattattttatatatatatatatatatatatatatatatatatatatatatatatatatatatatatatatatatatgtattatttttattataaatatatgttaaatttgtaatattgtgggatattattgtttgttttatatgaatttataaatattatttgaattgtttagagattgtgttataaattaatttgggttttaggttttatttttttattttttatgtggtgattttgatttagggattaaaattttttaagttttagaatttttttttgtaaaacgtgattaattatttatttattttatttaggttattttattgggtttgaaaaattagttattttatgaaagagtgtatatagagatttggtatagtatttgagagtattggggatacgaataaagtatataagtggttattaatattttttataagagagtaattattttttattggaaattttagaagtttttgttagttagtttttttttttttttttttttttttttttttttttttgagttatagattttattttttataatttaatatttgtattgtttgttgtgttggatatttagattgagattaaaaaaaaaaaaaaatttgggtattttattgttgaaggtagtgaagaggtaataatagttaatatttattgtgggtttattgtttagatagaattgggttaaatgttttttatatattttttagttgatttttatagaaattttttgtggagtgtatattattgtgatttttttagtttttaaagtgaggaaagtgagtattagaaaagttgagtaattggttttatgtaattatataagtcgttagaggttaatagaagatttgatattaggtggtttgattgttaattttgtaatttttattattttgatttattttttggttaatgtttatgtttgtgtttatttaaataatttttttataagtatttgatgttttataaggtaatattgtttaatttatattttattttttaatttggtttaatgaattttgtatgtttatttagattgtttaaattattttattttttttatattgttggttatttttgtaatatattgtaagttatgtttatatagttttaagtggtttaattatgaagtttttggtaatttttaatgattttttgtagataggtatgttaggtgtgtgtttgtaggtatgtgggtgtgtattttttttgagtgtataagtaatattatttaagagagaagaagatagattttttatttaaacgttattttttttttttaaagaaaaattttattaaatatattaaaaaaggtttttagattttataaatatgtatttaaaattagattatgttgtgattttgtatagaaattttgtttttgtaagataagaaaaaggagaggaaaaatgataaaatagaagttaatttgtttttttttttgtttttttataatttaattttttatttttatttatattttatgtagaatgtttataattagaaagaaaggtttttttttttatatattttaagttttagggtatatgtgtatattgtgtaggttatatatgtatatatgtgttatgttggtgcgttgtatttattaattcgttatttagtattaggtatatttttcgatgttatttttattttttttttttttattttataatagtttttagagtgtgatatttttttttttgtgtttatgtgattttattgtttaatattttattgtttttatttattattttggttgttgttgttgtttttgtgggttttttttttttttttttttttttttttttttttttttttttttttttgagacgtaggttagtttttgttgtttaggttggagtgtaatgacgtaatttcggtttattgtaattttttttaggtttaagtaattttttggttttagttttttaagtagttgggattgtaggtgtttgttattatatttgattatttttttgtatttttagtagagatggggttttattattttggttaggttggtttcgaatttttgattttaggtgatttattcgtttcggttttttaaagtattggggttataggtatgagttatcgtattcggtttttatttattgttgaataagaaggttaagattatttagaattatgtgggagaaaacgaggacggttgggtaataatttttggtaagaattagattcgagtcgaaaaaaattagagtaggatattaggtagttatagggagatcgtggaagttttgaagtattgtaattttggttttatgtggagatatttttggttattataattgtagaggtgttgagagggtgtgtgtgtgtgtgtgtgtgtgtgtgtgtgtgtgtgtgtgtgtgtattgtatttatttagttattaaatattttataatgtataagatagattttaaaaatttagtattatttggtttaaattatcgatagaattaagtttgagaaacgtttttaagaaagatattaaaaaagagatttagtaatattgggattagttattgtaaggttttaagtatgatgtattggaaataaagagatgttatattgttttgagtatttgagagtattggggatacgaataaaaagaaattagattttttaaaatgtatatttaaaatagtttaagtagtagaggatgggttttatgtgttttttgaatttaagatttttaaattttgatgagtagtggaaaagagggagaaatatataaaaagtatataggtttttggtatagttttgtgatatataaaatatataaaagtattcggttaatgttaaattgttttattttttttattagtagttagttggaaaagagttaattagataattttattatattttattttgtatgaatatataatttttttgattttttttttattattttaataaatttttattgatatttaattgttatattttatttgttatttattagtgttaaacgaaggaaggtatttatgtttttgggtgtgtttttagttgggttagttttttttaagattattatattttttatgtatagattatgttagttgatgttattttttagtttaattttttatagtttttattaagtatttgttgataagaatgttaggtgaatggaattaagtatatatatatataagaatgttaggtgaatggaattaagtatatatatataatataatatataaaatgtttattttgattatttttttttataaagtggtttaagaagatttttagaattttaaagttaaggggaattaatttgaaaattatataaattaaatgatatatgagttgtattttaattttaaaatataggttttaaattaaaggtattgatgtttttgtttattatttaaaatgtttaggagaaattttaaagaaaatggttttttgagtttttatttaaaatggttagttgattaaaattggattttttagttgttattttcgttgtttattatatataaaaatagttaaatttagagatttttaatacgtttatttttaatttatatgtaaatatatttttagtaattattttagtaattttagaaattattttggataatttgttttatttatttttttgtatgtttaatgatattattttattttaataagttgttttgttattttatttatgtttttgatttaattttaatattgatgtattttttaaaataattttaataaaaattagataatattagagaattattgttaattatgttatgtgtgaaaatggttttgtatataaaaattggtttagggtggtggtgtatatttgtaattttagttattcgagaggttgaggtatgagaattatttgaatttaggaggtggaggttgtagtgagtttagattgtgttattgtattttagtttgggtgaaagagtgagattttgttttaaaatttaaaaaaaaaaaaaaaaaaaaaaaaaaagaagaaaaggaaaatggttttgtgattatgtaagaaaatgattttaattttttgagatttaagttaatgtttttagaaattgttgatgagttgatgagttgagtagtattgatattataatattcggaatttattttttaagtgtttagttttagatagaaagatagagatagtggatagagagaagtaaatatagagttagttagttagataattagataaggtaaatatggtaaaaagtttataattgttaatttagttggttggtttatagatggtgatagtattattttttttatttatgtttgaaaatttaaatagtaaaaaaataagtaaaataataatatattatatatgaagaagtattatatttatttattaaatattaaatttagttatttgatttattaagtattattttggaaatagtttgatttggtgaaattagggttatatattatttatggagttttttataagtagtttaatgtaaaattttaaggtttttatttttaaaatgggaatattaatagtaaatttttgggtagtgttatttttggaatttagaagtgaaaaggagatagttttagttttattattagggttatgaaattataaatataattatataaattgaataagaaaatgtatgtaaagtagttagtatattgttagatatttaaaaaatatttagtaaattagatttggtaatagtaggagtttaatagtagtattagtagtggtagtaataatagaagttatattagttattttaatagtaataggagtagttttagtagtattaatagcgatattagtaatattagtggttatagttatagtagttttgtgtttttttttgtaaaatatagttaaaaatagtacgtattttataggtttgttattaagagtaagttagttcgtatgtatatttataataatttttgatatttagttaattttaattaaatatttgttgttagtagagttggtggtggtagtaatgtttgtagttggatatgatatatttgttatagtatttttgttttttttattttaataagttaaaagtaaagaagaaacgttttattattttatggatatagtatatattagatatatttaataatttttatgtttgtgaaatatattttttaaaggatgtatttttttttaaatatttatatttttttttttattttgaatttgaatggaataaattatttaaatgataattatgagttttaagttttatttagattttttttgtattatatagaatttttttttgtttattaagattaatttaatttgttaatatagcgttattattgagatttatttatattgtagaaatgattttgtagttagtttacgggggaaggtgaaggaagggttgggtatttatatgttggaagttttttgatttaaatttgggaaatttttaagtggttaattatatatatattttggaatatttttgagttttgttattataatttttagtatgtgatttaattttttttatttgaagggaggaattttgtaattgagttaagttgtggtttttagtaaaaatatagtgagtatttgtatttaatttgtggttagaatgtgttgaggtttatgatttttatttgttttgtaagcgttttgttaattattgaggattttaattttttttgaggtatggaaagtgttagtagtatttataaaaattttaggagtgtttttatatatatataattatattgggaatgatattttatatttttttttttttttttttgagaagttttattgttatatgtttattaaatgtagaattagtgagaataaatattatagttgttttttattgttttatgtaagtgggtttatcgataaaagagttaatttttaaattagtttaatattaaatttttagagtagtttaaaaatcgtaaaagagtttatggtgaaaaattaataaatataaatttaatataatgtattttaggatataaaatagtttgtgttttttattatatgtgatagtataagaagaatgattatattatttttattagaataaaataagtgaatgtataaatagtattatgttttaaagagagtttagggaaaaaagatagtaattttattaagaaagaaagaagattagatatattatataaatatttttaaaagggtaattatgatattataatatgtttatttttatattattttttgtttttaattttttgttgtaaagtttaatgaagaaatattttaaattgttaaggtgatttttttgaaaatttaaatttaatgatatggtttattgaaatagtgggagtttagtaatagggttattttttaattagatatcgaagtaattaaagtattgagtttatttaatgaataaatattaaaaaagtgttttttatttgtatgtagatattattttttttaaatataattattattttgtgtcgtaatagtttgaaagattttatttaatatatttatattattgaatatttagtattaagtgtatttgtattaaggatgttaagaaatattaaaatagtttatttaataaatatgtaatgtttattttattttataataattattttatattttatttttttttattaaaaattatttagatatatatgttaattaatttttatgatagattaagaaaaatttatatttattttttttatatatgaattttattttttgtttattttaaaaaaaattttaatataagtaataaaataatattttttattttttttgttagatgaattttatttagtataagaagttaggttagttgtaaagttgggtatagttttttaaattatttttatttttgatattaattgtaagtttaaggggttgtaaaaattatttttagtttttatgtttcgttagaaggtatttatagaatttttttaaagttgttatatatatgggtatagttttttataggagaaggatataaattaaaattagttaaaggaaaaagtatatagggtagagttaagaagtataaaatatagagtttttattatttttttttcgtgtagttaaaatgtattattttgattgttttgatgtgtgatagtatgtttgaagtattgttaattagtaaagtttattaagtttttttgtttagagtttttggggggattttattaattagatatgattgatggatttattgtttatatggttaattttagtttttaggttgattgatattatatgaatcgaagattttattttaagttaaaatgttttatttgtggtatgattaggtttttttttaagattttataggtgtagttaatttttgttcgaaattatatggttggattttttagtatgatttaatttttattttatgattagttttagtttgaagattatagaggtgtggttaatttttattttaaattatatgattggattattttgtatgatttaagattttttaagtaaagaaagatattatagagattattttttagaagttgagggtaatggtaagatttttttttgggtaaggttaaattttttattatatataggggtgggaaaagttagaagtttagtttttttgtatgttagtgatattgttttttttataaatttttatatttttttaataatttttttatttttttatgaaaatagtgtatagatatttgaaatatattatttttggtagtttattttatagatatggatagtaatagttttttttaagttagttattttattttataatattattattattttatttgaaaaaattatttgaaattattgaaagaatgtttatttaataaaaatattttagattattttaatgtatttatttaatatttgttgaatttttttgtatgttagatattatattaagtattttgtatgtaataataaataagatttggttttttttttaaggaattatagtttagtggaagaaattaatagtgatacgattacggtagaaaggaatagttataatgaaattgtatagagggtaataattaatttagttttataattttagatatgggaggggtatttaaaatgtgggttgaatatttatagttaagtaatggaagtgggaggtggggtaatttaggtaatgtaagtgatatatgtaaagttttgacgtgagaatatatagtaaagtatattttatttattgtggttggggtataggagttaggtgtaggggtaatttgtggaggttgaaggtgtgtgtattttatttttatataagaaaagttttattatttgtttagtaaatgttgttattgttatgggttatatgtatttgttaatataattttgaatgtagttgaaaagaagtgaatatatattattttaagagtagatattaaaatttttgataatttgataagtttatttaaataaggtatatttagcgtgattatttgtttggtattgtgttggatttgagaagatagcgtatatagttgtatatatatataatatagggatataatatgtttgttaaataaaatagacgtatttttttatattaaatttatagtcggttagggagaataattttaattatataattataaaagtgtttaattgtatttacgatatgtaatatgatagaagttttatggtagtataataaaatatagaaagggtatttgtttagtttatagaaaatggaaagatttgttggagaaaatgattttaattggtattgggtagaggtgaaggtgataggggagggggtattgaggttatgaggggtatgaattataattttagaagataagataatgtgatgaattagagattgaagagaataagatatatttgtggttttaaaaagagaatgttttgtttggagagtagagtgtgagtgagatggtatattaggtgagttggagtattagagagagtttagagaatggaattaagttggttataataatgttatggtttttgttttaggaaagggaaattttaaaggttttagtttatttgtttttatggagataagtgagttgggtttagttgtatttttaaaaggttattttaggtaattaatagaggaaagaatagagtggaatagtggtggaagtagtgattaaataagatgtaggggtttaggtgagagatgtgggtagtttggataagaggtagtagtgatggaaagaatggataaatttaagaatttatgatgagtttatgagaaagttgaagaaagggaggggttaagaatgttttagaagtttttggaaagttagatgattagaaaaaaatgagtatttgaggaaggaaagttaaatgttattaagaagttaaataagatgagttgaagtagtgggatttagatgagaattgattgaagagtaagaaatgaagaaatggaaaaattaaaaatagaatagatattgttagaatttaagtaaaaattaaataattaaatagtttaatatgagaaaataagaattatttatttttaagagaaagaagagaaaagaagagagaagtaagagattggtagtaggagtggttgttaataagatggtagagtattgggagaggtgaaggttattgggaaatttttagtaaatttacggttaataggatttttaaaaatagaattatgtagtggatgatattttttaaggttgatttattttattttttttttttttttgatataattagttttagtttttttagttgtttagtaaattaattttattaggtaagattttatgttatttggttttttgataaaatagagaaagtgttgaatttttagtttggagttttttggtatgataaaaataaataaataaataaataaataaataaataatagattaagaggatagaaggaaaaaaatttttttattgtaggaatttgtagaaattttgggaattgttttaatttttgattaatttatattttaagggattggaagattttaatcgatattaaattaagattggttaatattaaggattaaggtgtgtggttattgattagttttttatatggagatattaatattttgttttaattaattatattaatatgtttttttagttattatttttaattttattaatttagtaagggttgtaaatttaaatgttttttaagaattggagggaatatgatatatgaagaggttattggtagaatttatggtgaagtaaaacgtttattttatgtatagttatgatatattataggtatttagatatttattattgaaatagtaaattaatatttttggtttataggaaaattaaatgtttatttaaaaattgagttttttaagtttttattttaagaaaatattttggagataattaatatgaattttgatatgtttttgttattatataagttgagtgattttagttattttagttaaattatttggattttttaagtttaatttttattgttaattaaatggatataataagatttattttatagggtagttgttaaaaaagaattgaataaaagtgtgtgtatgtgtgtgtgtgtttgtatgtgtgtatgtatgtgtatatgtgtgtgtgtatatatgtgtgtgtgtgtgtgtgtgtgtgtgtgtatgtatgtatgtatgtatatatttgtatagattaggattcggtatagagtaggtattgaataattattagttatttttggaaattatattgaaatggtgttttattattataagtaaaatttttttaagatttaaaaatatgtgttgaatatttttggaggtaatagaatagagtattgaataaaataaatatttttgttttcgtagaatttataatttggtaatagagtatatgttagtggaattgtatatttttttaatttttgtaaatttttagtatttttgtaaaatgaattgtggtatatattaaaattagttaattagattagttttgtgaaattaaattaattatttttttaaattatatagtatttgtttgtatttattgatatttaaaatttattgatatttattagattttaatatttttttttaagagatattaatgaaatagttttattttttgagtttttttcgatataattttttgattgtggaaataatagaatgttaaagatatgaaagttaaaaaatattttattaataaattatttattttattttttagttgagaaattgaagtttagagtaaggatatagagttagtatgtttaaaatatattttttaagtggtgtttattttgttaggggaaaaaattattttttggattttaaatgttatataattggtgaaaaatgtattgatttgaataattgttgtttttgttaatagttggattttaatggggaattattaattcgaaatgcgtagttgaaatatgttggaagatatatatgtattgtttagataattgtggataattttttagttttagttgattttgtagtgagaggtaagagttttaatattttaaaattataaaattaaaagtatttgatttgtataaatatgtataattttttggtaattttggtgtaaatttttatatatttagagttttaattttatgtttaagaatggattttaagtttttttttatgtttaagaatgatttatgttagataagtagtaaataatattgattttgtttgttttattaattacgtattttttagaaagttatattatatattttttattaaatgtttgtgttttgtagatttattaaaagttttcgttttttgttaatattttttagtgtgttgtgtatagtgttgtttttttttttatttttatggaaaagatatatattgatgttgtttattataattttaattgttatatatttattatttttgttttagagtgtaaagttaatttatatatgtattatgtttttatttgttgttggtttttttaaattagtgttttcgtttttatgaataatataattgagattgtgatggaatatatatttattaaaaatgtaatttttttgttattggtcgttgttatagtagtgaggttggttgggaatatagtatattttgtttaaaataaagagttggttttttattgattgttttttagttttgtatttaagaagtattatgtgttgattttagtttgtttatttttaatattttattttatgtaattaattttaattatttaattaatttataaaaatatattttaatttttatgttagttgttttatttatagtattttttttatgttttttttttatgatttgttgattaaattttatttattttttaagttttaaagtatatattaagtttatgaattttttttttgatgtttttaatatgagtttcgattttttgaatttttataatatatattgtttttttttatatgttttatagtagttggtatatagttatttatttttttaagttgtaaaatttatatatgttttttttttagtgaatggtagagtttttttgtattgtttcgtagttttttttttttgttttagtgttagttaaaattattatttttttatattttatttattaaaaatatttattgaatattaattgtatattttgtttttattttttatattattagataaattggtaataaaatgatatttgtggtttgtttattttaattttttttttatatttgggttaatataattttatttaattttatgtagtttttgtatttttttttagagtaatgttaatatggggtttttaagtaatattgggtaaatgttgaaaatttttttattttatttgaatatattttttaatagagttttaagaagtttagttgaagtttttttatttgaatgaatttggaaatatattttataaattatttattgaataataataaataaaaatgagattataaaattttaagttaaataaaatttatttaggtttagtatttttatttattttgttatttgggatattgattgtttttaagaattattagggagagggattagagggattagtttattattttttttagttagattattagttgttaagttatttttagaagtagttaaagtgtatatttaattgaaattgtttgtatatgaaaataattagtattaatattgtaataggagttatgttatagtgtgtggatataaatgtttttatatgattatattgtagtaaatttatagtattattattatagaatattttgtaatatttagagtgaagaggaattttatagatgaaatgtaagggtagttatgatattagttatatatatttaggtaattaattattattattatatgtatttttatagagaattaataaaaagaagttatagttaatattatgtagaaataaaaacgtatatagtattttaagtttttgtattatagtaggatgttaataaaattatataggtatatgaaaatattgtttatttttgttaaagttagtagagttataattattttttaaattttatttttaataatagaaaaagtatttattttatattaaaagaaatttgtaattaaaatagttaaatatatttgattattgtagaatttgtgttaaaaatatgtatagatgttttaatatgttttatatatttaaattagaaggtagataattaaatagttgtttttattttttaataataatggtgagtaatgtataagatatgttttgttttaagtgatattattattggtttatttatttatttaattatatttttgtatttagtttaggaaattataatttggagtttatgaataggttttaagggatttatggattattagaaattgtatataaaattttacgtgtatgtatatttttttgggaaaatgatttgtaatttttataagattttcgtagttagtaatgttttataaggtattaaaaagttaatttattttttatttttttatttagattaagattttttaataaaataaattgaagagatgattatttattttatgtaaaagaataaaatattaatatattttatgtagttaaatttaatagtatatttagattgtgaattgtttttaaaagattcgatttgtatttaattttttaaaattatatgtttgtaaaaaatattaaatatgttatgtagtagatagtagaaatttataagaattttttatatttgagatggattaattttaatttatatttagatattggtaatttgaattgtagttgttgaaattagtggtgtaatgagaaggatagtaaatatagtagaggggaaagtaattttatttgaggatcgttaaaaaattttttataataaaattatttttgtgtataaatgattatgttttattagagaagattgaaataaaagtataaatatttagatataattaagattgtggattttttttagtttatattatattgaaggaaatgaatatatagtaagaatagtgttgttgttttaattaatatgtgtgtgtgcgtgtgtgtgtatgtgtgtacgtatttgtaattgtgggtggaaaagggtgagtatatgtatatagtatgatgaaagtaatttttattagaaaagaagtgtgttttaatttattttttgtttttttattgtatattgagtttagaatgtaagtagttaagtagttaaatttgaatgtttttaaatataaaattaaaattaaatgtaggaaaaatatagttaatggaaaatgtagtattggatttgattttatggggttttttattgagagaaaatattttcgttgtgagttttttgtgttatgtatggtaggatttagaaatgaagaaagtagtggtaattgtcgttaaagaaaaataatttgtagaaaatgttttcgataataagatatgaattattgtaattttgtaaaagtataaatgtgtatttatagaaagttatagtattttaatttatttattatataattgggtttaaagatgtttgaggaaaagaggttagtaaagttgtatgtattgtttaattttttagttttgtaaataattttaaattatgagattgtattgattatgtaatttttattttttttttttaaagttggtttttatatgagttatatttgttaattttggtaatatttttgttagtttttttatagtatagagattatttttgtaagagtaatatttttttaaatgttgttgtttaggaggtttaatatataaaatcgaagatgaagataaataaataaatatttgtgtcgttataattttggtaaaagtagattatttattttgaaataggatatttttaattagttttttaaggattttaataaatttagataaataaaatatgaatttatataaaaaatgaaaattgatggttaggtgtggtggtttataattgtaattttagtattttgggaggttaaggagtgcgtattgttttgagattagtttgagtaatatggtaaaaaattcgtttttattaaaaatataaaaataagttaggtatggtggtaagagattaaaatgttatgtttgatatgatgatatttaaataatttatagaagattttagtgaaagtttattttttttttatgaagaatatatattgattttaattttttaattttttaaataatattgttggtgaaaggagtaattttagaattatttttttaagataggggtttgtataatatatttgaaggaatttagaatttaaattattatagattatttaatatttaagaggttttaaatatgttgcgttatgtttaaaatgtttaaaatatttatattttaaaatgttaatattaatatttaaaatgttaatatttaaaggttttaaatatgttgttttatattgttttagttttaaaataagaattaggtattatattttagatgtttttaggtttttggtataaaagtttatattaagagtattgatataaattttttttgttgttgtaataaaatttttattttttaggttttataaaagtatatttcgggttgtttcgttaaagtaagtgtttgatgtttgtgaatagttttgtatgaatattttttagtaaataatatttttaaagttttttagttaaaagagtgttatttagaggtaagagttttgtaggatttatatagtaagatttattttggaaatttatgtgtagtttgttaaatttaaatttttatttatgagtgtatttttggataatatttaaaaatagattataaaattaggttttaaatgaaaaagaaattaggttttaatttgtatatgtattattattttttttggtatttttgatgtattataaatattttggtaatgtttttggttaaggaatatttttttgttatttgggtgaataaaatatgtttgttattgaaattgttaaaatagaaaatgtaattaagattatattttatatattatatatttgtttatattttatgtgttatattaaatgacgtttgtttatttaaatttgagtttaaaaataaataaaagaaaaagaaaacgattttgttatttaaatttttttttttggtttggtttttaattttaatatatgttgtatagaattttaaaatgttttggaaaaagagtagttgaaattaaagtaaatgatatgaaaattttgtaaattattttttttttaaaagaagtttgtgttgtttatattattatattagaagtttatttatttaattttacgtggatttgtatttaggtgaaaatatcgtgtaagtgagtgtgtgtgtgtgtgtgtgtgtgtgtgtgtgtgtgtatgtagttttttattttatttttaaggaaaaaatatagttatagaatggagagagatattagttagaggttatttttattgatatattttgttaaggtttttattgtttagtttaatgacgtggttattagatttttttttaagaaggttatttagttgattattaaattatttttaaatttttggataagttaaagtaatacggtcgaataaataaataagttaataagtttgatggaagttgttagtatacgttttagttggaataatattgtagtattttaaagtattataatagttgtttaaaggttttttttatggaaaatgtttttgggtattttatttttagttggtttatattagtagagttaatatttagagtattttattttttattgtttagataaaattagttttgaagtatttatttggagatgatggtttaggaaaattagtattttttttttgtaagaaatatggaatagataaatattttttttttttaagataaaagtgttttaatggttttattattggtaaattatgtgttagttacgtttttttttttttttatttttttatagtaattatatgaaatttttgtatttatgtttaaatttgaaaatataattttaaatgtagaattaattttatgggttatttagaaagtttttatttttttatttaataatttggattttgagagaaagagttttttttttgtattttttatttatatggtggtaaataataattttgggattttagtttagtttttttattgtattagattttttttagaaagtatggataaataaaatttatagttaatttttaaaatttattatattagaaagattattaagtttattttggagttggtaggataaatttttttattaatttttattaaatagtaaaagttattgattttagtttttgtttttttttttttttgtttttattatttggtatatgttaatataaaatatataatttttaaaatattgtaggaaaaataaagttaaagatatgtattataaatagatgtaattattaatttttggattatttagggttttatttgtatgattagtttagggattttggatattagtgagggttataggatcgtatgttgttatgtgaaaagtttgtgtaatttttggtgttaaattagattttaagtttttgtggtatttggtataaatgtttatattgtgtttaagaatttttatatttaatatatttttaaataagtaaatatggttttatgtttgaaattattattaaggtatggtaggttaaaataaattaaaaaggatttttaaattaagtaatttaagtattatgtagttgagaagaatagatataaaagttttatataatatatatattaagttaaataggcgtgtaagtatatatattttattatattatatatatatatatatatatatatatatatatatatatacgtacgtattggaagagatttaggaaagagacgattatataaaggtagaaagatttgggtttaaattattatagttaaattaaagagaatggttgaggtagttttttaagtatttggggtagaaaaatatatatttattttagatatttggataattgtttttattttttatttgttttggttaacgaagttttgttatagagatagattagagattttattttattagttttgtagaattgagataggaaaatggtttttgttgtttatattggttggaataatgataattgggcgttattttgagttattttgattttattttgtattaattatagtaatgtatttattgatagtaaaatttgtttagaaattaagtttttttttttttattgagaattaataaatttagattaaagaaatacgattgggttggttttttataattgtaatatataaaagttaaaatattgagttgaaatgtatatttggttataataaatgtagaatttagaaaatttaaagttagaatttagtggttatttaaataaaaattttagtaaaaatgatagtttttttaattatttttggaattttaaagtatattaataatttgaaattgtattttttaatgtaagtttagcgtaaattgaggtatatttaagaatttttttaaatatggttataaaataggtaatttatttagaatgatttatattattttaaattttaagataggttttgaaaattatttagatgaatattttattttataaatttaaaatttaaaatataaggataagaagatattatgttatgcgttaatataaatttagatttttttttttttttatattagagtatagtgagaaaagttttcgtggaggatttttttttttttgtaattaattattttcgggttttttataattaaattggttagtttttggtaaattggaatttttttttttgttgtatatttagtgtgtatttatggtttttttaaaaaataatcggttaggggaggtagaggtaggagaattgtttgaatttagggggcggaggttgtagtgagttaagattatgttattgtattttagtttgggtagtagagcgagattttattttattttaaataataataattataataataataattagtttggtgtagtggtttatggttgtaattttagtattttgggaggttaaggcgggtggattaggaggttaggagttcgagattaatttgattaatatggtgaaattttatttttattaaaaataaaaaaattattgggtgtggtggtatatgtttgtagttttttttgtttgggaggttgagataggagaattatttgaatttaggaggtggaggttgtagtaagtcgagatcgtgttattgtattttagtttgggcgatagagtgagattgttttaaaaaaataaaataaaataaataaataaataaaaaataatttttttattatttagtttgattttagggagatagtaggaaagttttatagaatttagtaggttttgggagtttttagatattgtatgtattttagtgttttatagtgatttatatatttatgcgtatttattagataattatgttaaattaggttataattatgttaataatgttaaagtttaagagtaatatagataattagagatatttataagtttcgaagaatatgaataaatggtaattagtttatattttgaaagtaattgtgatgtatgttggtaaaatattatatttttttaatttaaatttttaggttgtgaaaaggtatttatataaaatgatgaatataaaatgaaaataaagatatataattatataatttaatatataatgatagaatgtaattatatagtatgttataataaaatatatattatatgttatataatatgtattgattatattataaaatgatatataatatttattaaagatattgtttattagatttaattttaaaggataggtatcgttattgtattatatttattttatatatgagaaaattgaatttaatgaggttaagttaattattaaaggttataaagttattaagtggaagaataaggtttgaatgtagatagtttaattttaggtagaatatttagtttatggttgtagtatattataattaaaatttaatttaaatatatttaatgtgataaaataattagtgtggaaaagttaagttgttggttttttatttttttggtaataaatgtttattttatagagtgttattgatattgattttgttattttatttttgtttatgttatatttatggttggtttattataagggaaattatagtagttattttttttttagttatttaattttatatagttataattataatagtaaaattaataaatgaattgtattagatggtttgaaagtttgattttataatgtgttttttggtttaaaaataggtaaatgaaattttgatgtgtgtttttttgttttttaaaataatgtataatttatatagttaaaaatagtttatttagaatatttaaatattttagattataatgtttatatttataggatttttttataaattttattacgttattttataaaattgttgtgaggtggtagtataaggattgttatttttattttataggtaaaggaagtttaaaaaagaaaaaaaatatatttttaattattagttataaagttagaatgtggttagatattagtgttttaaatttaattatatgaatatgtttttttttttttgatgtttaatgtttttaaagatagaagttagattatataattttgtattgtgtatttttattattgttggtatatggtttgttaaattaattaggtaatttttttaaaatattttgagttattgataattttaagttaagttagagagtagagtaatattttagttcgtttaaaattagaattttattaatagtttttttttttagtttattttattaaataagataaaaatattttagttttattgttgaaaatataattaagaaaaaatttaacgacgtaaaatttttttcgagtagttttattatttatgatttttgtgtagtttgttatttttagtttcgtgattatgtagtgtttttttgagggagttttttgtgggtttgttttttatttagtttttggaaatttaatttggttataaaagtttgggtatattagaatgaaggaaatttagaaaaagtttttattttttaaatttattatcggtttatgaagttatagagagattttagtgtttttgaatttttataatagtttttttaattttaattgttattattgggattaaatgaaatatatatagagagagaaagaaatgtttaagtattttgtaattgacgtttagttaggatattttattagattagagtagtaaggtatagttttaaattttttttttgttagagtgtttttttattattatgtttaattgtatattatatttttataattgattgtagattttggtataaatttaaaaaaattttttttttttaaaaagtataatattattttaattgttatttgtttaatgttagttaatagtgatgattattgtgtggatatgggaagatataagggagtggttgaggtttatgtgtattttttagggtatttttgaagagttaatatttttatttaaaagtgtattgggatgtaagtgagtgagagttagtatgttattaggataattttgaatttattttattttttgggaaaaaaatgtagaaatttttgaatttttaattttattagtagtaaattatttgtgatatattagagtgtagagattttttgtgtaattatttttagaatggtttaacgttcgttattttgaagaatttatttttgagtatttgttttttgtatttttagcgatttttaataatgagagtttgatttcgttttttttttatatatttttgagaatttttcgagaagaaaggaattgttattgatagaaatatgttagatttcgttgatgtgtagggtttaagtaatttggaggattattatttgatatttttttatattgtttggtagatatagtgattaatttaaggaaatggtatttttttttggaggagtttaggaaggtttttttggtgattgtttatagtattttttttttagatttaaaattttaaattatagataagtaaattttggtaaaatattaaaaattatttaaattgcgtttaaaagaaaaaaaaaagaatatatttaaaattaggatttttagtttttattaaaaggatttaaaattttatatgtttaaaatgttaaatgttttacgattttttttttattatttatcgtaaggattgaatttataataagtagttagtataggtaagtttttttagttttcgttttttttatttaaatagttatttttagggggtagtagtggttataaaatggtataattttaataataattatttttagttatgcgtaggggaatgaggtaggtgattattttgttaattatatggttttttataataatattgttgtattaatatatatatattgttgttaaatgattatatggttttttataataatatttttgtattaatatatatatattgttgttaaatgatttgtatggtgtgatttaaaagttgtggtttttggtattaggtaaatcgattagatatttattttgtttatttaatttatggttttaggttagtttattaattattgtaagttttaagttttatatttatgaaagagaatatgagtagttatagtttatatattgtttatggtaattttttataaatattgttttttatttttttttttttattatgaatgtatatatcgatataagaaataaataaaatataatttaagatatagtttttataaaatagttttaatcgttgattaatttttttaaattattgttttaatttatttttattatttttatttttagaagtttttaaggtataattatatgttttagtagatagatttgtattttgtggaatgaaatttataaaggatttacgagatttgttttatttatttgttttttgaggagagattttagttataacgtttgttttttagaaagttagttattgtgtatgagggaaaggttttaattgggttatagtttgtggtatcggttttttttttttggtttttcgtttttagtgtgtaggggaagatatttttttgtgtttatttttttattttatttattaaggaaatagggtaaattttttaagtgtatggttttttgtttttaattgggtatttatattttttttttagttttgatttttttttttgtaggtaaaaatagaaaaggtggagagaaaaatatggtggattttttttttttcgtttgtgtaagtttgtttttaatttggtgatcgttgatatttattatttttgtgaaagatttttttttttttaatatattatattagatttgattaatttaattttgtagtttttgtagttttttttatttttaatttagtttttagagtatgtttttttttttgaaatatgtaaatatattttgggtataaatattttttaaaatataattataatgttttattaatattttaaaaatgtttagtgaattaatttagtatattatataatggttaagtgaaagttttgtgtttttatgttttgtttttttttgaaattatatagtttagaaattagtttattatttgaaaaacgtatgaagaattgatgaattgtataatataggagtattgttattgaatgtattgtttgatttatttaagtaggtaatgaataatgttgttaaattttttaatgagatattataattaggatataagttaaaaggggtattatttcggtagttttttttttttaattttagtattatatatattttttggtatgaaagaatgaaaagtattagtaaataattgaagttttattatggttttgtagggtttttggaataatttttggaattggaaagtgaaaatggatagtatgtgggggaaatttttatttgagtagtaagattttagtaaagatgattaagttattaatagtatgtatttatatttaattttattgatttttgttattagtttttgtagatcgtttgggtggaaggttgtgatttttattgggaggatttgagtagaagtggatgattaaaattgaggagtatataattttttttgggattgtttaaatgttattgtttgaaaatatttttattttttttttttggttaaagagatgtgtttaaaatttttatttttttataataaataattttgatttttttagataggtttgtgtttaggtatgagttttttttttattttatttagtaattttttttgtggttagaagaattttgaagaaagttttgagggaaatgaatataatttttaaattattatatgtgtgtgtatatatatagtttaattttaaaaataatttattagttattataaagaaataaatgtttttggtttaagatgttatttattttttttttttatattttttagttttaattattgttttaaaaggagttattttagaatttagattagagatttagattaattgttatttttgtaagatgtttaaaattaatttgagaatttttatgtgtttgtaaatagtattatggagatatgtatgaatcgtattaagggtatttttttatgtagtttatattgaaattatataattaagattagataggaatattttttattttattttattattatattttaagttttagggtatatgtgtataatgtgtaggttagttatatatgtatatatgtgttatgttggtgtgttgtatttattaatttattatttagtattaagtattttgttttttaaagaaataataaaaattttaaaggaaattataggatagatgtgatttgtattagaaagggaaggataattttaaattatattaatattaagtagaagaattatataggtttatttatttttttttagttttgtttttatttttaattgggatttaaatttatttttattaatattagaggttaagaaaattattatatttttattaaatggtagagatatttaataagatttagttttattttagtataattttaaatattaatatgattagaaaatattgatttatattttaaaataggatattggagttattgttttagataatttttaaggtaagaataagtttgtaataaataatgagattttgatattttttggcgaagaagatgttttttgttttaatatgattgttatttagtaattttaattttatgtttatttgatttaaaaagggaggataaattgttttgaaaagttttttgtttttttaatattttaaagtttttattgaaatttgttgttttggtaaaaataaatagttaattatagaatatttttacgtggtgttttgtttttaattatttattagggaattattagtggaaaaaagaatgttattagtgttttttttatttatattagttttgtagtatgaatatttatattaaatgtatgtgttatatgaattttttaaagggttagtagttttggggggtttatttttaattatagttgtttagaaagttagtgtttaagagggagagagtaggttagggttattatttaagtagtggtattaatttaaatgatacgtggggtgtagttatagttattttatattttgtttataaattgagatacgaggattttaatttttagttttttatttaatttgatttattaaaaaaatgaattttgattattgattaagaaaatatggttagtttattatgtgtgaatggttatttggaaaatttatatattgtttttttattatttttttttaaatgtttaaatttttttttattgaatgttattatatttttaaagtagaaatgatagaattgattaattatatttttttttatttttaaaaattagtttatatatgaatgaaaattgagtaaaaattaaatttatattttgtttatatataggtatgtttttttaaaaatattagtaaaatttaggaaagattattaaatatatttatagtaattaataaagagtgggaatgtattgaatatgaatttataaatggatgatgtgtttatttttatttatttgagttaatattgaaataaagatttaaaaaggtatgattggttaggtatgatggtatatattagtattttgggagattgagatgggattatataagtttaggagtttaaggttagtttaggtaacgtggtgaaattttatttttataaaaataaaaaataaaaataaaaaataaaaaaaagttatgattagtatgttatagtttttgttatattttttaaaatatttatttgtatataagtaatttatattttttttaaaaagaaaagttagtaacggaaatttaataatatttttgaatgtgatattgataatgttgttttaaaaatattgtttttaggatagttgttgaaaatttggttttatgataaattgattaggtttagattttaattttgatatttatttgttgggtgaacgtggttattttatttaatttatttttgtttgtttttttatttgtaaaataggaaaaataatagtatttatattatagggttattggtaagaattataaaagatttggtagtgattttaatataagtatttagaaaaaagtataatttttattaaaatgtatagtataaattttttttttttgaatgattaataattttatattatgtaaattttatattgttagtagtttaagtttaaagagaataatagtgtagatttgttgttatttaggtaattatttggaagttttttgtagataggtatatttaagttgtataatttaaatttgaaaatagatgtttttttattttgagcgtgttatattagaaaattttgtttttgattttatttttgtattttgttattgattagttatgtatttttgataatagtttttatagatttcggtgtttttttgtaaaatggattatatatatatatatatatatatatatatatatatatatatatatgttttagtggatttttaaatgtatgtgatttattttaaatattgaaatgtttttattatttgtttgtagtgtatgatttaattgtaaaaatgttgaaaatataaatttagagaaagagagtaggggtgtggtaaatgagattttgtattgaattatgaatgatagaatgataggagattatttaggtcgtttttttagttttttattaggttaaaaagtgatagaaataggttttagtagttgttcgtaaatttgtttttagttaattttgaagaatttttaaggtaagaaatataatattaataaggattttgatagattattatttttgtatgttttataggtgaaattttatggaatatttttagttagtattttttaagaggaatttttaaagtgagagtgaaagaatataatgggtgtaaaataagaatagtaagagagggggttatgtaaataggaaagaaagaatagtttatagaggtagttattatttgaagtatagaaaggtagtttaaagaagggtagtaatttgaatattatgattttgaatgggaaaataagaattaaaaaaattaatattgaagtttgttttgttaattgtaatgaaagaggaatttaattagttggataggttgagtataattagtggtatttatttttgatgatattttgtgagtatttgaaagaattaggaaatagaaatagtataaatagtagggatatgatatatgagcgtaataaaatgtattttaaaaattcgagagtatgggtagggggaggtggtgataagagaggagtgaagataaaattgtatttataaaagtataaaataaaaagtatgttttaaataattttttatttttttttttatattgttttttttttttttttttatttttttttaattttttaatattaatgttagtgagaaaaatggataaaaagattttgttaggtttagttagaaatatattttagtttttttttttttaattttagatttttaataattatagttaaagaaagaaaaaagaaaaatagaagataaatttgttatttaatgtatttaggtatttaaaattaggttagattttaatagttttttttaattgattaattttttttttttatgttaattttggggtaaatagtttttagaatttttagttatttggttgagaatagtttaagaaattggaaggagatattagtaaagtaatagtgaaataagttgtatgtattaggttatttgtttatattttttttggttttttgaaggatttattgagagcgtatggtaatggaaattaaaaaaagaaaaaaaaaaaagaaagaaagaatttagggttagaattatgtatggttgggttttttttattgataaaagaattagaagagtggttagtttttaaatgtttttttttgtgttgagaataaagtagttttgttattttattttttattttaatatttttttgtttattttaaataaaaaaaataagtaagtaatattagtttatattgtttgaaaatttttttgttgagagatattgtagggttggttttgggttgaagttcgatcgtttacgtttgttttcgtgttttattttttgttataaattgattttttaatatatagagtatttttatatttttaaattttttttatttatattaaaattattggaaaatattttattttttatgttgttttataaattaaagagtatttgagataagttttaagaaagtttattttgttaaggttatgaatgtatttgtgatatagttttaggaggttttgacgatttgttttcgaggttgttgggatatagtttggttttatgtattttagggggatatgagatattaattaatatatgtaagatgtatattggttttatttgggaaggtgggataatttaaaatggggggtttttagattagaggtagatttaaggattttttgattggtaattggttgaaagagttattattaatagaaaagaatgtttgtattattatatagatttgtgggtggcggaaattaaggttttttttcgtagatgaagtttttaggtagtaagttttagaaaatagattgtaaatgttttttattagatttaagaagtttgttttattaataatttttaaagggaggagggtgtaatgaggtatgtttggttgtttttttttattattttttgaattagttttttaggttatttttggattgtttttgttaagaaaagggttttttttagatggttggggggtttagaattttatttttggtttattgtttttgtttttttttaagtaataagtggtaaatgaatattttgtaaatagatttttggaatgattgataaagtattaattaataatttttgttaggtagttaagatgtttagaaattttttaaagaagtaatgataataataatattgttaatagataaggttttttgatggttttttatgtattaggttgagaattatattttttaaggatattattttagttttaataattatttgttttgttttgttttgttttgttttgttttgttttgttttgttttgttttgttttgaaaaggagttttattttgttatttaggttggagtgtagtggcgtaattttggttcgttgtaatttttgttttttaggtttaagtaatttttttgttttagttttttgaatagttgggattattaggtgtgtattgttatgttagttgatttttgtatttttcgtagagattcggttttattatgttggttaggttgtttttgaatttttgattttaggtaatttatttgttttggtttttaaagtgttgggattatagacgtgagttattatatttggtttaaaaataattttatatgttcggtttttattatttttgttttatagatgagtaaataggaatttaacgattttaagaaatttgtttaagataaattagggtatagaattgaaagttgagtttattttaattttaaaatttttgttttttaatataattatgattttaatagtattattttttttaggtatttttggggagatatttgtaggtaattattagatggaaaaatttattttatattagtggaattattatcgagtaaaatttttatattagggttttgaagatattaatataattttttttatttgttttttcgattttatttttttatgatgatatagtattttaagataattggaaaaatgaagattgtattgtggatgataattatgtttatagaattgtttgaatattaattataataaatttatttatttatatattaaatatttatgaagaatttattataagttagatatgtattcgagaaaataatggataagtataattatagtgttttgtttaataatattatttttaaatgagtggatgattgaattattatgtatataatgttttaataaatatattaataatatgtagttttattttgatttttatgaaatattatttatttgatattttaagaatattagagaataatagtagggaaatgatttatattttaatggttaatgattaatttatgataattttgttttaaattttttttaacgttttttgaatgttatatttttatgtttagaaaaagtaattgaatgtatgtattatagggttttttttttatttgagaaatttttttattatttatttttaattttttattttaatattttgaaatattttatttagtaattgatttaggatgttgtattatgtgaagtaatgaattttttggttttgattaagaatgtatattgtattttaatgtgtttttttatatatgaaaaatgtaatatgttttttttgaatattaaatgtgttttgttatgtgtttatttttaattatttaatattaagaagtttaagtatattattataggttataaatttataaaagttcgtttgttttttttatatgtgatatatttttaaataataaaatttattgttatggatagggtatgtgttttgtgttattttaatattggtggtgatgtgtttttgttgatttgtatatatttttttttttgggattattttaaggaaatgggtgaaggtttggggtgttggttatatttttgtaaatattaatgtttttataaagaaaaaggttatttaagttaagtaatttaattgatatataaatataaaggtatatattttagttgaaagataaagataaatgttttttttagtattatattaattatgaaaaatgatggtgttatttaataaaaattattaattattatattaaatatgtttaaattaattgggggtggatttttttttggtgtaaatagaataagtgatatgtatgtttagttataaatattttgaaatgtttatattaggagttgtttattaattgagagatttttttagtttttgaagtgatagatgttattttattatttaaaggatattttttttttatttttatttgttttatttgaagataaaaagttttttaaagtttaaaaagttgtgttttatttattttttaatttttattttttagtatagtgtattgttgaaaggaaaaaggaattatattggtattgagttatgaagtatttatgaaaatttatttttaatattgttttttgttttgttagaataatttttttaagattttttaatataatttgaggttttaagagtatttttggtatatttttgaattgataattattttttatatattatataagtagaaatatttttaatattatttatttttatgattataattaatatgaaatgtattatgtaaaatgatatatgaaattatttttagaaatttttattttaagtaaaatgaattatttataatatttagagttataagaaagtatgtgggttagtgcggtggtttatatttgtagttttaatattttggaatgtttaggtatgaggattatttgagtttagaatttggagattagtttggataatacggtgaaatttagtttttgtaaaagagtatatatatgtatataaaaattagttgggtgttgtggagtgtttgtagttttagttatttgggcggttgagttgggaggattttttgagttggggaggtagggagaggttgtagtgagttatgattatttttattgtattttagtttgggtgatagagtgagattttaatttaaaaaaaaaaaaaaaagttataaagaataaagaggatgtgtttagttttggggaggtagaatgataatagattaaatgtttttatatttaaattgaattgtgttattatttgatttatgtatttagtaagaatttattaaattatgttatgttataatttgttaggtttttttggtgttaattgtatataatgagttagagattattatatttgtataataatgttatttttaaatgatagtatttatttttttttttaaaaagagatatatgaaattatttagtgaaaattataaatgatattattttttataatttatatttaaaagaaatgtagatatattgattatattggataaatgttttttagattaatggttagaagatatttttatattttaatgtgtgtttgatttattagatggaatttattgatttattatttatatttttattttaggttttttaggttttttaggtggtttgagaatagaagatattagagttatttttgtggtatttatttggagtcgtggtttagataattatagttttatttttaaatatattatttagattaagattatttttttagatgattggaaagatgtaaagataggtgagttttatttgtttgattaattcgtgtatgtttttaaagtgaattttttttttaaaaataaaaatttggaggttttaaaaatgttattatttattttgaaaggtttttttttttaaattttttaaaatgtattttaatattttggtaatgaagaaaattatatagaatttatatatttaaatgtgttaaagttatagaaaaagaagtattatttttaaattaatatataatggaaagtaaaatgaggttttttgggttttttatttgagttttgtgtgagatttattgttttaaaattatcgggaagtttatttttgagtaaatagtatttatagtatagtatttatgattttttttatttgggtatatatgtattatagttttgaatttttaaaaaattatattgattataaattttaaattaagtatttaaattttattattataattttttatgtgaatgattttattcggtttgaatttttttaaaatagatttttaaagatattttggattttttaatttttttttttttttatattaagattttttaaagttgatcgggaaaaattaattaagaataagtgggtatttttttttgtttataattttgttatttgttatgattagtttataatattatatattaatatatatatttttttttgtaaaatggaagattgaagatttttttgataaaataatttgtttatttttgtaatttttgataatatttttaaataaatttgttattgttagaattttttaagatggaaaagaggagatatagaaatatttttttagttgttataagaggagaaatgagatacgagtgtgtgaataaaatgttttttttttttaaaaaattaaaaaaaaaaaaaatattttaattttttaaatttgtttttattttagatttattttaatataatggaaattttatttttaaaatgtttatatttgtattgtttattaagatattttaatttaaatttatttttatttgatatttttttttttttagggaaataaattaaatataaatttgaggtttgttgtaaggatttaggatatattttaatattagatgattttttatttaagtgtataaagttgtaataaattagaaataggtgaaatatttttattatattatgtttattgttttaagaattatttgtaaatatttttgataaaattagattatttgaaaaataattttaaaaattttttagatattttataaatttaaagtatgggtagtttttatttttttgaagagaatggaaaagtatgataataatgaaattattagaaatttagttatattaaaataagtaaatggtttaaatttggtttggttttgaaaaaagaaatattaattgtaattatttttattatttatgtatgtttattatgtagtttaatttaaatatgttttttattttaaaatatttattagaaagtaagttttatgaaggtaaaaattgttttatttattgttttatttttagtatttatattagggtttatagtgtttatttattaaatatgtttattgagtttttattgtgtgttagaatttattttagatgtagtatgtataggtgagtagtagtgaatataataataataataaaatttgtttttaaggagtttatattatagtagaagagatgttaatatagaattaaaatatatagtaagttatgtggtgatgaatgttagagagaaataatagaaaagaggaatggggaagtaggagatgtgttttaaatagggtattttttatatttttatttataggtgggaattgaataatgagaatatttggatatagggtggggaatattatatatcggggtttgttttggggtggggggaggggggaggatagtattaggagatatatttaatgtaaatgatgagttaatgggtgtagtaaattaatatggtatatgtatatatatgtaataaatttgtatattgtgtatatgtattttagaatttaaagtataataaaataaataaataagtaaatagggtatttttgatattagtaatagttattgttgttttttgaaagtttttatttttattatatattttttttaatttttttatttttattgaatttgggtttttgaatttaaagtatgttttttgttggttatatatagttggattttttatttagtttgatagtttttgttttttgattgaattaattaattaatatttaatgttattattgatatagttggattgtagttgtattgtatttttgttttttaaatattttattatttttgttttttttttttttgtttattgtttttttttggaagaagtgagtattttttagtgtaatattttaatttttttgatgatatttatcgtgtgtgtgtgtgtgtgtgtgtgtgagtgtatgtgtgtatgtgtgtatatgtataattttgttttgaagggaagtttatatttattatatatgtgtatatttaaatatatatatatttaatgaatattttagggtttattagatatatttgaatttattagaataggttttataattttattagtttaaatttttagtgaatatgaaagtgttttttttatatagttttattttatttttttttttttgtgttattatagtattatatatatatattatatattatattattatatattaatagtatatatagtaatatagttatatattattataatattgtatattaatattttgttatatatgttattatagtatattttattatatgttattatagtatattttattttatgttattatagtatattttattatatgttattatagtatattttattatatgttatgttatatatagtaatatatatattgttataatagtatataatatatgatattaatatttagtaatatattattaaatatattatttatatatagaggattaaatatattacgtataaaagaggaagatgaaataaagttatttaggggaaatatttttatatttagtgaaatatatataaatatatatattatatttttatatgttataaatttaataattttatattaatattattattttttataaatgtttgtttattaaattaatatgtttatattattttttgttaatttgtttgttatattattttttatatttattatttttaattttttttatttgtttatgttgatttgaattttatttgtttaagtttattttgtattgttataaagaaatatttgaggtcgggtgattttgaaagaaaagagttttatttggtttatagttttgtaggatatataagaattatagtgttagtatttgttttttgtgagggttttaggaagtttttatttatggtgaaagtaaattggtttgttatatggtgagagagggagtaataaagagagaagtaaggtgttaggtttttcgtaataattagtttttgtatgagttaataaagtaagaatttatttattattggaagaaaggtataaagttatttattgggaatttatttttatgatttaaattttttttattaggttttatttttaatattggggattaaattttaatatgagatttagagtggataaatatattaattatgtattattatttgatatgatttttttataattttgtttttatttgttttttttgtgtagttagtattaaatatattatatttaaatatattatagatttaataagataattatatatatatatgtatatataaatgtataatatatgtgtgaatatatatatatatatatatagttttttataattatttttaaataagttaagagaagatagaagaaaaaataagtatttatattattttttataattataaaattatttttattaatgtttattattttgggggagtttatttaaattgttgtttgggattaattatttttaatttgaagaattttaatttttttttgtaagataagttttttattaatagttttttttagtttttgtttatttaggagtgtattttgtttttggttttaaaatatatttgtttggatatgatatttttggttgatagtttttgtttttttttttttttttattgttttgaatatgttattttagatgttttttttaggttgagaagattgttttttattttatttgttgaaaagtgttttaaaatttttttatatttattagtatatttattatatttgggttttttatttttttttgtaaaattttttttttatttggtataatttgtattattaagaaatttatagtattttaaattgtttaggttgttggatttaaaggtttttatattttttttattagaaaatgtttttaattttatttttaagtattatttttattttatataaaatttaaattgttttttattttattttgattattttaaaaatattgttttgttgttttttgtttttattgttttgggtgagaagttagttattgttttaattataattttttgtatttgatatgttttttttatgtgattgttttaagatttttttttgtatttgttttttagtttgataaaatgtatttattttaatggagtttggttttttgtatttttaggttgatattttttttaattttggaaaatttttagttatttattattttttgaaatattttttttgttttattttttttttttggttttttttgatatatatgttagattgtttgatgttgttttatagataatggatagtgtgtgtgtgtttgtgtgtgtgtgtgtgtacgtacgtatgtgtttgtttatttgcgtgtttgtgtttttgtatggataatggttaatttttttttttgtttatatagataatttattttgttggattcggtttgtgaataattttattaaaatatttttgattttttgttttattgtgtttaggaatttttatttttagtatttggttgtttttaatattgtttatataatattttatgggaattttttatttgtttatataagttgtgtatgttttttatttgatatttttatatatttaatatagttatgttaaaattttatgagatgatttaaatatttagattattttaaagtttagttttgttgatttatttttttttttttgatagtgggttatatttttttgtttgtttatgtgtttgataattttttgtttaattttaaatattgtgtatagaagaatagtgattattaaagtaaatattaattgatgtttgggaaagtgtatgttattattttagggattgagttaattagatttgtagttgagatgatttgagtattgttagatttagtttagtataggttttaagtaattcgaatgtatgattagattttttatatatttgagtgtttggaggtttttttgttttgttattagatttcggtagatttttttacgttggattttatagagggtttttttagtttttttgtttttgtttagatatttgttgttgataattagtttaaagtttagagtgttcgggttttttatttagttttttttttttttttttagattttaataggtttaaagtatttgttttttaaggggaagtagattttttttagtatttttgttattattttatgtttgtagtatcggtgtcgtagagggaagttttttttggtttttttgttttgttttaaaatttttttgagtatatatgatgaaggtttatgaaaaataattgttaaattattatagattttttttgttttttgatttttttacgtttttaaatagttatattagtttatattttgtttgtaaatatttgttagaagttaaattgttttttttttgttaatatttgtgattataatttttttttattattgttttattaatgatgaattttagtttattgtgtttttataaatttagttttttaatgggttttgaaagatggtggtttatagattatttatgtgttgtttttgttagtgtattagtgaagtttttttgtgattgtattttaagtggaagtgaaaaatattttttgtaataaatatagaaataaaaattatatggtttttatttataatgtgattattaggaaataaaggtataggattaaatttagttttatgaaggtaaatatttaagatatgaaataaatatgttttaaagatattaatttttagtgttttaaagattaaatttagaataatgagatgaagaaatagattatgtatttttaaggtaatttattgtaaattttattttttttggattgtttttagtagatggatagtagatagtttgatgttgtttttggagttgtataagatgtttaggtcgttgttagaaaattgtgtttgattttatgttgttgtttttagcggataaatgatagaatattgttagtgatggtgtgtgtgtatgtaagaagatgttggttagaatatgaagaggtatagtaattatgttatgagaaatagttaagagaatttggaatagattatgtaatatgaagaaaatatgtttatatttaaatttttgtgttatgtaagattgagttgattattaaaatttttttgtagttaatatttttgtatataaatgtttttttatattttagattatttttttaaaatagatatttgtaaattaaattgttgagtgtaaatagttaaaatttatgagttgtattatataatcgttttgtaataaagtagaattagtttttatttttattattagtatttgagtattttttttgttatatttttatttagtattagtattatttttttaaaaatgaaaattttttaggtttattgtaggatagtattttttttttttttttgtttttttgtttttttagtttttgtagtttttattttaaatatgaatttttagatttttatgaggttatattcgtattttttttagagaaggattaaggatttatattttttgagatgttagaatatagtttgttttatttttgttttatggaaatttgtttaatttatggttttttttagagttttgttaggcgatttatgggttgggtttaggatttgtaatataagattgagtaggtgcgttagaattagtgagaagtttttaaatttttatttttagttttaaatagatatttgaatttttatttagaatttttgagtgagtaggtttgttttgcgtatttataaatatttgggttttagattgaaatgggggatattaaagattttgtttgtgttcggattttaaagaaatattaggatttatttaggtaatttgtaaaagtttataatggaggggtttatattggttggagttatttttgatataatttgttttttagttttgaagttattttggttgtttttaaagttgtttaaataattaattagtgtgttttaaaggtagggtattacgagtatgatttttaggtaattaaaatataatgaattattggttttatgatatttatgaggtttgatttttttttttttaaagaatggtggaaatttttttttattttaagttttagggttttaaggtatttgtaaatagatttttgaattattgtttatagttggttgttaaattgagtattttggtttaagtattaaagtaagaattaaggttttttgttttatatttttttgtttaaaatttatattaaaagtaaaataaatttttaaagaattatttatttaatatataaagtttagttttttttaaaagagagatgtttttaataggtattatattgttaagatttgattttttattgttgagattaattgtattgtttgatttagaattgattcggttaaaaattaggtttagaataaggtttgtttttgatttatttttagtatttgtttttattatgtaaagtattttattttttttttggttttaagaataataaataggttgtaaggaatttggttgaagaaaaaggatataaagttttttcgtttttgtttttttttatttggtttgaggtataaatttgtttttaaagtaaagttgatttttttagggagtaggtttttgtttttaaattgtataggtgattttggaagtagtaaaaaaagaagaaagagaagaagagaaaaggatttaatagtttttattagggtttaaggaataggaaagaagattgtattaggtataagtttatttatgaagatatttagggtttataataaaatatataaaatgtgttttaaaagtaaaattatgtttttaaaaagtatataaagcggtagtggaagagataaatgagaattaatttataattgaagggaaaggaagaggttttaagaagatagagtagtattatttgttttagataggataggataatttatgggttgaatatatgataatatagagttatggagtgatggatattatgtggtggggtaaggtaaaatagtgtttttttttttttatttgtttgatttaaggatggagaagatattaaagtgattgatatagataaagttatgttttttgtattgagatattgtttattttaaatagatataaattttagaatttgtattatatatatattttaagtaaaaatgtattaagtatttttatttgtaaaatattatgttgggtatattaggttttgaggggttttaaaatatgaataaaaagtagaagaaatgtatatatggttataaatgatagttaggaataagtaagggggagatagaagaagtatattgagtgtgggttttatgtggatttagttagttttggagttttatttgtagtgatgatatgggttatttagtttaagataagagttgggaaaatagatagaaagtgttttaaattatgtatttttgatgtggttggggttagaagtgttatcgagatttgtagaagtgaaagtagtttagagagaagagatatttttaatttttggtatattttttaaaaatgatagacgttaattatgtttttgttaaattatttttattatttatatagatggttttattgaggggatattataattatttattaaaatatgtttgttttagatatttgtattttcgtaggtattgatgttaatataaattattaagaagaagaataattgggtttgttttaaaaagaagagttgttaagttattagtaattttggtgggaatattatttttaaatatttatagtaaattttttttttaataatttagaatgtttattttggaattttatttttttaatttgtatttcgttttttttttttgagagagttttatgcgtttttggattaaggggttttttttagggtttatttgtttgaggttatgattttgagtttggttgtttattttttttttttttattttattcgttaaaattaaagttttggttttttagttggaatttagatttagtataaaatgatttttgttgattttttttgttttatttattattatttttttatatatttttggtggttaattatgattttttattttatgaaaatgttttttatttgtttgggatatttttatattggatttttatattttttatatgtatttaaaattagttaattaattgtagtttttttatatatttatttggtttttttttgtttgttttagtagatatttgtttttatttgttgattttttagttttttggaaaagttttagtgtagttttgattattataagaatataatatttttattttttaaaatgtttttaatatttttatttttaaaatttttaaattgtgttggagttttgggattaggaagtaggggagtaggttagattgttttaagttttttaaaatatttttgtattgtatattttttaatttttgttaaatttaagaattataaatttataaatagttttattagtttttgtttttaaggtttagtattagttttttagggttgttaataaattaatataaatttgttagtttaaaataatagaaatttatttttttatagtttggagattaaaattaaggtggtggtagggttgtattttttttaaaggttttattttttgttttttttagtttttgatggttttatatattttttggtttgtggttatattatttttatatttattttggtggttttatggttttttgtttttttaggtgtgatttttttttgtgttttttttttataaagatatttgttattggatttagagtttatttagaaaatttaggataattttattttaagatttttaatatttataattttaatttgagggtttgttaagtttttttttttttttatataagataatatttataggttttggtaatttggatatggatattttttgggtggagaaaggtattatttaatttaatatagtttgttttttataaggggttaaaattattgaaaagtgtttagtaaaaaagggttattttggtcgggtatggtggtttacgtttgtaattttaggattttgggaggttaaggtgggtggattacgaggttaggagattaagattattttggttaatacggtgaaatgtcgtttttattataaatataaaaattagtcgggtttggtggtataagtttgtagttttagttattcgggaggttgaggtaggagaatggcgtgaatttaggaggtagagtttgtagtaagtagagattacgtaattgtattttagtttgggtgatagagtgagatttcgttttaaaataaataaataaataaataaataaaaaggttattttatttagcgttattagttattattttattttgtaaatagttttttataaattaaaattttattttattttttttaattatttagaaaaatgtttttatgtatgtgaattaaaataaatagttttcgatttggtgtgagggaggagtgaaagaggagataaagaggtagaaatttttaatgaattttaataaattaaaatagaggcgaaggtaaagggaaaattttaattagaaagttaaaaatatatgttaaatttatagaataaatttataataaaataagaaattagatggtaaaagtagtgtttagtagagttaaaattatggtagggtgagatgggatagtttgagttatgcgagaatttgtttaaaagtagaaattggattttggggtgtttagtatttattgtgttgatggatacgttatttttaaaaattatgtatttatggtttatattgttagataaaatttttttaaatgataagatattgcgttatagataagtttataggtataggtatttatatggataggttgattattaaaaattcgtggaaatatttgaggtaagtttataataatgtatagatttattttggttgtatgttttattatattttaattaaataagtaagttaagattatattttatttataatttattatttaatttatattagtatttagtagtatgaattttgagggatatttaataaattttaataaaattattatgatatttattattatttgtttaaatgatttgagtataaatttataaaattaagtaaaaaggatataaatattaattttttttatttagttataaatcgtttgttagttatagattatattagtggtaatatataaaattttgttgttttaattgtatttttattttaggaaatttttttagattgtatttttagaatatagttttttgttatttaaggtgtagtttatggattagtattaagtttggaggtttgttagatatgtagaattgtagattttttgttttaaatttatttatataggtgatttatatgtatattattttttgtaagtttattatatattaaatttttttttttatttttttgaatttaatattttgttatttttagttgtagtttttattttaatttagtgtaatatatattattttttttgaaatagtaaaataaaaagggaagttataaaagtgataagttaattaatttgtattttttatttattatttattttatttagattttttaattattgaaggaaatatggaggtagtaagagtagtggatttaattttatggatggagtatgaatttcgcgtggtagtaattaatatattgggtagaggagagtttagtatattatttaatagaattaaaatagacggtgttggtatgtatatataagaaatttgaaattttaaaagatttttaaatatagtgttatttttatatatggttgaatgtatttgaaaataatgttttgaggtaagtgatttatttgaaaagtatgtgtgtgtattttattattaagatagttaaaaattaaaagaggaaatatgaagtttaagaatattttaagatagttaaaaattaaaagaggaaatatgaagtttaagaatatattaattaagaattaatatagaggaagaggtgaataggaattattgaaatgttattggagattattggaatgacgtaagtatttagattataaattttaatgtaaattttgaattttaattaggtagatttttgtttgattaaatatgttttatgatttagaaggtttataattttgtgtttttttcgaatttatttataattgaatggttaagtcggtggatattttatggtaaatattaattgtaattaaatagtgttaaaattttaggtttgatattatttggaaataatttttttttaatatttaaggataagtagatattatggtaaatattttttagagttatatgcgaattattgatagtgagtatattatttttagatatgattttaagtatttagagtttagagtgtttattattatttcgtggaattagttttagatatgattttaagtataaattatatttagatatttaggtatgaaagaattagattgaattttttcgagatattgtttttgttattattatttttaaaaaatatttaatgttgttatttttattttgagattaaaaaataatttaagatagattttatggtaattatgtttagatgatgagtttatatattgtaaagaaattattttttgagataaataatatagataatatttgtaataaaattttaagaaagaaggagggaggtttatatttattattagtgttaaagaaagtattttttttttttgacgatttttattttaaagaatggtgtttagttaagatttaggttatattgtattagttaagaaattatagaaaattaattaaattttatgattaaaggtttgtatttgagataggtaagtaaaaatattttatttgagatgtttgtttagattaatttaattatttagtatttttttgtaattttagtgaatgtttgttaaattaaattaaatatatgatttgttagtataaaattatataggtaaattattagtggaattatgttatagtttttttatatttttgtttttaaagaaagagtaatagtgttcggtttataatatagaagtttttattataaatatatgtagttttagggaataataataaaaattaaatataagaattttggttatgtggtatttgttttttataaagttttattttagattatttatatattttgatgaaatttttgtgaggtagagaaaagtaaatattagtgtttattttgtaggtggatatgttaatataaaaaatttagtgtttaggttatatttagtattatagttaaggttgaaatttaagtttttattagaattttaataaagatttatataaatagatgtgtttttagaattttgtttgagaagtcgattttgagaaaatttaatgtatgagaatagttgttagatttaaatttgaattttgaattttgtaattagttatattaatttagataaattatttagtgtttttgagtttattgtttattaatgaatatgagtataggattatttatgttaaaatgttattatgaggattaaatgaaatggatgtgaaaatattgaatatagattaagtattttagtgttttggttttttaattttagaattatttttttttatttaataaattatattaaattatatgaaattttaagagatagtttatttatagtagtttttgtttaaagatattagaatttataattatatttagaagttaggttaaggaattgaggtaaatagaaatgtagagaagtgatattaagagattatagtagtattttaatggaattttgttatttatttaaaattttttttatattatttaaaatattgaagtttggtaagttttagttaaatgagtttagagaggttatattttttttttgatatagggaataataaaagaagagttattattagaattagaataatatttttttttagtgatataggggagaaggaaaaaataatagagtattttttgttttaaaggtatagttgttattttaaattaatttatttttgttattattttttttaggtattattttttatatttttttaaatggtattttgttaaggatttagttttttatttgatgtgtttataaaataattttttttataagttattagagttaaggttaaaagtaaatatatttatttatagagtaagatataattttgtagtgatatgagatgatttattttttttaattgtaaaaaaaaaattaattttgtaatttttaatatatttgttaatttattattagaaaatattttgagatttttgattaataaatttattattatagtttatatatttgtagtatattgttagatatagtgtttagttttttgtttgtattgtttaagttaatttttataataattttatgaaatagatgaggaagttaagattatatttagttaatgtgaggtagagttgggatttaaatttaggtgttttttatttaaaggttttgtttttaaattattttttgaagatagtgggtagtattgtggtttcgggttattgattttttggtggaatgttcgtattattatttaaaagttatgtaatttgaggtatattatttaatttttgagttttatttttttttttttttagatagtttagtggttttttttttggagtgtagtggtataattatagtttattgtagtttcgatttttaggttttaagttattttattgttttagttattttagtagttcggattataggggtttgttattacgtttagttattttgtgtgttttttggtagagattgggtttttttatgttgtttagttgattttgaatttttgggttgatgtaatttatttattttggttttttaaagtgttgggattataggtatgagttatcgggtttggtttgagttttattttttttatttttaaatgggaattatttattttaagggatgatttttatgtttataaatatattaggaaagtagttagtattgtattgtatagtatttgtttaataaaatttatttattatgttattaaatgttttttaaaaatttaatatgtttataagaaaatatggttttttgtttattttgtaatggattatttatttagtaatatatttttaatttttataagtatagaagaaagattatataattttatgtaatttttaataattttttaaaagttattttatgtatttgatataaaattttatagaatttttttattgttttgttatttatttgttttattaaaattgaatatgtattaaattggatatttatattttttatttttataagaaaataaaaatattttttaaatgagggatgtttgttttgtcgtgtattattataataattttttaagagatgttagtatatgttatgtgggataaaggttggtttttatttgatggaaaggttggtttttagttttattatgttgattgaaagatatgatattatttaatgttatatatgtttttatttgtttaattatttaatgttaagattttagcgtatatttgggtgtattttttggatttagatacgtgtattataaaatggatgtttttaaatgaaaaattagaagatgtatttgtaatttattttaatttatttaattttgattgtagaaaagagataataaaagtattttttgaaataatgtgttattgtaagatatgtttttatggttaatagttttgtaggtttagttggtgagtttatattttaaaatggtatatttaggtttgttttaatagttttttttattagttagattaagttagttaaagaaaggaaagagaaaaaagaataaaattaggaataatatttttatattatgtataaagttttgattttatgtttaatgaaggtttgttgtttttttatttagtatttttttttattttttttttttttttttttttttttatatatatttgataaaagagaagaatagaattaagaaaatattttatagttggtaaggtattatgtgatgttagttgttgttattaatatttaaatagataaatttttaaaagaagtaaagaggatagatttttaagttatttgaagatttgaattaaagatggtagtttttttatatgtaagtagtataatttgggtaagttaattagtgtattcgggatatatttgttttttttattaagagaggggataatgttaattttttatgatgttgatttgggtatttaattagatgaagtatatgaaaataatttttaagttttagatgtgtgtattattaagttgagattatttatttagtaaatttttatatttaatatatcgaattaaaattagttgtatatatttattttttattattatgagaaaattatatttagtattggaatttgattttatttatattgttatttttagtgttttatataatataatgtttatagttggtatttaaaaatatttgtagaagataaaaaggagaaattaggagggtaagatgatgattggggttattggaagttaattgaggatgatgaaaaaaaaaggagtgattaaggtaataatagatttgtatattataatttagaagaatttattgttaaatatattgtgttttgatgattgaaaataagtttaatatatatattcgatgttattgtttatatattgatgaaagaagaaagcggttattttttaatttaatttaaataaatagtttgtaattggtttggattttttataagaattttattgtggataattataattttaatgtaaagaatttttttttgtttatttaaatattttttttaattgatttatttttagattattattttattgtgtaattaaaaatttattttgttttatttatttaaattttttgtttgaaaataaggtttataataataaataaatttataatttttatttgatgagatataattatttgtgattttttatttttttaagttataatgggaatattattttaatatggtggattatattaggggtgttagtaatttatttttttattagagtaagcgtttagaagagttgtaaagaattatttttattttaatattaaaatattatatagtttatttgatttttttgatagttttttagaattatatatttaagtgtttaaagtataataaaaaagaatgtatgtataaatatagaattaatgtaggtgttagattttagtttttttggttttttaaattagagtattatttatataattatgttgaattttttattaaaaaaattgtattaaattattatgaaattttaatgtaagttaaagtaaaaagttatatttatgattaattttttatttgtaaaaatgattgtataagttaaagttataattaataagaattaaagtagttaatatgtttttaattaagagtttatttttatatattttataatttttataatttaggatttgttataagttaatttgtatatttttaaataaaatattaaagtttaaagagatatttatatgtaaattatttaagtatttagatttgaaaggaaaattggtagtattaatttttttttatgggaaagaatagttatggtattggtttgattttttttaaaaaaaatttttagatttatgattgaaatatagaagtatttttataagtattataagggaattattattaaatagaaattaagataaaaggataagttaaagtagtttattatttttaatcgtttatagtaaaattatatatgttattaataaatgattaataatttaataatttttttgaatagtttaaattttttttaatgatttattgtgtaaagaatgtttagtttgttttttgttaagtgtattggagtttaaatttaagtttttttgtatttagggtgatttatttttttgaaataaattatgttttggttaagtttttatttttgtagggttgagtgtaaatagagtatttaatttttttatttttagatttatgttaaatatgtaggttttgtgttaattttatttgtgaaaaattttttttaatatgttaaggttataattgaatatttaaagttaaatgagagaaattaaattaataatttaagtaagatataaaaatattttattaagagaagtagttattgtttttttgtgttttttttttttttttttttttttgagatagtattttgttttgtcgtttaggttggagtgtagtggtaggatttcggtttatagtaagttttgttttttaggtttacgttatttttttgttttagttttttaagtagttgggattataggcgtttattattacgtttagttagttttgtttttgtatttttagtagagatggggttttattgtgttagttagggtggttttgattttttgatttcgtgattcgttcgttttagttttttaaagtgttagattatagatgtgagttattatgttcggtttattttgtgtttttgtttatgttttattttttatggattgagtttagtgaatgatttttgaagagtaaattagttttgaaaatatattataaagtgtttaaaagaaatatgataaaatggaaagagatatttaatttaatttaaatatattttatttttaggtttgttttaaataaaaaggttaatattgtttataatgaaaaatattttagtaaaatgttttaataaataatatttgttttaaggaaggtaatatttgatttaataaattgtagtataatattttagagttatttttgaaattatttgtttgtgattattatatttgtatttaaatatttttattgtttgattataggataatttattttttgtttttttatagtatgaaaagttttaattttagaatatgagttataggggtaaaagagtttttagaagttattttaatattttagtttttaatatatattatatttaaagtgttataaattattttttaattttgtgtagttagttttattttttaatagttatgtaattatagttgaatagtaaaataaaattttttaaattttatattattaataatttttttatggggaaataaaataattatatagttttattttttttaattttaagttaagaggtatatgtgtaggtttattatataatgtaaatttttgttatgggggttagttgtatagattattttgttaattaggtattaagtatagtatttattagttgttttttttgatttttttttaatttttattttttattttttaatatgttttagtatgtgttgtttttttttatgtgtttaggtgtttttattatttagtttttatttataagtgagagtatgtagtatttggttttttgtttttgtattaatttgttaaggataatgattttttgttttatttatgtttttgtaaagtatatggttttgtttttttttatggttgtatagtattttatggtgtatatgtattatattttttttatgtagtttattattgatgggtatttaggttgattttatgttattgttattgtgaatagtgttgtaatgaatatttatgtatgggtttttagaatagagtaatttgtatttttttgggtatatatttagtaattggattgttaggtcgaatagtatttatgtttttaggttttttaggaattgatatattgttttttataatagtgtataagtgttttttttttttttataattttgttagtatttgttattttttgattttttaataatatttattttgattaatgtgagatagtattttattatggttttgatttgtttttttttaatgattattatgtggagttttttttatatgattgttggttatatgtgtgtttttttttgaaaagtgtttatttatgatttttgtttattttttaatggggttgtttttttttgtaaatttaaattttttatagttgttggatattaattagatttttgttagatgattagtttgtaaaattttttttttattttttaggttgtttgtttattttgttgtagttttttttgttgtgtagaagttttttagtttaattagatttaatttgttaatttttgttattgttataattgtttttggtatttttattatgaaatttttgtttatttttattttttgaaatttttgtttatttttatgttttgattggtattgtttaagttgttttttagggtttttatagtttgagattttatatttatgtttttaatttattttgagtttatttttatatatggtgtaaggaaggggtttaattttaattttttgtatatggtttgttagttattttaatattatttattgaatacggtgttttatttttattttttgtttttgttagtttttttaaaaattagatagttgtaagtgtgtgattttatttttgggttttttattttgttttattggtttatgtgtttgtttttatgtattagtattatgttttttttgattatcgtagttttgtagaataaagttgggtagtgtgatgtttttagttttgttttttttatttagggtttgttttggttatttgggtttttattttattttatttttttggttttatgtgaattttaaaagagttttttttagttttgtgaagaattttaatggtaatttaataggaatagtattgaatttataaattgttttgggtagtatggttatttttatagtattgatgttttttatttacgagtatggaatgtttttttatttgtttgtattatttttgatttgtttgagtagtggtttgtagttttttttgtagagatatttatttttttagttgtttgtatttttaggtattttattttttttgtggaaattataaattggattgtattttttatttggtttttggtatgattgttgttggtgtataggaatgttagagatttttttatattgattttgtattttgagattttgttgaagttgtttattagtttaagaagtttttgggttgagattatagggtttttttttttttttttttttttttgagatggagttttgttttgttgtttaggttggagtgtagtggtgtaattttcgtttattgtaatttttgtttttcggtttaacgttatttttttgtttcggttttttgagtagttgggattataggtgtttattattacgttcggttaattttttgtatttttagtagagatggggttttattatgttagttagtgtggtttcgattttttgatttcgtgattcgtttgtttcggttttttaaagtgttgggattataggtatgagttgttgtatttggttatgggttttttatatataggattatgttatttgtaaattgatatggtttgatattttttttttttatgtgtatgttttttattttttttgtttgattgttttggttaggatttttaatattgtgttgattaggagaagtgagagatggtattttggttttgtgttagtttttaaggtgaatgattttagtttttgtttatttagtatgatgttggtttcgggtttgttatagatagttgttattattttgaggtatgtttttttaatatttagtatattgatagtttttatatgacggggtgttgaattttattaaaagttttttttgtatttattgatttaattatgtggtttttgtttttaattttgtttatgtgatgaattatatttattgatttgtatatgttaaataagttttgttttttagagataaagtttatttgattgttatggatgagttttttgatgtgttgttggatttggtttgttagttatttttttttgaggattttttcgttgatgtttattaaggatattggtttgaaggttttttttttgttgtatttttgtttggttttggtattaggatgatgttagttttatagaatgagttaaggtggagttttttttttttaatttttcggaatagttttagtaggaatggtattagtttttttttgtatatttggtagaatttagttgtgaatttatttggttttgggtttttttttttttggttagttggttatttattattaatttaattttagagtttattattggtttgtttagggatttaattttttttttgtttagttttgggagagggtatgtatttaggaatttatttatttttttaagattttttagtttatgtgtatagaggtgtttataatattttttggtggttttttatattttcgtggggtaagtggtaatatttttttttgttatttttgattgtgtttatttgaatttttttttttttttttattagtttagttagtagtttattttatttttttttaaagtattagtttttagatttgttaattttttgaatgaaattttgtgttttaaatttttttagttgagttgtgattttggttattttttgttttttgttagttttaggatttgtttgttttttgttttttagtttttttagttgtgattttaggtttttaatttgagatttttttaattttttgattgggtatttagtgttatgaattttttttttaatattgtattagttgtgttttagagattttggtatgttgtatttttgtttttattaattttaaatattttttcgatttttgttttaattttattatttatttaaatattatttaggagtagttatttaatttttatgtgattgtatggtgttgagtgaattttatttttgatttttaatttgattttgttgtggtttaagagattgttttttattattttattttttttgtattttttgaggagtgttttatttttaattatgtgtttaatttttgagtatgtgttatgtggtaatgagaagaatatatattttgttattttggggtggagagttttgtaggtatttattaggtttatttgatttaatgttgagtttaggttttgattatttttgttaattttttattttgatgatttgtttaatattgttagtgaggtgttaaagatttattattatgtgggagtttgagtttttttaaagttttttaagaatttgttttatgaatttgggtgtttttgttttaggtgtatatatatttattatagttagatttttttgttgaattgaattttttattattatgtaatttttttgattttttttatttttattggttaaaagtttgttttgttagaaattaggattgtaaattttattttttattgttttttatttgtttggtggatttttttttattattttattttgaggttatgagtgttattgtatgtgagatggattttttgaagataatatattaatgggttttggttttttatttagtttgttattttgtgtgttttaattggggtatttagttatttatatttaaggtaattgttgatatgtgtggattttatattgttattatgacgttagttggttattttgtagatttgtttatgtggttgttttatagtgttattggtttgtgtaatttagtgtgtttttgtggtgtttggtgttggttttttttttttatatttagtgatttttttaggagttttggtaaggtaggtttggtggtaataaatttttttagtgtttgtttatttgaaaaggattttatttttttttggtttatgaagtttagtttggttagatatagaattttggtttggaattttttttttgtaagaatgttgaatattggttttaaattttttttggtttgtagggtttttgttgaaaggtttatttttagtttgattggttttttttgtagttgatttgatttttttttttagttgtttttagtatttttttttttattttaatttttaaaaatatgatgattatgtgttttggggatgatttttttgtgaagtattttattgtggttttttgtattttttgagtttgaatattggttttattagttaggttggggaagtttttttggatgatattttgaaatatggtttttaagttagttttattttttttatttttttttttagggatattaatgagttgtagatttagttatatattttttgaattttttttatttttttttatttttttttttttatttttgtttgattgttttattttagaaagttagtttttaagttttgagattattttttttgtttggtttattttgttgttgatatttgtgattgtattatgaaatttttgtagtgtgttttttagttttattaggttggttatatttttttttaaattgtttattttttttgttagtttttttattgttttataattatttttagtttttttattttgggttatagtatattgttttagtttagtaatttttatttttgtggataatttgaattttatttttgtgaatttagttatttgagtttagtttagaatttttgttggagaggtgattttattatttggaggaaataaggtattttggtttttttaattttaagtttttttagaggatttttttttatttttgtgggtttatttatttttaagttttgaaattgataatttttgatttttttttttttttattttatttgatgattttgagggtttgattgtggtataaggtagatttagtagattagtttttgtaagattttatggggttaatatttattttttaatttttggattgtatgttataattttgggggatttatattaggttttgattttgttttttggttttttaaggtttggaatttattgtattggaagggagggttaaggtgtagtagttgtagtagagtgttaataagtgttggggtatttgtttttttgtaggtgtttattatagtggtagaggtaatatagttggtaggtaggagtagaggatttttgttggagattgtgtgtgggtatgttggaggtggtattagtttaggggttgggtattggtgggaaaagtttggatgttttttttgtgttttttaagtaggtgtgatttattatatagttttgtatatagttttatttgtttttgtgtaattaatgtatatattttattaaagaatttatatagttaatattagaagtttttatgtaggtatttttgaattataattattaggagttataatttagtaaaaggatattttgtttttagtattttaaggaagatgtggttattttaaaatgggagggtatttggggattaatattttatttttttgaaatgttaatagatttgaggatggtatgttagattgagttaaagtatttgtatgggaaaaggtatgttttttatagaaatatggattttatttagatggttgggtagttgggtggtgtttagattgtaggaataaataatgaatattttgtttatttgtataaggttagttaggtgttaagtatataaatttaataaggtatagtgtttatttgaaggagtttgaaggagagagaaaaatttggagagaattaatgaagaggttattggatttggtagttaaaagtagttttgtgtggttttttttttttttttttttttttttttttttgagacggagtttcgttttgtcgtttaggttggagtgtagtggcgggatttcggtttattgtaagtttcgtttttcgggtttacgttatttttttgttttagttttttaagtagttgggattataggcgttcgttattacgttcggttaatttttttgtatttttagtagagacggggttttatcgttttagtcgggatggttttgattttttgattttgtgattcgttcgtttcggttttttaaagtgttgggattataggcgtgagttatcgcgttcggttagttttgtgtgtttttaaagagaaattttagttatttaaagaaatggatatgaagtagttatattatttggggtatatattttggggtttgttattttgtattaggaaaatttaggatatggatttatacgaggagtttagtagtagaggtttaataggtagaagagaagtgaaagagaaatagttttttttttatagagagaggggttttttagtggaaaagattggttgttagtgaatgtgttaaattttatagttaggtttgaggaggcggtgtttgatttatatagggtttatagattggtttgattaggtatgacgtttatataatgtatgcggaaggtggttgttttattttaatgttagtatgtaaatgggttttttagttgattggtgttattttttttgttttttattgtatatttggtcgataaagggaagagaagatggattattttgaatatgtatagtttttattttttgttagtatttatttatgtaagtttttagtttgtttgtttatgtttgtagtttaattttataggttgttttttgttagaaaatgatttgtggttgttttttaataaaaagtaaagttttattaaggatttttatttagttattttttgtttaagtgattttttaatttttatatcgtttttttttttggagtggtaattttaattgttgttagtggttatttgaatgatgattttttttggtaatttttttttataaaggggtattgtgtggggaatagtagttatggttttttttggggttaatttaagggtttttggaagaaaggtatgtttatgtatggttttgtttgtagtattatttggagtttgattgtttttaaatgagaagagatgaatgttagttcgaatatgattattaagattgttattattagtggaggtattataggttataattataatagtagggtttgttatttgttagttattttgatgaaatgaaatattggtttgtttttattaaatgttgttgtattttattagaagtgttgatataaaagtaatatttttttttttttgagaaaaatatatatattttcgttgttttgttattaggggataatttttggtttaggttattttttttaatttgtaatatgattgggagaaatatgttattgggtggttagtgtaattttagtgttaattttagttaaattttttttgtaattaatttttttatagtttttattaattatttatgatatgtttaaattttttggtttgttttaaatatttttttttttaaataattaattattttttttaggatatgtatttattatttttttaatttttttatgatttttatgaattatttatgatatgtttaaattttttgatttgttttaaatattttttttttaaataattagttattttttttaggataagtattttttatataagatttttttttatataaaattttttttttttataattttttttgtattaaacggtagtatgagtatggagaattaaaaaagtatatttggagttagtgtaaatgttagttatttttattttgtttaatttaagtgtttttgtaagagttattagtttagttggttgagtatttatgtttggagtgagagatatatttttaataatatttagagtgattattgtatattttgttttttgtattttttgttttgtaaaggagtttttgtttatgaagagggtttaatttggattttttaggggagtttttttgagattttttttggtcgtataggtttgtattataatttgtttatagttatatttaggttttttagtttttttggggagaaaggtgattgggtttaagtaaaaataagtttttaattggatggtggaattttttgatagtagggtttgatatttaaggagtttgttgtttgttaattaaaggttttttttagaggatagtaattttattatattatatggggtataaatagttatgttattttttaggattaatttggaggtttttgggattagtagagttattgtagtaatggattaggggtatgttggtaattttttaattattaaattaagttttttatttaggtaatttattggttgttgagttggtttatagatttgtgttaaaatttttaaggttattttttttttttttgatatatatagattgaaggttttttttatggaaaggttgtgattatggttttagtgagatggaagttttgaagtagtttttattttttattgagttttatgtgtttttaatattggggtgttgaatgggttgttttaggttttgaagaggttttgtattattaggttattagtaatggtttttagtttttttttagtttttggttttagtggatattgtttttggttaggaaaagaagtgggatttttaagatggatttggattggtttagtagttatagtttaatttattgtttttttagttgtttatatttttggattgatattagtttttattagggggtgatagagtttgttttggggttataaggatgttggtttgtttgtaagtaaaatatttttatttaataaaggagtggaattttttggtatgattaaaaaagtatgtgttaataataggtttttttatttgtaatttaaggggttgtgaaaaatattgaattagatttttttttgagatgttttgtgatgtttggttatgttatagaaagaggggaggtttggattagagaggagaagagagagagagattggttttagtgtttataaggagatttatttttttttaatttttagaattatttagggtttttgtgttgtatgttggtttgagttattggagtttcgggatttattaattttgttggataatttgtgagattggtttggaattcggtgatttttatttttgggggtagttcgatttttaatggttttttttataggttagataaggttaaggtggtttttttttgttgtttgggtatttttttttaaagtgttttgatttgttgtatttatagaaattagtagatgtattttagggattttgggttttgtatgtttgtagagtagttattagtgtttttgttttttttttttgtttttttttttttttttggattttttttttttggtttttattataaaatattaaagtggttatttttaggaggttttttaagatgttatttggtgttatagtttttttttgtattttttttttaatattgggaggtgtttttttaataaatttgttttttaggatgagttgttttcgattgatttaggggataaaggtatgttttatgagtgtttattagtttttttataaaggttgtaggatttttatttggttttgttttattttggaaagtatagagtaattaatagattttgtttttgttttttataggttttttaatatgtgtattaaatggtgtttttttttttatttatttgtggtattatcggtgttttaattagggtttgtttttttttttagaggaattgtttttttttttatcgggaatggtgtttttattatttttttgttttttttatttttttttttttttttaatttattataggagatatgttgtttatcgttagaattttttgttgtttgtagaattgtttgtttttttattgtggttaggatttggtttaagagtagtaaaatattttttcgtgtgtggtgaaatatttgagttaaattttggaagggttttatatatttattaggattattagaaaattggtttaaatttttttttatttgtttaagattttgtaatgagatgggaatttgaggtgattttaaataacggggatttttagatggtttttttggaagttgtttttttagttttagggaattattttttttgggtttgtttgatatgattgttatatttgtaaaggtttagtaagaaggttatgtttttgtgtaaaagaaaatgagttattttttttttaaagttttaggattaaaggagtttttgtgttttagaatgtattttagaggagtataggttttagatgataaagagaaggaaaaaaaggtatttttttagtttttttttttttgatgtgatttagggtgggagaaagatagtgggggtgtttttttgttgttttttttttatggtttttggtattttggtattttgttaaatgtgttgtttatggttgtaggtgtggtttttttagttatggaattagaggaattaagtggtgggttttagttatttttatttatgtaattttagttttttgtttagattttggggttttttgaaaaatggattttgggaaagattatgtaatagttgtatttgggtaattgttgtattcgtttttttaatggaggaagcgtgttggtttgagttttatattttgttattatggtttatgttaaagtgtttatttttagagaattattttagttaatttttgatttaaaatttttttattaattaagtattattttaattggaggtagaataggtattttaaaagaatgtagggattaaatggttatttttttgaaggaaggatagtattaagattaaaatttggttttggaggatattttatttttaattgttgaaggtagagtttttttatttatagaaatagtataaagtttggtttttagtagagaggcgtaaaaaggggagagaattgggaagttagagtgtttgggtaaaggagaggatttttattttattaggtggtgttgttgattttgagatgttatgtgttttttagattaagggtagagtgattttgatatgttatgtgttttttagattaagggtagagagagagagatttggaaatgttatgtgttttttagaataagggtagggagagatgtttattgggggtattttttgtttttagaatattataaaaatatttttttttgagttatatgtttatttattatgatattatttgattttgttaaataggattttttttttgaattataaatttttttatatattgtatatatagagaggataagagttatgatagttgttaataggaaagaaagaaattatgataggaaagttggagattttgtggtcgatagtttattagtggggatagaggttggggttagtttagtagtttttggataatattagggatagttttagttagaaatttttagttgttttaggattttttttagttttatatgacggttgagtattttatgaaaggaagttggtttaaatatggttaatatgttaagtaatttatgggttttttatgttttttttagtaagtttgttttttaagttttatatggttggtagttacgttaattattttatggttgaagggggtttagtatttggtttgatttggtttttaaatggaggttaatagtttttgaatgaaaggatagagttggagtttgtttttttatttattgttttaattaatgttgtacgttggtattatggatgaggtttttagtatgaaatggttatgttgtttggggtatatattttgggatttattattttatattaggaaaatttaggatatggatatatataaggagtttaggagtggagatttaataggtagaagagaagtgaaagagaaatagttttttttttgtagagggagaggggttttcgagtagaaaagattggttggcgttgaatgcgttggattttatagttaggtttgaggaggtggtgtttgatttatatagggtttatagattggtttgattaggtatgatgtttatatagtgcgtggggaaggttggttattgtattttaattttattatgtaaataggttttttagttgattagtgatattttgtttgttttttattgtatatgtggttgagaaagaaaagggaagatggagtcgttattttgaatatgtgtagtttatagtttttgtcggtatttattcgtttaagtttttagtttgtttgtttatgtttgtagttcgattttataggttgtttttttttagaaaatgatttggggttgttttttattaaaaagtaaagttttattaaggatttttatatttttattttttgttttagtgatttttttttaatttttatattggatatattgtgggttgttaaaaagtgattatggagtgaagtataaaaaaaaaaatagttatatattagtttttttatgtagtatagtggtagaaaaggatgtgatggtttagggattaagaagaaagtagtatgatagaaagatttttaagattagagattataaagggtttttttagtagggaaattgatattataagatgatataagagaacgggggagagagtattttggagttattgacggcgtagttttagaaaaaattggggaattgaaagtgagagtataagagacgatattagatttataatatttttagatatttggggaaatattatttaatataaatgtatggttttttaatatttatttgtagaatgaagtatgaaattaatataatattaagttgttagaagtttataggttttaaaagtaaaagtggtaaaatttttttttaatagtttatgtaattttttaaaattatattaattgaaaggataggaaatgggtatattttttatggtattaaattaatttttattttggtagaaaaattgattattatagttattgtgagttattgttattataattgagtggattatttgtttagtatgttttttttagtaaaagaaaaatatttgtggtttttgtggtgaataagaattttaatattaggaaaaaaatgtaggttttttttttgttgttgttttgtatatatttgtttgtttgttttagtattaaatgtggtttttttagatgtaggaggtggaggtggaagaaatagagagttgattataatatgggcggtaagtattgatgagttgtatatattataggttgttgtatttatatttaatttttattttattttgttttttgaaataaattgagatgaaagtgattgtttattgtataagtaagaatatattattattttttttttttaaatgtaaattagattttatttggtttattgtggtttagtgtgtagtttttatgtaagaatgaattttggatgttaagagatttgttagtttagatgattaaatatttagttgtttgattttagagatattttgattattgtagtttggtaatttaattgtaattttaaatattgtttttggatattttaaattttaaagattttatttataaattttgtattaaaatttatttttaaattggagattgtttttttatttgaagtttattttgattattggtgtaatttagtatgataggttagttttagaagttatttatgggattagttattgaggtatttaaagtattttattatagtttcgtgagttaaagagttttgtattagagattataatttttagaaaataatatattttggttggatttttgaaataggaaagatattgggaggggtgggaaaagttgtttgataaaattgtttgatttagatatttggtatttatttagataatatggtttatatagatttatttatttattaaatatatttagtgttgaattattgtagatagttaaagagtataatttaggttttaaaggattttgaagattgtggaaaaaatgataggttttattttttgtattggttaaatggatttatttaataaatgaatgtttagtaaaatttgatttattgtgtgttttgtagttattttttatatttagtatttaaattatattttaaagtaagatttagtaaaaaaaaattaatttgaatcgtaaaatatttatttttaagtttaattgttaatgaaatgtttaaaaatgtaaatattataaaaattagaatatttcgtttttttttttatggttttttataaattttgtggatatttgttatagaataagatgggttttataaaaaatttagtattggaaatttttttttaaagatttaaatttaggtttttggagatagagttcgagagttgttatttttgaaatttttatagttgattttgttatattttaaattttaaaaattaagtagagaattattaataagaaaaatgtttaaattattgtagaaatgttaggttatattatttaataatttaaaattatatatttattaatatattgtgtaattatatatagtttttattatttgatttttttatatttttatatttttttatttaatataagtatgtttaagtaatagtgttatatttattttaaggttttgttttaagatattttaaatttgattttttggtaaaaaaaaaaaaaagtaaatatataatgtgtatatttatttaaattgttaaaaaaggttaattgataagtatttattagaagtagttgtaagttagtttttattaataataggtgattagggttgatatagatttttttataaggtaatttatatgagtgataagaaattttgagaaaatgatgaaaaattaagtatttgttttagaattggagatagaaatttaaagttatttttttataaatgagtgtaatattgtttttttttttttgttatttatttttattttttttattagttttttttcgattataaggtagatattttaggttagagttttatataatttttttattattgttttttaattttaatgaaatttatttgtttatttttttaatatatattatttgaagttttgttttaggtgttagggataaagaggaaaataaaattgataaaaacgttgtatttataaaacgtgtattttagtagttgagagagataataaagtagataaataagtaaattgtatagattttgttagggttaaagaaaaataataggtagggtgcgggatatggagtattgtgttggagttttgtagtggtagaatttgtggtcggagaaaacgtcgaggtgattttatttcgggaaagtgagggggtgggaggagttatataatatttaggagaatattttaggtagaagaaattgaaaggaaaaaggttcggagtgagaggtttttgaggtgttttaggagtagtgaggttataatttggtaaataagattattttatgtttaagtatgttttttttttgatatttggaattagtattaatgtatgaattgtgtatgtttttataaagagtacgttttcgtgtgtgttattatttttatagtattttttttttgttatttgtattattaaaatttatttaattttttaatttttatttagtttttgttaagagaatattattatggtaataattttggttatatagtggtatttaagttatttgatggagaagaatggaaaaaagttatagttattaattttgatattggtcgatatgtttataaagatgaaattatgagtttttttattgtattttaagttaaagttaaggtttttaataataaaggagatggattttatagtttagtagtagttattaatttagtataagacggtaggtgaaagaaagatttttttatttgaggagggaggaaaaacgtatttttttagtaggtatttagtttgtttttttttaggttttatttattaagatttttttatagtattatgtatttagtaaatgagtattattttgaattaaattaaatattattttttttatttaaatgatgagaatgttgttagagttttttttattatttagattatgtttatggtatgaggaaatttttattaaaataattggttttgatttttatttttgggtttttgattataattttgtagttagaaattttttatatttgaatagaattttaatatgtttgtatatttataaagtttataatttaaaatttttataatatggtcgggcgtggtggcgtatgtttgtaattttagtattttgggaggcggaggtaggtagatttgtttggaggatagagtaagatttcgttttaaaaaaaaaaaaaaaaaaatttttgtaatgtatatattatatatattatttgtaaaatggttttaaattttaatttaaaaatgtgtttaattgtagtatttacgtaattttttattataatatagaatataaattttgttaaagggaatttagatataattatatgaaaaagaggttagttgaaattgtttttttgaaaagggaaaaatttgttttgtagggtatttaggaaaaaaataatgttaatattagttttttttgtttttttagaaattttaatttaattaattatggttatagaagattttatatatttatataaatgatatatagttttagattgagtataattatattattttttttgatttttgtttaagttgttatatttttgttatttatatttttgttaaaaataatatttttttggtttggtatggtggtttacgtttgtaattttagtatttagggaggttgaggtaggtggattatttgaggttgggagttcgagattagtgtgattaatatggagaaattttgtttttattaaaattataaaatgagttaggattggtggtatatgtttgtaatgttagttatttgggaggttgaggtaggagaatcgtttggattcgggaggtgaagttgtcgtgagtcgagattaggttattgtattttagtttgggtaataaaagcgaaagtttattttaaaaaaaaaaaataataataataataatagttttttttatttatgtgtattgtgtaaataattaatgattagaaaaataaatagagatgttattgttttttgatttttggtaatgtatatttatttttggttaagtttttttttgtatatgtgtgagaagtataaatagaagagtttgaaaattaaaggtgtgtgaggtatttttttattattagaggaaatgggttttattggtttatttaatttttattgtttttattttaagatagatatttagttatgttttatattttaatagaaatttttacgtatatttatcggttatagaattattagttttagtatttgttaaaaatgtaatatataattaaattattttatgatttttatttttattaaatattattgtattttatatatgtatgttataatattatgttatatgttttaaatatatataataaaatttaatataaaaggtagttatttatatatgttaaagtatatatgtgtgtatatataagtatatatgtatatatttaaagttatatatatattttttattatattttttattgtatataaaagtatgtgtattttaatatatgtgtgtgtgtgtgtgtatgtgtatgtgtgtatttttttatttttaagttagtataattaaatatgttaaaagaataaaatgtagaaataatttgtttattattaaatagtggaaaagttttgatgataaatttatattttttatgtttgtgtttatttagtagaaatatgataatttggttgagcgtggtggtttatgtttataattttagtattttgggaggtcgaggtgggcggattatttgaagttaggagttcgagattagtttgattaatatggagaaattttatttttattaaaaatataaaattagttaggtgttgtggtataagtttgtaattttagttatttaggaggttgaggtaggagaattatttgaatttgggaggtggaggttgtggtgaatcgagatcgcgttattgtattttagtttgggtaataagagcgaaattttattttaaaaataaaataaaataataatgaaatatgataattttatttagttttaataatttgaagaacgagtatattttatagataaaatgagtgttttaagtattttataagttatttttttatttttttattgttttatttgatgttaaaataagtttttaggtaaatagtttgttatttatttagttatggttatttgtatttaattatattttttttttaaatattttatgagttttataaaatttgtatgtgttgaaatttgtataagtgttaatttttttttttattgttgagaaattaattatagtgttatatatttgttttgttttagaaagttaatagtgtttatgtgtagaatatttttaaatattaaataggattatggtattttaatgaaagataataaaaattgattatttttgtttaaagtttttattggtttttttgtgtaaattttataagggatgttagttattttttttttgtgaatagagatttttttgatatatatttgatttgatgtttagttggaagattagatatataaaagtttttttgagtttaggaaatagtggatgttataatttgttttaaaggtttttaaaaatttttttttaaagattttagtttgaatataaaaagggaagttttattaataatattgttgtttgtagttagtttatataaatagtaaataagagaaaatgtattatattgaataattttttataattttaaattttttatttttgataatatagagttgatagttaaatattaataattttaatttgtattaataggtttttttaagtatattagttgagagaaattaaaaaaatagtttttttttgtttatagatgtaatagaaattgatgaagttttttgtatttggtaaaagtgtgtgtgggaatgtgtatgtgtatatgtttatattaatatttatgtaaatgaatgtgtgtgtgtatatgtattattaatgttataaaataaagtaatattagaaaaatataggaagaggtaatgaaataattgtatttagtttgaaaatagtaaagttattttagaaatattaaaattaaagtatggtttaatattatttatatagtaaatgatgttattcgaattttttaaatgtaaatattttattaataatataatgtttttataaaattttagtttttagtgaagttttaatagaagtaggtgtaaaagttttattattttttgagatatttgtttattgggaatatgttttagaaaaaatagtggaaagttattaggtacgttaaatttttattaaattaaatatatttatttataaatatataagtatacgtttttaaatgtgttgtatgttttaatgttttattaatttatgtggtaattaatattttattttttgtgtttagtattgtggttatatataagttaattgttaagaataaaataggggtttttaattggtttatttaggggagatgtaaagaaatttaagttttggtaaataattggttaaaataaaaattatggtaataatatttatgattatttaaggtttttttaggaaaatatttttataaaaagttagtgaattttaagttttttggaaagtattttggtaatttatagaagtattttgaaaatagttattttttttgagttagtagttttatttcgaaaagtttttttaaagtaaataattttaaatatatcgaatatgttttatgttatttatgaagtaataattaaaatgatttaaataaaattttttttgagtttaattttaaagaattagtaagaattagttagacgtaaatgagaaaatttgttttagttaagggagtaaaaattggaaaattaaaattagagagattagttagggtttttaatataatgttaatgtaatttagattgagttatgtaggaaatgtgaaattattattttatatttttaagtgtaagaagtgaaaatttaaaggaattaatatggttttttttttatagatgagtaaatggatattaaagagatttgataatttgtttgagttgttatttatagaaagtgttagagtagtgtttaaaatttaagttgtttgatttaaagttcggggttttattgttatatattatagatttttttgtttttttttttagtgagtgttgtttagggttgtttttttatttattttatttttttagttagtttgtatttttagttttagtatttttttttattttttgtttatggaatattagttttatgagggtagggtattgttttatttttagtgttatgtaagattagtgttgagtatttggtaggttttaaatagatattaattgaatattgataggaataatgaagtatgattaaataaaatgttataattgggtttttttaaggttatgtttttgagatgtagttgtaaaagaaatttaaggttttgagtagatatatttagattaataggaagttttttttttttttttttgatataataggttataatttgggaagattttaaagagtttttagattatttatgtaagggtttagttgaatttattatagtatatagaagagtagattgggaataattagattgagaatatttaatatttataatttattaatttgataattgtgtttgcggttagtaggaaagagagaaatttattagatgttataaatttttgtaataaatacgtttgaggtatttttgggagaagatattaatgtgtagagtttggaaagtaaaattttggagtataggatttttttttttttttatattatttatttttaattaataaatattgaaaaaaggataatttaatatataatttatattattgagttaaaatgttaaatatatgatatattttattttatttaaaatatgttagaaaattatatattatttttgttaatgttaagaattatatattgacgatttgtttatttttaataagaagaagataaaagaaataagaggtaggaagtaatatagtggaattaatgatttagatgataattaaattaaatatgtttttttaattgggaattaaattttgattaaggatttttatatagttagtaaaaagtaatttttattaaagaagattttttttaaatgataattttaagggaaaagtatgtattatgaggagttggttttatagatgtttgattttttttaatttatattaagtaaaaatttatgtattttgttgttgagtaaatatgggtttatattttagttttgttatttaagaattttgtagaaaattgatttgaattttgagtttttttatttataaagtgagaaagtaattattgttttatagaattgttatgtgaaagatattaaataatttgtatttaagaattttttttgtttatgttattgggtattttaagatggtggtgatgatgatgatgttgatggtagtgaggaagatgatgatgatgttaatgatgaaaagattgataatacgttttgagtttttattgtgttaaatatttaattaagtttattttattaaatttatataattttagaggatagatattattattatttttattttagagatgaagaatttgaggattagaaatgtttgtttgagtaataattgttataattagattttaatttagtttttgtttttttagagaacggttgattaaaattgttggaagtaaattatagaattattttttttatttatttttttttaaaatttttttaaattttttatatagggttttggatattaaagagataagtacgaatatttaaaagagaaaaatttatattatttattgttttgtaggaaatgtttttgtgattgtggtcggtaggggggaggggggttttgattgattataatgtggttattgtttttattttaaaatatgatgggagaagttaatggtttaataagatagatgatggtgaaaattaatattttaatgtattttttatgaaaatgtacgatggatttttatttttttgtgtataaagatatatagaaagaaagtagtatattgaaaatataaaatataaagttggaaagttttgatttttgtttgattgatattattttaaggtttattttttgatattttaaatgagaattgtgagtaattgaatttaaagataatttttttttttgtggttttaaagtgtattttagtagaatgtttatgttatttagtatttttttattttatttggttaaagagttttttatttttaattttaatatttagggagtttttttatagtgtaggtaagttagaagaatataagaagttttttttattaagggtattttggaattttgggtttttgtttaggaatttataaaagatttagtttgtttatatagtgggtaaaatatttatttaattaatttaataaaaatgagtaaaataggttattaggaataatgaatgtaaaaattttagtatttaaattagagattaatgtagatgattgattttagttattataaaagatgaataattttgtatagtttatttaaatatttttaaagtttaaattattatggtgagtcgaaattgattatttagaaagtgttttatttttttattttggagaagatattcgttttggtttgaatttttttgaaatagagttttaaataaagatgtggagaaaggttgtttattattgttgttaattgtttgtttttaatatgattttaggaagtaggtatgaggaaaaggtagagtgaataggaaagaggggagtttagatataaacgtgttatttgttttgttggtaattattgtgggtaattggtattttattttttgagatttttgaggagttttataaatgtgtttttgaagttgttttgtttgggatgaaaagggaagtatttatttatttttgaatgtttagaaatgtgtttatttaatatataaattttatttttgtgaagtgaatttgagttattttgttgtattttataatagttttttatatgtttatgtaaataaaaaatgtaggattatattattattagatattttaatttaggtattttggttaattgtgaaattataatttcgttattttatagatagggtatttaaaatatgtaaaatattaggatagttataaataatttttttttttttatttttatattatatataatatatttttatttattttatttatattttagatataattataaattttgaatgtaaaaaagtttttatttaaagatgaaaattataatttataattttttttaaattttaagagaaaagtaattttgtaattatttgataaaagtaattatttttaatgaaaaaatcgataatttttttaaaaattattttatgggtaaataatttttatagtttatttagttattagatatatttttttgatatttagtttttatatgggtttaaaggaaataatattagatatttttgaaaggaggtagaagaaagtattattttagcgtattttaggttatatagtaattatttttatttagtaaaattatatttttttttaattgttttaagaatggtttagaagaagtttgaaattatgtaaatagaagtaaaataggaaataaatgataaaaattatagtgataaatatttttaaatggagattatttttatattttgaaagtaagtttgttttaaagtttttgggatttttaaattttttattttttattttttttagttaatgtaaaataattttgggtaatgaagtaagattttgattcgtttttggtatttttagttatttttgttttgtatgttttattatattttaaggttgataaaagggtagatattattaagaaatatttgaaaatatgatgattagttaatattaatggtaatagaattagttgaagagaattttttatagttgaagattttaaattatggtaaaatataatttattttgaatgtttgtagattcggtattgggttgtttatgataaagaagaagttgtaaatagagtttaagttattagttaagagtattcggttaggttcgagaattttttgttagatatttagtattttatagaagtcggggtttgtaatagtgtagggtgtggatttttaagtgatatgattgaggtttttattaagaaagtacgtgagttttacgttttgtttttagatttgttaaaaattattattggatttaattatgatacgaatatatttgaaggaaattttttatttagttatttgagtatattttttaatattttttatagttatataagattttttttaaaacgtgaattattgtagatgatgaaaaaatgtgaaaaatatttttatacgttaaatattttattatagaaataaagttagagaattatttttttgtaaaggttgtttttttaaattttgtgttattaatttgtttttattttgtatttattaatttaaatattgtttttataggagtatattaatagtatgtgaaaattaaaattttgtttatttttatatgttttaatttataaatttttgttattgtatagtgtaatgtaagttaagtgtgtagtattatgtttatttttttattattgtatgttttagtattgtatgttttaggtggtttataaaataagatcgtttatttttgtttacgttttggttattttaatttttttgggtttattttgatatttttgtttttgaatttaagtggaataagtaaaaaggagaatttttatgtaggattttagggaatgttttaagaatttgaagatgtgattattattagagtgtgaaaatttatgaaatttattttgggatagagatttttttagtgagatgatagaatgtagtgataagaattagaatttggtgtttaatatgtgtttgagatttgtttttgttatttgttagatgtatgataatagataaattatttatttaaattttagttttttaatttgtaaaaggagtatttatttttgttttttttttatttgtttatgtatttatttatttattaaaaatatgttgtgtgtttagtattatttttgatggtgaggatataaaagggattaaattagtttaaggtgttattttcgtatggtttataagttaatgaaatgagatagaaattttaaataaatataaattttgataaataaataagtgggattaaagtagttgatagggtaataaaatgaataaatagataaaagtaaagtgatttagataaaagtgaaattttgattgggtggttaggaaaggtttttgagaagatgttagttaagttatgatttgagtgataaatgataagaagaatttattatgtgaatagttttaggtagagttttaaggttttttgtattttaagtagtataaaattttaaggtgaagagtatttaaaatattttaggtgtggaaaggttattgggtttagggtataggttttgagtaaggagggggaagtgttttggggtttaattacggagaattttgtaagtaattgtgatgagtttgagttttttttaaatatgataagaagttattgaaagattttaaaatagagagtgatatttaatttatgatgttgtttttaaaaaagttattttggtatttgtatagaaaatggattgtggtgggttaatagtggaagtagaaaagttagttaggagattattttagtagttaaggagagaattgatagtggttagtattaagtgaaaatggagatagaagtggaaagttttttgtaggtagagttgataatttgttgttaatttggatgttggtaatgagtgggatgagagattaaatattaaatttttgtttgagaaattagggggttggttgtgttatttgttgacgatggtaaagagttattggagaaagatttgaggatattcgatattatattatatttgaaaaatgtattatatttgattatattatatttgagaaattttttagagatttaagtagaaataggttgatatttgtttagatagagagatttatagttatatatgtttagaggttgaaagagagattagggttagagatagaattgtgaatatttaaagttatgggtttaagtgttagtatttagggaagatttatagagagagtagaaaaggtatatagatgaagttttaaattatttaatagttataagttgatagagggagttagttaagtatgaataatgggaagtagtagtttatgaggtagaaggaaaatttagttgttaagatttgaatttaagaaaaaatgagagatttaagaaagaagatggttaattttgtgaaatgttttaaaaatgttaaatttaaaaaagaataattaagtgatattagatttaattaagtggaggtgattgatgattttgtaaatagtaattttaaaagattagtggagaaagaaatttaagtggagtatgatgagaagagaataaaagttatattatttagtttatagggttatggggtatattaaatggatttatggatgtaaagtgtttagtatagtgtttggtatatagtaaatatttattaaaattagatggtggtggttattattattagtattataatatttgatgtaatagagtatgtagaattgagattggatatagtgattattgattgtatattattattttttatagtttttagttagtttttaaggattattagtttagtaaggtttggtttacgttatataattatttgggattatgtcgttgtattattaaatgaatttatagtgacgggatataaggtatatataaatagtgatgattaatgtttgtaatttttgttattttagtgaaatttaagatgggttttttttttttttttgagatggaattttgttttgttatttagatcggagtgtagtggtataattttggtttattgtagtttttattttttgggtttaagtgatttttttgttttagttttttaagtagttgggattataggtgtttatatttatattcggttaatttttgtatttttagtagagatagggttttatcgttttggttagggtggtttcgaatttttgattttaaattatttatttattttaattttttaaagtgttgggattataggtatgagttattacggttggttttatttaatttttttattttatttaatagttgtagagtagaattagataacgtagtgttatgatatattttgaaatggaaaatattatttttagtgaattttagtaaaatgttatgttaaaagtgtaagataagtagaatattttaaagataaaatagaataattagagtttaaggaggagagagaacgaaattatttttgtttggtaatgattatgatagggttgtttagtatttagaaaattttttgataaattgagttattgtttataaatgaataaaaaggagaaaagtttattttaaatatattttttatattatatattattatattttttattggatattaaattttatggaaaatggtaaaaataaaaattgagagataatttttagattattttaatatattttaaaagtttttattttggattttttttttaaaaagatttattttttttatatttttattttgggttattttaaaaaataaaatttagatgtttaagttatatttttttggataattttataaatttgtaaaaattaattattgtgaattgaaattaatatgattttttttatttagttttaaatttagtttttttttttgttttaaatttattattttttgttaattaaagtataagtatttttattttggttttagtgttagagtattggtttattattatgattttattgtatatttatatttttgtattttataaggtattttatagatttgatggttagtatgatggtaagttgtatttaatttataaatattttatagaagttttaatttttagagatggagaatacgttgtggaggttcgcgcgtatagtgatggaggagatggagtggtgttttaagttaaaattttaggtaagtgagttatttaagatatattttaattaagtatttgtgagtttttagattttgtggatttttaagggtagggataagtttgatatattagtgtttatatttttttaagtagattggatatattaaggattttttgaaatttggtatttttttttttatgagttataaaagtaagtttgtgatatattatatattttttgattattatttggatgttaaagtatagttgaaattttttagatataagacgaacgagtttttgggatttaatatatagtatggaatatattagtttatttgattgtggtaattattatataatgtatatatatattaaatttttatgttgtttattttgaatatatttaatttttgttagttaaatatttttaaataaaaagtataattaaaatggtataatttattgaatattatataatattaggttattatttaataataattaaatttttattaaaaggaaatatattaggttatttttaatatttttataatttttttatttggattatagatattgatatagtagtaaaagagaaaaatattaaattatagtttttttgttttttttttttttttattttatttattttttttttataaattttattttttatatttttgtttgatttggaaatatatatatttgaggtagttatttttttttttttatttttggtaatttgttatttaatttttgatatattttttttaatttatatgtatgatatagtttaattatattgaattttaatagatgttaatttgagaaatgtatgagaggttttgatattattagaagattttagaataaagatgataataaataatttataagaaaatttggttaatttgtataataaattttatgatataagtttatttgtataataaatttgtatatatatttttgaatttaaaataaaagttaaattttaagaaaattaaaaaaaaagaaaattgaaaatttggtgattttgatataaagaaataaatatgttatatattaaattaataaaaaattttttattataatgttagagtatttaatggtatttaataaatgttggttttaattgtatgttatgtttttgtgaagtttgttataatatatatatatattttttataaattaaaatagaattttgattttttttagtttaattattagtaattttgttttttaagaaaatagagaaattatagagatgtgaaaggaaaagaaaataattatgttttaaatattttaaaatagttattgttaatgtttagttgaatttatttatagttattttgtatatatatataattttatgttttagtttttatttttgtaaattatttaaaaattataaatgatatttttttaaataaatatgtaaatttattaaagtttttttttattataaataatatttttagagtttatttttataaattaattttttttttggttaaatttaagataaagtgttttaggttgttaaatttttttaaaaatatttattaatttttatttttattattattgagtataagtgttttttttattgtattattttaatattattgtttttttagttattgttaatttgataggggaaaatagaatttttttatttttgaaatattttttatatttagaattttgttaatatttttaatagttttatatttagtgggtagttttataaaaggaaattagagggaaatatggttattattttaaggaaggtaaagtataaataattaaataaattgtttttgaattttgggtttttttttttttgtgtagaagttagttatagcgagtttttgttttttgtatttatttttggtttattattttttatcgaaaggagaatttagtttttgggatttagattagaggtttttagtaagagatgatgtagtagtgatggtaatattagtttatttattattaatggtattggtaaatgttaaatagtagaattattagggataggggaaagttttgtttataatgtttgtttgtttttgtggtgtaaatatttttattatgtgtgattttaagttttttaagtgatgttatttaatatggagttgtgaagagttatttagtagtatattattatatgtaattgttattatataggtataataagaatttaaaaaatatttgataatattataatatagtaaaatattaagaaatgatgggttttgagtatttattatatttgttttaagtttttaaatttaagtttatataaattttattttaataattatatttttaatatattgtttatatattttttaaaaatttaataattggattttaggggttgtatcggttgattttagtatattatagttgtaatttgatattttagtatatatagtttatgtatagaagagtatttttttaattttaaatttaggatattttttatatttttttttttttgttaattaatggataatatttttattgattttagaatttttattatttattttttattttgattataattgtataaataaattgtagaattaacgttatgaaatgttagatgtttggtgaataatattattttagaatatttttgtttttaagtttggatttttaaattatttaaattattttaatgaggtaaatgtgtaaatataaatagaaattataggtttttttttaaatttaaaagatttttagtatttttttttggtttttatgttttaaatacgtagttaggattataatatattattagattttaatgtttataagtattatgttgtttgtttatttatttatttaataaatagatattaaatgtttataatatagtaattatagtttatatatttaaaatgtgttaagatttatatatttttatatttttgtttggttttgttgtaattttaatgatttttttgttttttagtgttggttttttaaggtttattatttatgtaatagataggggggttttttaaaatataaattaaattatataatttttttgttagaaagatggtttatagggaatggtgtgaattttggaggtggtgtttgtagtgagtcgaaatcgcgttattgtattttagtttgggcgatagagcgagatttcgttttaaaaaaaaaaaaaaaagaaaaagaaaaaaaagaaagaaagatggtttataggtaatatttatattttttattgtggtttatagtggtttatataatttatttttttttttattttaattaagtgttttgtttttttttttgttgatatttttttttttgaatatattagtgttatttttgttttgaggtatttttatttgtttttttttttgtttggaattttttggattttggtatgttagttttatttttattatttttgtttttgttttgatgttatttttttagaaaagttttatatatggttagtaattaaggtagtaggttattttgagtaaattttttttatattatagtattgtttattttttattttaatgttagtaattatgtaaaattattttatttattaatttgtatttgtttattatgtttttttatttttatttgaagttaagttttatgggagtaagtttttgtttgttttagttgatttttgaatttttagtatttaggggattatttggtatgtagtagggttttaaaaaataattgttgaattaatttatgatttttgtatagagaaaagtttattaataagaataatttgggtaatttaaaattatagtttttatttttagaaaattgatatatttttttattaggtttatgatttatattattttatgtgttgattcgtaaatttgatttttaaaaaaataagatttttttttagatatattttggaaatattttagatttgattatttgtaattgtatttttatttgatttgaatattgttatttattgttttaataatttattttttattgaatatttgtagtgtatattaaggtaaatgtaatattataaatgttttattatatatatattatttttaataattttatattattttttaaaaatcgtttttaataattatgagtaaattaagaaaatatatatatagttataatttttaatattaatttttataagttaatttggattattatatattttttataaattttagaatattaattgataaggatttttggttataaataaatatttttagagaagtatatatttaattatttgtagtgagtatgtatattttaagtttttatttttttttttagttttaaatagattatagatagttgaattaagaaagattgtagaatattttagagtttgaatatttttttacggaaaagaagtagttatttgaaatttttaaggtaggagtaatatgattagatttttttatttggaaaattatattggtgattgtcgaaaatatgtataggaggggattaagatataaggagatgaagtattaggttattgttatagaatgattaaaagataatgatgttttgggtcgggtgtagtggtttacgtttgtaattttagtattttgggaggtcgaggtaagcggatcgcgaggttaggagattgagagtattatggttaatatggtgatatttcgtttttattaaaaatataaaaaaaaaaaaaaaaaattagtcgggcgtggtggcgggtatttgtagttttatttattcgggaggttgaggtaggagaatggtgtgaatttaagaggcggagtttgtagtgagttgagattgagttattgtattttagtttgggcgatagagtgagattttattttaaaaaaataaaaataaaaaaataatgatgttatgatgttttgaattggaaagaaggtagtggtggatgtttagggtagattttaaaagagtaaggtattttttttatttgatttaaagttattatatatttattttgtgtattttgttttttaataaatttgtaatttattttgatattattattgatgatgtaatttgtatatttaatttaatatttttgttaattttaagatattaagttaaattgtataattaaatttattgatttaaatattgtgatggaaaatatattttgttgttttgttttgtttttttttgttagtagtagaagaaggtttagaaaattattttttgggtagaatttttatatgtttaattttattattatttttgtttttttttttttattttttaagtattgtagtgtaagagggataagaggatagtaggatgtttagatttattttatatgttattatatttagtttgtgattaagatataattagatattattatttaggaaatgttgtttttttaattattttgaaataattaaatattttgtttttttttattttattttttatgggattaatttgagtatttaagtatataaatttagtttatatattttagattgataaatagtttatatttaaattatttttaaaatgtatattttttttattattattgaattatgattaattatttaaagttttgtttaattatataaatgtatttagtatttttagttttgtaataaatatgaagttggaagataaattatttggataaagtaatattgtgtgagtttttaaatttaattttgggaggtaatttatagttttgatgattattaatataatttttgtagtgattaggtttgatttagtagttgttggataatttttagtatagggagtttttagagttttaattgttttttagaagttttgagtataatttttagaagtatattttaatattttaattatatgttaggtcgtgaatagtatttttgtatttaaattaatttaggtttttttaaattttttttaaggtttttattagttgttattaagtttttataataattttaatattttattttgtttatttagttagatttagaaataattttgttgaaatattttttgatggaatatatgtaagaatggaaaggaaattttaaaataattttttaagatgtattttttattagaataatttttattaatgaaataaagttttagtttttagagttatattttagtattataatgtgttaatgatttttttttacgataaaataaaatttattttttaaatattatagatttttaaaaatattttgttttttagtaaattaatttatttaataagtgtttaaatattaattatatgttaggtattttgttgggttattggttataataattgtaaatttttttgaagtttttattttaatggatattagaagaataaagaattaataaataaataataaaataattagatttaataaaaatataaggaaaaatgagtggttttttatatttttttttatatttaaagagaaaaataggtatataagtttttggtaggatgattaggttaagttttattaagaaggtgatgtaggttgaaatttaaaggataggaattagttatatgataaaagtgtgggtaaaggaagagtttgttatgttaaggatttgaaaggaggttggtgtaattagtgtgtagtgaggatatagagttatatgggatgaggttggagaggtaagaggggtaaagttatgaatagtttggtattgattatatttaaaaggtaatatttagatgtttgtaattttttgtaagtttaatagaaaaatgttgatgtgtttttaggagatgaaggatatgatttaatttaagattatttgttgtttttgtgtagaaaatagattggagtgagataagaggggagggagttgatagagttagtgaaaagaaagtaagtttgagatataattagaataaggtatttttttttagaaataattaatttataggttattgtaggtttttttatgattttaagaagtaaagtaaattatgataagattttttttaggataaatggttaaagagtgtatgtgaagattttagtttttttttttttatgattttttaatttttttttttttgttttttggtggtaggagagtttggagggaatgtagtgtttatatttttattttagggagatgtaggagggtattgagagtaagaagaatgatgttgagattttgagagaaaatgttttatattttttaaaaaaataaagagttttttatggtaattattaagattaatttagagaattaagttaaatgtggattttttaggaaatatgaaatgaaatgaaagaaggataataaattagtttttagtttttaaattagttttatggtatataaattgatatttttagtagtattattaaaattatagaataaaagttttagatgttgaagtgatatgatgatgatatttataagtaagatttatttaagatttagaaaatagtgattaatataatttaattattaaggtttatagataatagtgtagttattatatttagttattttttatatttttatttttagtattatgataattttataatggatatttttgtatatagattttttttttggatttttaattatttttttagaatgattgttagaagtgtaatgattggattaaagggaatgattttttaaaggtttggtatatatttgttaaattgttatttaaatagtaatgtttgtattttattattaaataaatttttgtagtattttgtttttttaaaaatttttgttaagtaaaaatattattttattattttttgttattattaatgtaaatatatagatgtatttgatagttgtttatagttttatttttgtaaaattttgtttatgttttttttatgttttatgttaagaattttttttaaaatgttataattaatgtataaaggaagattataaaattttttttgttatatttgtgtaaatatttttttaggtttgtttttaaatgttattaatgatggattggtatggtttatttttatgtaaaatgatgaattttgattataaaagtttttaaatatttaacgttgaatataaatagaaagttataaaataatatatataaggttatgtattatataataaagtttttattaatgatgtattatatataagatggtggttttataagattataattttatatttttgttgtattttttttatatttatgtatgtatatatatatataaatatttgttattgtattataattggttatagtatttagtatagtaatatgtttatgttgtggaggtttgtattttgagagtaataggttataaatatattatgttttttaggtatagttatatgttcgtataatgaggaagttgtttaatgatatttttgtgaagatatttttgttattaagtaacgtataattataagtttatttatatgaagtttaaaattagaaaatatattgatgtttaaaggggtttgtgtgtttaatatatatatatatatatatatatatatatatatatatatatatttatatataatatgtgaaatttttttaaaaaatttagtttagtgttgtttttgtggagtgatgggggaattattaggaagaggtttttggggtagtgtttgtgttttatttatttgtttggttggtgagtataaaggtattgatggtattgtttttaaattatgtttttaggttagatatggtggtttatgtttatagttttagtattttgggaggttaaggtgggtggataatttgaggttagaagtttgagataagtttgattaaagtggtgaaattttatttttattaaaaatatgaaaattagtcgggtatggtggtatatatttgtaattttagttatttaggaggttgatgtaggagaattgtttgaatttaggagattgaagttgtagtgagttaagatggttattatatgttagtttgggtaatagagtgagagtttattttaaaaataaatgaataaataaataaataaagttttaaaaattattaatttatataatttattttaaagtggtaaaagttaaaagaaggttgaagtagttgagtaaaggatagttagtttggtattttggaggtttatgtattagttttttagagttgttatgatagtatatagattgggtggttttgtttatttttttaattttgggggttagattaagatgttggtagggttggtgttttttaaggtttttttttttggtttgtagatggtcgtgtttttttatggtttttttttagtgtgtgtgtgtgtaagtatgtgtgttgtatttttttttttttataaggattgatttgtattgttttagatttattttaatgattttattgaaagattttattttaaatgtagttattttttgaggtattagggggttagaatttcgatatatgaatttgagagggataaaattttgtttaaatagaggttattggtaggtttaagagagtaatttttataaaatagtgtgggtgaaagttttatttttttaagtaaattttatagaatttatattttaaagcgaggaggtaaaataaataatatatagtaatatataaagttttgttagatagtgatagtatttgaaggtagttgaggaaggtaaagagaggtgggagagagtaagggtatttgtttttattaagagtgtagggaggggtttattttgataaggaaatgtttgaaaaaaaatggaataaagtgagagaaaagttgaagaagttatttggagagaaggaaatgtatttttattagaatagtacgaaagttttgaattggttgtatgtttagatgtttaaggaatagtaaggagattagtacggttggggttaagtaagttatgaggtgaatttgaattatagagttttataggttttgattaaggattttagattttattttaaaggtgatgagaagttattgaattagtttaaggtgggaagtgatatgattagatttatattttataatagagtattttaattattttttggaagggaagtagaaattttatgaatggtggtgtaaatttttgtgaatttttggaaatagggggattagttaggtgatagtttaagtaagagatgaagatagttttgattagtgtattaagagtagaagtgggaggtagttatattaaggatttatatggaggaagatttaatagtattttttgatgattttatgaggtatgtgaaatggatatggtagaattttaaggatttagatagattagtataattattttttgaaataattagtagaattatatattaaaatagaattatttattgaaaatatatgaagaaaagaaggagtattttaaattttgataagttgagtttaatatgttagtttaatatgtttatgagatattttagtggagagagagaaaaagagaattatttagtaaaattgagaaagtagttgaggttagatgatataaatttgttagagaattaattggtataattatataattttatttgtaatgtatattagtttggatggagatggaggaaatagagatagtagatgttttttggtgttgtttaaagttggtaaatggtatggttaatataagtggagattaaggaaaataaggatttattatttttagttaaagaataattaaaattgttgaatagagttagtattatatattatgaatattagaatatttttagttgttagtaataaatttttaatttaatttttaatttaaaattgtttaagaaagtttttgtggaattagtgttttaaaaatataattaaagaataatttttttttatttttttatttgagaggttttagttttattttaaggtttgttttttttgtggttgaaagattttgtagatgtgttaggaattatatagattttataatgtttaagaaagaagagggtttgttttttttgaagttttatttttaaaggaagtttagtttttaatagaagttttttagaaaaattttttttataatgtttagaagtgtgttaaaagtttttttttaaattagttaaatattatttttataattgtttaaagcgattaagatttatggttggtttgtgattgagaaaattttttttgatgagtgaataatatttgaataaaatatgaagagtattagtaaagaagtagagagagaaagattttttgtatgatgtttaaagttaaatagtgaggtaaataaatatagatataggatatatatttagagaaattagagacgaggaaattaggttaaagagtagttttataaaaatgtagagaaagttattttgggtagtatggttatttttacgatattgattttttttatttatgagtatggaatgtttttttatttttttgtatttttttttattttattgagtagtggtttgtagttttttttgaagaggttttttacgttttttgtaagttggatttttaggtattttattttttttgaagtaattgtgaatgggagtttatttatgatttggttttttgtttgtttgtgattggtgtataagaatgtttgtgatttttgtatattgattttgtattttgagattttgttgaagttgtttattagtttaaggagattttgggttgagataatggggttttttagatatataattatgttatttgtaaatagggataatttgattttttttttttttaattgattattttttattttttttttttgtttaattgttttggttagaatttttaatattatgttgaataggagtggtgagagagggtatttttgttttgtgttagtttttaaagggaatgtttttagtttttgtttatttagtatgatattggttgtgggtttgttatagatagtttttattattttgagatacgttttattaatatttaatttattgagagtttttagtatgaagggttgttgaattttgttaaaggttttttttgtatttattgagataattatgtggtttttgtttttggttttgtttatatgttggattatatttattgatttgtatatattgaattagttttgtattttagggatgaagtttatttgattatggtggataagttttttgatgtgttgttggatttgatttgttagtattttattgaggatttttgtattaatgtttattaaggatattggtttaaaatttttttttttggttgtgtttttgttcggttttggtattaggatgatgtcggttttataaaatgagttagggaggattttttttttttttattgattggaatagttttagaaggaatggtattagtttttttttgtatttttggtagaatttggttgtgaatttatttggttttggattttttttggttggtaaattattgattattgttataattttagagtttgttattggtttatttagagagttaatttcgttttggtttagttttgggagggtgtatgtgttaaggaatttatttattttttttagattttttagtttatttgcgtagaggtgtttgtggtattttttaatggtagtttgtatttttgtgggattagtggtgatattttttttattattttttattgcgtttgtttgatttttttttttttttttttttatttgttttgttagcggtttattaattttgttgatttttttaaaaaattagtttttgggggttttaattttttgaagggttttttttgtttttattttttttagttttgttttgattttagttattttttgttttttgttagtttttgaatatgtttgtttttgtttttttagtttttttaattgtgatgttagggtgttagttttggattttttttgtttttttttatgggtatttagtattataaatttttttttatatattgttttgaatgtgttttagagattttggtatgttgtgtttttgttttcgttggttttaaagaatatttttatttttgtttttatttcgttatgtatttagtagttatttaggagtaggttgtttagtttttatgtagttgagtagttttgagtgggttttttaattttgagttttagtttgattgtattgtggtttgagagatagtttgttataatttttgtttttttatatttgttgaggagtgttttatttttaattgtgtggttaattttggaataggtgtggtgtggtgttgaaaaaaaatgtatattttgttgatttggggtggagagttttgtagatgtttattaggttcgtttggtgtagagttgaggttaatttttgggtatttttgttgattttttgtttcgttgatttgtttaatgttgatagtggggtgttaaagttttttattattattgtgtgggagtttaagtttttttgtaggttatttaggatttgttttatgaatttgggtgttattttttttaagttattaatgattttttttatagaattggaaaaaattattttaaagtttatatggaattaaaaaagagtttgtattgttaagttaattttaagttaaaagaattaagttggaggtattatattatttgattttaaattatattataagtttatagtaattaaaatagtatggtattggtattaaaatagagatatagattaatggaatagaatagagtttttagaaataatgtcgtatatttataattatttgatttttgataaatttgggaaaaataagtaatggggaaaggattttttatttaataaatggtgttgggaaaattggttagttatatgtagaaagttgaaattggattttttttttatattttatataaaaattaatttaagatggattaaagatttatatgttagatttaaaattataaaaattttagaagaaaatttaggtattattatttaagatataggtatgggtaaggattttatgtttaaaatattaaaagtaatggtaataaaagttaaaattgataaatgggatttaattaaattaaagagtttttgtatagtaaaagaaattattattagagtgaataggtaatttataaaatgggagaaaatttttgttatttatttatttgataaagggttaatatttagaatttataatgaatttaaataaatttataagaaaaaaataaataattttattaaaaagtgggtaaaggatatgaatagatattttttaaaagaagatatttatgtagttaaaaaatatgaaaaaatgtttattattattggttattagagaaatgtaaatgaaaattataatgagatattattttatattagttagaatggtgattattaaaaagttaggaaataataggtgttggagaggatatggagaaataggaatatttttatattgttggtgggattgtaaattagtttaattattgtggaagttcgtgtggtaattttttaggggtttagaattagaaatattatttgatttagttattttattattgggtatatatttaaaggattttaaattatgttgttataaagatatatgtatacgtatgtttatagaggtattatttttaatagtaaagatttggaattaatttaaatgtttaataatgatagattggattaagaaaatgtggtatatatatattatggaatattatgtagttataaaaaatgatgagtttatgttttttgtagggatatggatgaaattggaaattattatttttagtaaattatcgtaaggataaaaaattaaatatcgtatgtttttatttataggtgggaattgaataatgagaatatatggatataggaaggggaatattatattttggggattgttgtggggtggggggaggggggtgggatagtattaggagatatatttaatgttaaatgacgagttaatgggtgtagtataatagtatggtatatgtatatatatgtaattaatttgtatattgtgtatatgtattttaaaatttaaagtataataataataaaataaataaaaaaataaaataaaaaatttagagaaagagtaatggaaatttatagaaaggttaggatgttagttttaaaatgtaggattgttttggatttaagaaatagaaattgttgataagatggatattgagattaaaataatttatgatgttgggtaaattgttaaggattatgttaataagttgagttgtaagaattttggtgtaaataaagttagtaaatataggtttattttttaaaaatatattatttggttttattattgttaaataatatttaagtagttaagtagagaggaatatttaaggattggtttatattattaatgatataaaaattgtaaatgtttttgttttgttttatattttagattagttattttataattttgaaatttatgaggtaaattttttattttaaataattgtatttggtgatgtgttttaaatttagaatgttatattgggagggtagaatttggaaagaatattgttgaaggaattaaaattggaatttagtatgaggaggaatttttatatatagtgagtgttttggaaaaggacgttagaaattaaagaaattaattatttttggagaatgtaattatagtgaagaattttcggagaatgaattaatagttttaagggagatatttttatttaaagatgattttatttttttgagtattgggtattagtaaaattttaattttattaaaaagtaatgtgttttttttatttgtaagtataatattaaggtttgagaaatttcgttgtaaagttttaattaatttatgatatatgtatgaataaattatttatgagaaaatggataattttttataatgatttatatgaagaattttaattattggtaagtttaattttgtatttttttatgaatgttgatttattaatgatataaaaagttatattaagatatttattttttatatttaagtggattgaaaatattttgtttttaaggatgaattaagatatatttattttcgttttaaattataggatattattttatttttttttttgaaataagagtaatataaaagttaattaaaataattagattatttttaatagatatatgtattaattattagaataagattttaaaatttatttttttttgaaatattataggttgtgttgaaatttgtaatttttttaggaaaatataaaaataattgtttgttttgagaaagggagttgggttttaaatttttttttttgaggtttgatatttatttattataatataaatttgaaaattatttagaaaggaaagtgattttgtgatttttaaaaataaaatttttgaaattttttataaatattattggaagtttttaatgttatagtaagagggaatataaaatgtttaaattggaaagtgatatgttaatatattaaaatggtttattcgatattatattagggattagttttagtgatttatgaaggagtatttaggttttaaagtaatttttatagttgggtaaggttagaagttaggttttttggtagattttttatagtatgagagtagtgtaaaggatattttagaggtagtttttatagatatattttgtaaaattatttagattaaaataaaataaataatttagaataattttaagagtatgagattatttagttagtagttttttttttataattttttattttagggtttgtatatttgatttttattttttttttttaaaaatgggtttaaaagtaaataattagttttgggttatatggttaggagaagtaagaagagtgaaggttattgaaggttatagaaaatgtaggaagagtcgagggtgtggtagagtatagagattaattttttaagttttttagtttatagagatgttttagaattttgatgtgtttgaaagttgtgaatttttaggatattaatatttatgtagatgatttatttaatgttatagttttttaatttatttaattttttttttttgatgattttgttttgtgttttgttttagttatttatttatgattataatcgaaataggaatttatagattttagtgtgaatttgaatttgagggatttttgaaatttggatggtaaaaaattatattataatttttatgaatttttaattgaaatttggtattttaaaatatatgaatttaggttatatattattttgttattaataataattaaatatatttttatatattttagttgttgaagtattattttaataatatattttttaaatttgtttttagattttgttatttaatgtgttaataagtatattatttgaatgtgttagtaatttatatttggttttttgatatttttataaatgaattttaatataataggtttttaaaaaattttatgtattatattttatgtatgtaataagagtattatttttagtatttttagaaatttatagattattaaacgggtttatgatattaaaaagtttaagaatttttgtaaattttaatattattaataattgtaaatttttttttttaattttgattttaaatattgtgttttttgattattgatttttttttttttagtttatttttttaaatttttttttaattttagtagtttttttatttttttttatttagattattagtgattttattgtttattttttttttttttttttttttttgttttttatttatttttatgtttttagtttttgttttgaatgttagtttagattttacggtttatattgaaaataattgttttatatattttgtttttttttttttttatgttttttatttggttaaatttaaatttatattaaatataattgtttatattttatgtgtttatatttaggtagaaggtagaagttatatgtttttattaagattttttttttgtatttttattttttttgtatttttatttttaatatttatttttttattagtattatatatttagagattttgagatataatttgtttatgttttttagttttgtttatgatagttatttatagaaatttaggagtttttgattaatacggatttaggtgtttattttttgatatttttatttatattttatttttaaaatttttttattgttttttttaaaatttattattagttattagtagagttttttgtaatttttatttatttattgagtgttttttttattttttaattttatttgaagttttgttttttttgatgatattgttttttttgtagtttatttaaaagtggtggtttttttttatattttttgaaggttgtatttggtggagggtagttgatttttttttttgttatttttatagtatttttttttttttttgtttaaaaagttttgtttggaattatattattatttttttttatttattttttttttttgtttaagttttttattagtttttagggttatttttatttattttatggagattttattttttagataatttttattttttttaaatgatattggagagaatgttatttttttttatattttttttataagttttagtgatataatgtaggtataaatgatttttgtattattttgttttttttattttttttttttattgatgttttttttacggttttattttagttttttttattattatttatataattttaaatattttattttttgtttattttttatttttatttttatttttggtatttagatttttaaaagtttttgatttattaggaaggataagttattgatttgattattgtttgtgttttttattttttttgtatttttattttttttatatttagtttaaattttatagttatataatataattatttttttgtatagattatttattttatttagaagtttttttttgttattttaattttattatatttatttggttaaaggagtggattaaatttaatttattatttgttttaagtttatatttttatggttaaaggtggttagagaagaatgttaatacgaatattggttttattttgaatttatgattataaaattttaagtgggtttatagtgttgttgggttattttattagatttttttagtatatttatttttttttttatttagaaatttattttatatttttttttttttttttttttaatttttaatatatttttattattttttttttttagttaatgattttgttttttatttttttgagaaataaaagtaatttgaagtagtcgatatttatatatacgtttatgtgatttgtttttttttttaagattttggttgaatgttttatgtttttaaggatatttttttatatggaagttagattttaatatttttcgttaatttaagaatattgttttaattattttttttttttttttttatattattatatttttttttttttatttgattttttttattattatataagtattttgtaatattgtttatttttaaggggggaaaatataaataagataaaataaaatagagtaataattgaaagaaagaagaaggaaaaaaatgaaggaaggaaagagggaaggaaggagagaaagagaagaaggagagaaagagaaggaaggaaggaaggaacgaagaaaaataaaaaaagaaaattttttttagtaattaacgtatgttttattattttttttggagtaaaatttaataaataatttattatttttattatttaattttttttttaaaattttattttaaatttgttttaattagatttttattataatattttgttaaaatagtttttgtcgaggttgttaatgatttttatgtttttaatttaggagtagttttttttttatttaagtttttagtagtattgatgtatatggttatttttttttttttggttttttgggtattagtttgttttgattttttttttttttttaagagttgttatttttagtttttttttttggtttttggtaattattttaatttttgaattttaaagttttttaggatttagtacgttagtaatttttttttttttagtttttaggtaattttatgtagtttcgaggttttaagtgtatgatatgtatttgtagaaaataattaaatgttagttttttttgatttatttagttgtttgattgttatttttatttagatatttaatttaaatttttttttatttttttttgtttgttttttttgtagttttatttattttaataaagtatttttaattttttttgaagtaatttttggtattattttttttaatatattatatttattttattaagaaattttgttggttttattattaaaataaatgtattgagaaatatttatttttgttgttattattatagggtttagttattgtgttttgtttttaggattgttgtattaattatttaattgtgtttttcgtttggtgtttaatatttataatttatttttaatataatgattatagtgattattttaaaatatgttagttttttttatgtttttgtataaaaatttttaatggttttttatttgagaaggggattagattatatttatatttgtattttgtttgatttttgttaatttgggttattattattaattttttagtttatgatatataaattagtttttggaaaatataagtttgtttattttattttttaatgttttgtaaaatttgatttaattaattaagatgtttgtaatttttttgttttgagatggagttttgttttattatttagtttggagtgtagagtagtataatttcggtttattgtaatttttattttttaggtttaggtagttattttgttttagttttttaagtagttgggattataggtgtatgttattaggtttagttaatttttgtatttttagtagagatagggttttgttatgttggttaggttggttttgaatttttgattttaggtgattcgtttgtttcggttttttaaagtgttgggattataggtgagagttattgtatttagttaagatgtttataatattattataaatttatgtatgtttttattatttatatgttgtattagtttatttttatattgttataaagaattatttgaaattgggtaatttataaagaaaagaggtttaattgatttatagttttataggttgtgtaggaagtatggttgggaaggttttaggaaatttataattatggtagaagggtaaaggggaagtaagtatatttgtatatagtggtaagaaagagagaagggggaagtgttatatatttttaaataattaggttttatgagaatttatttattattataagaatagtaagggagatatttatttttatgatttaattattttttattaggttttttttttaatattggggattatagtttaatttgagatttgggtggggatatagttaaattattattatatgttttgattatttaatataggtatgttttttttttgtataaatgagaataatggtgtttatttttgatatgagttataaatgaataaattaaatttgtttttatatattttaaatttttgttatttaattataatcggaagtatgagtgggaaagataatattttatattagtattttttaaattttttttattattgtttttttaggaagtttcgttatatattatttttttaagtgttattatttatgaaattttaatattaaaaatttattgtatagttgtttatgttatgtggttttttagagatttaaaattattatgagattttagatttttttattttataagaattaatttttatttagttggaggttatgttggttttattgagaatgtatgttcggtggagatttttatttattttattttttggagatatagtaaattttatgaattaattagtttaaatttttagtgagttgtgtttttagaatatattgttttgtgattttttttttttttttttttttgagacggagttttgttttgttatttaggttggagtgtagtggtgagatttcggtttattgtaagttttgttttttaggtttacgttatttttttgttttagttttttaagtagttgggattataggtgttcgttattatgtttagataatttttttttttattttttagtagagatagtattttatcgtgttagttaggatggtttcgattttttgatttcgtgatttatttatttcggttttttaaagtgttgggattataggtgtgagttatcgtatttagtttgttttgtgattttatataattaattttgtattgaattgtattttagttttatgttattggtttagattgagggtaattaaaaataaagtagagaaataaaattaaaaaaaatatataaaatttattattatattattttataattgttgaggatatatttttataaaatatatataaaaatgttttttttttaaggaattgtgaatgaaagtttttttaggtaggggtgaatttatagaagtgagtattttggtttaggttaataaataaatatttaatgtttaaataaaataatttaatattaatattaaattagttttgaaatttttgtatattatgtatttaatggagaagatgagattttgtaagaggaagaatgtaaggaggattatttttgtttaaattttggaatagtttattttttaatatttattttatataaatatatatatatatatatatatatatatatatatatatatatatataaagaaatttatagttaaataatttattttttgtgagtagtgtagatattatttattggaatgtattaaatagtagatttattttttatatatatatattttaaatagtttattagtatttttttttagtagagaattgtgggggtagaatattgtgataaatatgtttttttaattttttgtatttttagtattgtgttggtatttagtatagtttatatttcggatatttgtttaattagattgttttataaattttgtttttggttttaagattagaagtagataagttttttttgagatattatttgtttttattttttggataaagatattggaaatttaatggttgatgtattttcgtgtttgtattgtatggttaaagtttagagttaaatttgttatatgtttatagtaaaatatataaagtattgtatattttattttaaaatgtttgaatatatatgtagtggttttaaaaagtgtttggaataatatagatataataaatattagtaatatttgtattagttttagttgatgttgttgttattttggtattattttttattttgtattatgttttttaattttattttttttttttttaatttttttatttgttttttttattatattttatttatttttgtaaattattagaaagtttttttagaatgaagtagtttataatttataagtaaatatttatattttattttttaaagaatttggtaaattattttgatttagtgtttgtttttttaatttaattagtaaaaaaagttttttagataaatattgttggattataatatttggaagattttaatagtaaatgttttaagaatatttatttatttttaagaattataaaatatgaatcggatttttagtatatgttttataattaaatttaagttaaaaagaatttttgaaatattatttaaagttataaagaatgtatttaaaatgtgagagttaataaaatttaaagagaaaatttttaaaataaaatggatataagaagaaaaatgaattaaaaagtatttatatatttagtaaaataaatgtgtttagaaaatagagaattggtatgtgtgattttaagattatatagatattataatttaagtagaagtttaaaatataaagtaaattaatttgatagagaaatatttgaagtagaaaaaataatgatgttattatatttgaaaaatatagtttttataatttttatatttttttaagtattttaagtgttttcgtgatattatatagtttgagtttatttttagaaagttttggtttttataaataaaaagatattttttttttttatagagttattatgaatggttgattaaatttttaaatatataaatatattgttatggatatatgatatttaaaatgaatttgatgtagaggaaaaagtagtttatagataaaatttatttagattttgttttttttatgtttttattaaatatatatatatatatatatatatatatatatatatatatttgttaataatgtagtgttagttttttataaggtggtttatttttggaaatttttgttattttgtaattttgttaattatgttgttttttatattgatgatttagatgtttgaatatattttttgtagttttttgtagttatatgttattttttttgtttttgtttttgggattgaaaattgtcgttattaagaatttttaattaatttttaatagattttaaaataattaatatatatttaaatgttattataaataatataatgttagtttatatttattattatatttgttgaattttggatttagttaaaggaataaagaattatttaatttagtatttttttattttgattttttaatttttttttatttatttttaaaataaatatagtgtattattaaggtaaaagtttttaaaattttattgtttttttgtttttttattttttaaaaatatatattgtatgttagtttttaattgtgtttatggaaatttgtaaaatattaattaatattttataagttagataaaataaatataaaaggaaatattttatatttgaattttagaggttaattttttttttttaaagaaagagaagttatattatttttaaattaaagtgaaaatgagtatgtttttttattgttatttgattatttaggattatatagtgttttaaagtttttatattattttttttggtataagatttatttttttaaaatttgagaatgataaaattagtaataaattttgttaggagttatagtatcgatattgggaaaaaataaggtaattatattataggtattagtaaatatagtattatatatattttttagaatatatttgattataaatatttttttataaattaagtagatattgttgttaatgtttaatattttatttattttttatggaatataatatgtatgaggtaaggttagttatatataagatgaaaaattatggtgaaaatatgattagagtatttgttttagtaaagagagaaatggtaattttttttttattttaaatataaataagttttttatttttataattaatttattgataatataaattaaagtatttattatagaatatagtagttgtttaattattttattgatttttagtagttattaatatattttgtaagttagtatataaataaggtattttatatagaataatgtttttaaattatattattagttgttatgttatatttaaagaatttattttttagttattagatgtatttgaatgtatttatgtgatttagagaatgttaagttatgtaatatatttttgtaaatttgatgaatttttatttatatgtgttaattttaaaatattgttttaattatttaatatattttttatatagttttgttgtatggttaatgaatagtatgttatttgtggtttatcgttagttatttttaattagacgaaatttaatattgtaagttttaaaattgaagattaggtattattttaagtagtaaatatttttgttttggtttttttttaggttaataatttttttgatatttgtataattgtgtttgaaatatagtttaatagaatatgtatttgttttttataaaattaatgttttagacgatgataaaatatgttgaagttttaagggaattattttttttattattttggattggtttatgaattaatgaaatggaaattaatatatatgagaggattaattataattttatattaatttagagtattataagtagtggtttagaataagagtttattttttgtgaatatttaggataatttttattagttttttttttttttataatgtattttttggtaaatattttgttattattacgatagtgggtgtttttaaaatttatttatatattttgttttatttttttttttttagtgtgtttttttttttttttaggaaattttttttttgttgttatttggaagtatttttttttttgttttttttatatttttggtattttaagtgtaattgtgtttattatatcgtattatagttgtggtttattattatttaattaagattttttgagaagaagaaaggttatttttgtatttagtattgattatagaagtagtgggtttttattaaattgaaatttatgaatggaggtttggtagttaagtttttttttgttatattaaaattgagaagtaattttaaagaaagaaaaatgatttggatagaaatttatattttaattatatttagatggtttttgtttatttagttaaaataattagtatttttatttataagttggattatgttaatgtattttttttagtagtgattttttttttttttttttttagttttttatatagggatattatagttacggatttgtttttattttgaagaagtacgggtattttagtatttagatttttttttgagtttgtataattttggagatgtagagtagttaagttgtagttagaagagttttgatttttttcggtttggattaagtggtattttaaattttaaatattttttaatgttttttagtttgggtttggttagatattttttttttgagtttattattagaaatttttggaatgtggtttgtagagattatagataattggtatttattttttaataaataaagtaggttagaaaataattttttagttataataatataaagagttattaattatgaaatatttatttataatagtaatgtattttgtatttttgttaaaataatataattagttaattgttattattattattttattgatgaagttattgaaatttagagagtttatgtaatttgtttaaagttttatagttggttaagttaggagttagaatttaaatgatttagttttaatattaaagtatgtgtttttaatttgtatattatgttaggatgggattagttttatatggtaatttttagtaagaatttgatattgggatatgatatagtaataagagaagagaaatagagatatttagaaatatataggttattttataagtaattattatattgtagaataaatagtgaatgttagataggtatagttaaaatttttagtattttaattttaaattaaattttgttaattatttgggagaggatttgatatagtttttgttattatttaaatagatagaatttatatgatttttggaggaggaaaaaattaaataaatttagattatttttttttaattttttagattttattcgtataagtggaaaatttatttgatttagttaaaattaatatatttaaagtattaattatatagtttaattaaagtattatttaaatataatatttagattataatttattatattataaatatttggatatttataaatattatatttagatatttataaatatttataatatttagatatttataaatatttataatatttagatatttataaatattataaatatttagatatttataaatattataaatatttagatatttataaatgatatttataaatattataaatatttagatatttataaatattataaatatttagatatttataaatattataaatatttagatatttataaatattatatttagatatttataaatattatatttagatatttataaatattaagatatttatattataaatatttagatatttatattattatatttagatatttataaatattattataaatatttagatattatttataaatatttagataatattttattttttttaaagaaagagttatgtatttttggtttaagattatattttaaatataggtttaatttaaaatagattatgattattataaaaaggaagaaaggtgataaataatatttaaaaattttatatgtatattagtagattttttataaggaaaatattattaaagtttaatgtgtaattaatttagttcggtgaaatatttttgatatgtattaaaaaattaatttatggttagttaataatgtaatttttagaatatgtaatattaatataagattttgtttatatttttgaattaagtattttagtggatattggtttagatgggttgattgtttgattttaaattttatttgatgaatttggaatggaagattaagaaataaaggtagagaggtatgattggagtataagttatatttagattgtgaaaagggagaagattaagtttgtggtttttgttttttgttttttggcgttttggcgtgattttttttatttttatattttgttttttttatatataagtatgagatgatgagattttaaatttttaatgtataggtaataaaggtgaagagtcgtgagagattttagagttatattggagattaaattagttggatttggtatttaagttgatatattataggcgaggaagaaaaagtattttgtaaatgacggtattttttattatgaataattaagtgtatggtattttatgaattgaattaagtagtgtaggaggatggataatttttataggagtagtggtaggaatagggagtatagagggagagagaagtggttttgtgataaacgtaagaattttaatatggaaaaataggtaaagtgaataagagataaaataatttaggtaagatatagtaaatttaaaatgagttaatgtttttaagtttttttttaggttttttaatattttttttaatatttagaaaatttattatgaattattttatatatgttattatattattattgataaatatttaaaagtttttgtttttattgttaagataaatgagtataataagatataagttttgaaaagagaaaaagtaataataattaaaaattgtatgatggaatgaataaaagaagtttggtaatattgatagaaatgttggtattgaaggaattttagttttatttatttgtgggaatttgatttgtttaatgtaaataaaatggttttttaaagaattttttagaattttaaatggttagaaagaagtaattattttgttgattttataaataaatttttgtaaaagtgatgaaagttaattttttttttttttttttttaatttaaaaagaatttgaaaagaatttaaaattttaaggtttaatattatgaaattatgattaaggatgagtttttttagaaaagaaggaagtttgaaaaatatataaatagaattaaggaaattttgtgtagatataatttaaggtgattagaattattttatatttttaggttgagaaattgaataagtataattttttagaaattttttagattagttaatgtttaattttagttagtgattttttatatattttagattatagttaaaatagttgaaaaattatttttgttgtgaaagtataaagagaagatttagtttgttatgatttttttaatagttttagtgatttaatgaatttggataattttttataagaattttatgtgtatatagtaaaatagagagatattaattaattttttttgatagatggatgatattgaattgtgaaataaggttttaagatttaataaataaatgaatttaaggttataaaaagaagaaaaattttaatagtaaatattaaatattaatatattaggagaaaaattttaatattaaatattaaattttaatgtttttaatattaaatatcgattttaatattaaatattaaaatatagttttaaataggtgaattatttatttgttatagttttaaagttaaagatgattgaagattaatagaattttttgttttagttttattttgagaaagtttttagggtagttttgtttttgtattattatttgaaattagtgagagaatgggattattggttgttattgttattgaggtttttagaaatttttagttatttttaatttttaatttattatattaaggaaggcggtattattgtattttttagtaatgtttaaagatgtttatgaagtagttaggatgtagaggaaatagtattgggtttagattttggtttatgtttaatatttaagtttattgttttttaggtatgtaaatataagttttaggtttttaatttgtaaatataaataatgatatatattttaattgtattttataagaatttagtaaaataaatgttgtaatgtgttttagataaattaggtatttattaagtggtttaaaagaattaaaaaatttattgaataggttaagtgtagtggtttgagtttgtaattcgagtattttgtagggtcgaggtgagaggattgtttgaatttaggagttttagattagtttgggtaatattgtgagattttatatttacgaaaaatataaaaatttagttgggaatggttatgtatgtttttaattttatttatttagaaggttgaagtgagaggattatttgagtttgggaagtaaaggttttggtgagttgtgatcgtatttttgtatttatttaggtaattgagtgagtttgtcggaaaaaaaaaatgaatagatatttgttaatgatatattatggattaggttgtttagaattttatgaataaatgaaataattttaaggaaaattgagttttatggttagttagttttattttttttttttattgttaatatttataaatattagttagtttttataaaaaaagagaagtaaagtaatagaacgagtaatttttgtggtgggggatgattgtaagggatagtttttttttgtatgtaaataaatttatagggttatgtatttgttgaaaatgtttaagaagttttagttatagtgtttaattggttttttaagatttgtattgaagaggaattattaattttggtatagtggaatatgtaaatttttaaattttttttttggttttatttgtttttttgttttaaaaattaatttggagaaggtaaggtagaggtagtggaaggaataatttagtatttgtttttataagtatggtaaaatggaatgggtatttgaagttgttagtttttttaattttgattgaggttgagaaaagttatttttggtgataatttagtgtattttataaagttggggttgtaaatgtgagaatattttgttaaatagttatttttaaagttaagtgtatagattatttaataaattggttttggttgttggttaattaattataaattaaaaatttgaatgttatttataaaatattttgtatacgttgggaataaaataaatttatgaaatttattatatataattttatgtattttatagaatagaatttagatattaaggtttgagttttttttgttttattttagattgagtatgtttttattaaatatttattaaaaaattaaatatttttttaaatgaatgaattatatttaatattgtaaatttataatttatagatggtttttattttgtattttaattttattatgtaagtattagatttttaattttataaataagtaaatggagtatagagagatttagtattttatgagaggttatatatttaagtgagtggtaatagtatgtagatagaattgttttattttaagttttatgtttttgtgtaaatgttattttgtatttttaaagaagtaggtaagttagttttaaaagtttttataattatggttttattttgttttaaaatattaaaattgggtttgttgagtatgtgtttattggttagttttttataaaagttagaagttgtttttatattttttagtaaattaattggttattattttattggaaatgtttattttttttttaaagaggaaatgtattttggtgatttggtgttttttgatagggaaagggttagagttaatagtaaggaataaatataattgttaggataagttgttagaaaattatgtatttttgttaaataaataaagatttattttgtttggtatgtgggtttgggtttataattgttaaacgaataggagtagaaagattagtgggttttattggatggaaaaatttatcgaagttattagtatttagatgattaagtatttaatgtatatttataaattaatattaattttgattagtataaataagggaaaatgtaataaatatgtttgtaaattttatggtttaatgtttgatatttttaaatatattatggtttgtttagaattatagatttagggttgtagtaggaattttaaaatttataatattaaattttattattttatagaaggaaaatttatatttttgagaagtaaaatagttaaagattatagaagtattagaattatgttttgagtttaaatattttttgttgttaaagttatataattagttattgatagaattagaggtaggttttaagttgtttttttttttttttatttagtttagtatttgagtgttgttattttaagtaggtaaagggaaataaaattattaaaagtaaaataagtaagttgatatatagataatattataaaatagatattttagggaaaaaataaaaattattaaatgtgtaaaaattttgttgaattttaaagattaaatttattttattttttgatttttttttgggttttttttttagaaatttttaaaattaattagtgtgattatttattattttattttgttaaagttatgaagttaatgtttataataatttaaaattgaaaattatattaacgttttttttaagaaattggtttgaagttaatttagttaattttttaaaaagatattttttttgttaatattagattatttataaaaataataattttgatatatagtttaaagaaaatgttaatagtaattttattgaattatagtagtgttattgaaaattgtatgttagtttttaggtaagtataatttttttattttatagatttgtaagttttatattttaattttagtttatatttgtattgttgataatatttagataggatggaaatttggaaagaaaaaaattatgtaagagaaaatgtgtaaggagaaagagataaagatgagatagaaatgttaaaaatgaattaagtaataatttaaagatttttttgttttagatattttataaaattttagttaatatatttaaaatatttgtttttattttaatagttttatattgattaagtgttaatttaaggaagtaaatgggattgtatgaattttttaaaattattattgttagaaaattaattatataataaagtagattttagtgttttaaagtaaaatatattttttttttttttaatgtttgtttttatatatttttgttataaaatttaataaaataaatatttaattgatttttttatttagttttgatagtaatttaatggagaaataaatataatttagtaatttgtagaatggaatattattagtaaaagaattttagaaaatttttaattgattagattaagtttaaaataaagttttttattataaatttattatttttttagataaatttttatgagtgattaaatttgtaaagtggtaaatttatattaggtttttttgtataaataaataagataaaaaatgttgaaaaattcgaacgttgtatttattttgattgcgttttagtggttatttataaaaatggatttagtattttgataagtttattgaaagtgttgtttttagtagttaaagagagtatttgttttttttgtgttgattagttttaagtaattgggaaaatagttaaaagttgagaaaggtaaattagagaggttttaaatgatataggtgagtaaagttttgaaatacgtttttttaattattataaatttattagaaaacgtatttttttatagttatgggtagaatataatttttgtgtgatggtttttgatagaaagttattgtggttaataagtttgggagatattgattattttttgttgttttgatgatttttaatatgtatttatttgtattttttagatgagagtagttttttttttgttttagaattttttttttgtttttggatttatatagtttttttattgggtaaagtatcgttttttttgagataagaatgaaagttattatttttttatatggttttgtttttttggttagagtgattggttgagtgatggaaagtttttttaaattagtttaattaaagaagttattaatttagttatagttattggtttggggataggtgtgtgatttgatgtttgtaaagtagagtttttttttaagaattttttattagtgttggggtaaaacgatagtttagtttgtttgtttttaagaatacgtgatgtgagttaggagtttatattttttttgagagaagttagtttgagaatgtgaggtaataggtcgggcgcggtagtttacgtttgtaattttagtattttgggaagtcgaggcgggcggattacgaggttaggagttgagattattttggttagtatagtgaaattttatttttattaaaaatataaaaattagtcgggtatggtggcgggcgtttgtagttttagttattcgggaggttgaggtaggagaatggcgtgaattcgggaggtagagtttttagttagtcgagatcgcgttattgtattgtagtttgggcgattgagtgagattttattttaaaaaaaaaaaaaaaaataatgtgaggtaaattgtaaaagaataagaggtgaaagttagagatttggaagatgtaggtatttaattatttgttttagtgtgtttgtaaaatattagttgttaggttggggttttgttttttaaaattaaagatttttgattattatgttatataaatattggagttggaagttagatttttatagaaaaatttagtatgtttagtttatgttattgtttgttttattttatttaattatttttttagaaatatagtgtaggtttagaataagaaataaattttatgaaatgtagtaggaattgttattatttattgggagttatttattaattatgtatttttgaaatgttttatataaagtagttgtttttaaatcgtgataagtagagttttatatgttttatggggtgatagagttgcgggaagtataggtgttagtatgaaaatagagaagataaaaatttggtggttttttgtttttaaatttatttttgagtaaagtattttttttttatttagtttaataatggatttttatatataattatttttgaagaaaggttatgttatttttttagatagatagatagatagatagatagatagatgttatgagatatattattatttttattttatagttgaaggaaaaaggtttaatttttttttaatttttttaaattaaaaaaattaaagaatatgtttaagattatttagattatgtagttagtaaaaggtagaggtagagtttgaattttgttttgtttgtttttagaacgtttgatttagttgttatgtgatattgtttttaatatatttttgtggtttttattaggataggtatttattgtttgttttattttatttttttatttttttgagacggagtttcgttttgtcgttcgggttggagtgtagtggcgttattttcgtttattgtaagttttgtttttcgggtttacgttatttttttgttttagtttttcgagtagttgggattataggtgtttgttattaagttcggttatttttttgtatttttagtagaaacggggttttatcgtgttagttaggatggtttcgaatttttgattttgtgatttattcgtttgggttttttaaagtgttgggattataggcgtgagttatcgtattcggttttattgtttgttttattgatatttatattagttagtttgttttgttaaaattaaatagttaaagattaaatagaaatttgtagttcgataaagttagagttattgattggatgtagtaaggaaatatatattagagtaattatggaatattatgtaggtgcgaaggagaagtgttttatgtaaggtttgagtttttgttgaagaattttgaggagggtggaaataaattggtagttagatttggattagttttgtttttgaagtgggaataggagaagtaggaattaattagagttggggttgttatgaggggagtgtagtttagtaattgggtatttttattaataggtgggataagaagagtagagttggggtattattggtaatagtattatttatttggtgaggaggttatgatggtattttatagtagttttgtgattttggtagtgttttttgtgaattttatagttggtattatttatgtttgttatacgaatttgaataaaggttttgttatttttttgttttagttgatttttattttaattatagggatgtttttatttttttagtttttaaacgtgttgttttagtaggagttttattgaatttaataatttttaacgtaagtatttatttatgtgtatttaatatattttatatatattaggtatatttttaggtagtggggaattaattatttaataaaaatatttttttttatatggttagggttattaatagatttcggaagaataaaaaataatgtcggattaggattagttggaggatttttggattgagtagtaaaattattgttttttgatattatattatgaatttttaatattatttttttaataggaaaaaattattttttgaggaaaagtaattataggaaggtataatttttttttttgtttaggtttttagaagttagagagattatgtaatatagaataaaataaaaagaaatattaggggttatattgaaggttatagtggttttttttaattatttttttttttagattttttgtgttttgtaataagaaaaaatttagggtttataatggaggtataatttaattatttaatattataggttgagtattttttatgtattaggtttggtattagttaatatagttaaaatataatttggatattatttttgttttgaagttgtttataatatagagatattagtagttgtggttataaaatgtgatattataaagagaaaattttaaatgttatggtatcgttagtaataggtaagtagtagaaataaagattgtattatagtgtttagattgaagaattagaaaggaagtttgtattaaaaattaagtagagtagttttttatttattagaaagtttgtagtattgtttaatttttaattgaaatgtttgtttttagtattattttttatatagcgggaattttttttgaaggaagtatgaaattaaagtttagatttaaaaaaaaattaagaatttttatggaagagatatagtattttaaattggttttatattttttttgatagagaaaaattatttataagattaatgatttgtttaggtttaatatttattagttatgtgaaaagtaaaatatgtgtttattatataatatataagtattagaattatgattgatagtagtattttgatatatatgttgttagatttaaaattaatatatattgaaaaattttttaagaatatatgttatttaaaatgatattagatagtattttaattcggtttttaatttttgtttggaatgtgggatagaagtaaagatgaagattaaaattatataagtttgagttattagagaaattaaatataatatacgtaaatatggagagtttattttaaatattttgatgttaaagttataaattatgaaattgtatttggtttttatattagtattaaaatattaagatggtatttataatttattaaatttttttcgagtagttatagtttgtattttgttaatttatatatttagttaagtatataaatatgtttttatgatagatgtaatttgtggttaaaagatagagtattgtggagattttgtagttatttttagataaaaaaggttttagaatgatgatttttaatttttattataagaataaaaaattaaatatcgtatatttttatttataggtgggaattgaataatgagattatatggatataggaaggggaatattatattttggggattgtggtggggtgggggaggggggagggatagtattgggagatatatttaatgttagatgacgagttagtgggtgtagcgtattagtatggtatatgtatatatatgtaattaatttgtataatgtgtatatgtattttaaaatttaaagtataataaaaaaaaaaaggttttaggatggattatttatattgggttaaatattgacgtttaaaggttttattgtgtgattgaggtttattattgggtattttattagaataaaataatgtgtggtttgtggtatattttaaaaaatttgtagaaaagtagaagataaaaaaaattataagaatataaagatttttttgaaatagtttatgtgttagtttttttttatatgatatttattattttttttttgtgtttttgttttgatatattaagtgtagagcgtagtttttttttgtatttttaaaattagttttttgttaaagttatttgtaagaatacggtagagaggttaaaagtgtatggtttttgtagttggataaatttgaattttaattttttttttgttttttagtgattattggatttgagtaatttattttatttgatttagttataaaatatataaaattagggtaaaagatttattattgtaggttgttgtagttatgttataatttatataatgagttaatatagttttgtagttggttgtagggtagtaagtagtattttttaaagtaatgataagtttattattgttattgatagtgtttttaggagttttgttatttgagggttgtttatattttttttgttatttgtttttattttttgatttttatttttttgtttatttttaagaattattttatttgtattcgataaagtttttttttttatgtttttaggtagttttaaaagttttaggtagggtaatgttgaagataagtaagtagatagatattattattttttattttatagggaatatgaatgtgtttttaatgattagagatttaggagaaatgtattaaatttttttgaatataaaaggattatgttaaagaatgagttgtttatggttatttttaatgtgatagataataataatttatttggtggttttaaatttagagagtaaatttttaaaaattaatgaaaattgttatattagtaagttattgattaaattttttaggtttttatttattttagtagtatgtttattgaagatagtgttagttaggtatggtggtttatgtttgtaattttagtattttgggagattgaggtaggaggattatatgggtttaggagtttgaggttgtagttagttatgattgaattattgtattttagtttgagtaatagaataagattttgtattttaaaaaataataattaatttatttaaaaagaagatagtgtttaatagttgtggatattgggaagaaagagtatgattttttggttttattttataatagttttttaaaaatttttatgtcggtaggatacggatttataaatttatttgattataggagtagtttttttaagtgttatttaagacgtaaattaagtttatagtatattataatatattattttaatttttaatttatagtgtaatattttagggtaattgttttttagataaaaattgaatgagattatttaatattagaaatatattatttaagttattttgtataaatgtataaatgttttaaaattattgggatgtgaaattatgtaagatttatttagtatatttatgttgttattgttttaggaaaaattattagtatttttattgtatttttttttttatattttattattattatattttaagttttagggtatatgtgtataatgtgtaggtttgttatatatgtatataagtgttatgttggtgtgttgtatttattaattcgttatttagtattaggtatattttttaatgttatttttttttattttttttattttataattttattttatttttaaaatttatttttttaatgtatgtatatatgttttttgatattttgttttttggtaggaatttgggattgttggattatagggatagtatatatatttgtgattatattattttaaatgattaattatgttgtgtaaatagtttatatggttttatatagaaaatttttgattaaaagtttttgttttttttaaattatgtaagaataagagattttgttttgtgaaaggatttatttgttttttagggttatgtaatttcgttttagttgaagtagattaaatgagtaatagtgatatgtattaatgaaataatatgtatatttttggtttattttgtaggtgtatttattttatttttaagttttttcggtttattgttgtttgtttttggtatttttgtttatttggaattttgaatgtgttgtgatagttgttgtttttattttagtttagaagatattttttaattttgggatgattataattttttttaatttttgcggttttattttaagttaaataaattatattttaataaattatttaattgatttataatatatatgatgattgaggtattcgggaatttttttatttaaaagaataaatttttaaatggatataaatgatttttaattcgttttaatatgttttataaattatttaatttgattttgtgatagttgtatgatttaatttaatgggataagttatagtgtttaatttaatattataggttgtagagtgaaagttaaattattatatataggtgttttaaatttaataataagttgtgaaatataatagagattgaaatgttggttgtatgtggtaaatgtaagagtaatatagttttttgtattttttttattg

(The sequence listing continues in the following parts.)

The invention claimed is:

1. A method for determining the presence of a cell type in a biological sample, comprising the step of determining the expression level of HIF1A, whereby said expression level of HIF1A is indicative of the presence of said cell type in said biological sample.

2. The method according to claim 1, wherein the step of determining the expression level comprises determining the level of HIF1A mRNA and/or protein expression and/or performing an analysis of the level of an epigenetic marker of HIF1A.

3. The method according to claim 2, wherein the epigenetic marker of HIF1A is the methylation status of HIF1A.

4. The method according to claim 3, wherein said analysis of the methylation status comprises an analysis selected from promoter methylation, CpG island methylation, and/or analysis of at least one CpG in SEQ ID NO:156, or a sequence complementary to SEQ ID NO:156.

5. The method according to claim 3, wherein said analysis of the methylation status comprises at least one of the following methods: MSP, HeavyMethyl, MethyLight, and Ms-SNuPE.

6. The method according to claim 3, wherein said analysis of the methylation status comprises a chemical or enzymatic conversion of the DNA.

7. The method according to claim 6, wherein the converted DNA is subsequently amplified.

8. The method according to claim 2, further comprising a prediction of the quality and/or suitability of said cell type as a therapeutic, wherein the level of the epigenic marker of HIF1A is indicative of the quality and/or suitability of said cell type as a therapeutic.

9. The method according to claim 8, wherein the epigenetic marker of HIF1A is the methylation status of HIF1A.

10. The method according to claim 2, further comprising an estimation or prediction of the potency of said cell type in its use as a therapeutic for an individual or between different individuals.

11. The method according to claim 1, wherein said cell type is present in said biological sample in a cell population, cellular batch, a heterogeneous population of cells, a sub-population of cells, a tissue, an organ and/or a non-human organism.

12. The method according to claim 1, further comprising determining the identity, cellular status, composition, relative proportion, absolute amount and/or potency of said cell type in said biological sample, wherein the expression level of HIF1A is indicative of the identity, cell type, cellular status, composition, relative proportion, absolute amount and/or potency of said cell type.

13. The method according to claim 1, wherein one or any combination of the following cell types are analysed: keratinocytes, chondrocytes, osteoblasts, melanocytes, fibroblasts, adipocytes, or mesenchymal stem cells.

14. The method according to claim 1, further comprising detecting and monitoring the response to chemical and/or biological substances interacting with growth or differentiation programs of said cell type.

15. The method according to claim 1, wherein furthermore the expression level of at least one additional gene selected from the group consisting of C15orf27, COL3A1, CAV1, PRELP, SPP1, CHAD, ANXA6, KRTHB6, BGN, LTA, FGFR1, GDF5, PTHR1, BMP4, GLI3, COL2A1, IGF2, LPIN1, TDGF1, KRT8, CD4, CNTN1, COL6A3, FMOD, PKNOX2, ROPN1L, and ACVRL1 is determined.

16. The method, according to claim 15, wherein the additional gene is C15orf27.

17. A method for determining the presence of a cell type in a biological sample wherein said method comprises:
  a) contacting said biological sample with one or more probes selected from i)-iii):
    i) a nucleic acid molecule comprising a sequence of at least 18 bases in length of a segment of chemically pretreated genomic DNA derived from HIF1A, or a sequence complementary thereto;
    ii) an oligomer comprising at least a base sequence having a length of at least 9 nucleotides which is complementary, or hybridizes under moderately stringent conditions, to a nucleic acid molecule according to i), and
    iii a set of oligomers of ii); and
  b) determining the level of HIF1A mRNA and/or the level of an epigenetic marker of HIF1A in said biological sample, wherein the level of HIF1A mRNA and/or the level of the epigenetic marker of HIF1A in said biological sample is indicative of the presence of said cell type.

18. The method according to claim 17, wherein said cell type is present in said biological sample in a cell population, cellular batch, a heterogeneous population of cells, a sub-population of cells, a tissue, an organ and/or a non-human organism.

19. The method according to claim 17, further comprising determining the identity, cellular status, composition, relative proportion, absolute amount and/or potency of said cell type in said biological sample, wherein the level of HIF1A mRNA and/or the level of the epigenetic marker of HIF1A is indicative of the identity, cell type, cellular status, composition, relative proportion, absolute amount and/or potency of said cell type.

20. The method according to claim 17, wherein the epigenetic marker of HIF1A is the methylation status of HIF1A.

21. The method according to claim 17, wherein said one or more probes are contained in a kit.

22. A method for determining the presence of a chondrocyte cell in a biological sample derived from a human, comprising the step of determining the methylation status level of HIF1A, whereby unmethylated HIF1A is indicative of the presence of said chondrocyte cell.

* * * * *

UNITED STATES PATENT AND TRADEMARK OFFICE
CERTIFICATE OF CORRECTION

PATENT NO.      : 8,298,762 B2
APPLICATION NO. : 11/908392
DATED           : October 30, 2012
INVENTOR(S)     : Sven Olek et al.

Page 1 of 1

It is certified that error appears in the above-identified patent and that said Letters Patent is hereby corrected as shown below:

Column 20,

Line 60, "$M_1=ax_{1a}+bx_{1b}+...nx_1n$" should read --$M_1 = ax_{1a} + bx_{1b} +... nx_{1n}$--

Column 20,

Line 62, "$M_2=ax_{2a}+bx_{2b}+...nx_2n$" should read --$M_2 = ax_{2a} + bx_{2b} +... nx_{2n}$--

Column 24,

Line 20, "Gene J=" should read --Gene J=Col6A3--

Column 37,

Line 53, "gene regions (FIG. 5) are summarized" should read --gene regions are summarized--

Column 38,

Lines 26-27, "respectively. As shown in the upper panel of FIG. 6, MS-SNuPE analysis of melanocytes" should read --respectively. MS-uPE analysis of melanocytes--

Signed and Sealed this
Nineteenth Day of February, 2013

Teresa Stanek Rea
*Acting Director of the United States Patent and Trademark Office*